United States Patent 6,812,339 (POLYMORPHISMS IN KNOWN GENES ASSOCIATED WITH HUMAN DISEASE, METHODS OF DETECTION AND USES THEREOF) - sequence listing, part 46

SEQ ID NO: 14516 - DNA, 203475 bp, Human
  misc_feature (1)...(203475): n = A,T,C or G
tcaagtttctggataatcttgctgggggtgcatccccctcactgtctgtgggaagccaaggtcaaggttatggagcctgaggggcatggggctgacccagacaccatggccctgcctccccgcatctgaccagtccaggcatcatttatagggtctgggctcccctcctgagtttgccatctccccaaaggacccagagtggaggctgggggctgtgggaatccctggctggagtggtggaagagggaccagcgcaggtaggagcttgcggttcccctcccagtgtggaatggctggaagagggggagtcagggacaaggcctttgcacagctgcccacccgtccacactctggaagacccttcacaccttcctgagctctgcctggccccagtcctggagctccttgttggtgctgctctctggggctctgcagagctgttatcctgctgggccctagtgaagccatggcaggcttcggtttcatgtacagtgatgggaaggtggacagagaaggcagaaactggtgctgcctaggcctcagaccccacaggcaggtctgaggagctggtggagtccctgactgtccccccagggccctgcaggcaggtgatcttttcttggagaagaagaaaatgggagaagctgcccatgtggggcagctgctataataggtgttacgggccatgctgggaaggctgactgtcttcccagtaccctgggagggagggtactctgcatcactggggagcaaactgaggctccgagaggggaagtaacatggccacagacacacagtggatgcagactatgctggtccaggcacacatgcatctctcattgtgggagaattcaatgcctcatgttttaaaataggattattttgccgctggcagtaaaatgccagaagtcctggggaacccttacgttccccacgtccctatctccttcagggtggaggagtgagtgtaaatttgtctggatgggacagtggggactgacctgaggagtcagagcccgctttgctcctaggctgccagccttggcattgtggcactggactggtgtccctgaggtcattttcccagtggagacagtggtgtgaggggagaggaaaggactggtgcccagctcctggtggatacaagacagagtcctcagggcctcaggccgtgagtcggctgcttcccttttagctgtcatgaggttagaatgacgatttcccttaatcagggtggcggtgtgctcttcactctgggaaatttcactttttatctcattggatcttaaaaataagtctgtgatcaaggcagggcacatgtttatctctcatgtatgtgcatgtgtttgcctgggtctgtgtccttgtaatatatacatgtgcatgtgtgagtgttcatgtacctctgcatgtaactacatgtatcctgtatgtgtgcacgtgtgtggctgcatatgtgctgtgagtgtatgtgtgatgcaggtgaccatgtgtgactttatatatgtgtgtgcccatgcacacgtctgtgactttaatgcggtgtgcacgtgtgtgtgtggcctgcgtgcaggtgtatgcatgtgtgtggctgtgtatatggtttgtcggcgtatgttctgtgtgctgtgtgagtgtgtgagcctgcgtgtgtgtgtgcatccatgtgtgcctatgcgtgtgggtcctgggcacgcatgccgcacgactgagatcacagcagaggtgagaacaccgtggctctgtggtggctgtgactgctgagaggcgaggcttcatctctctcctggagattgattttgcctggggaacaatgctctaattcctgtgagtcactcgttagaggagttcaaagaaaccaggtggcgggagggtgtctgggatttcaggtttcagggtgattcgctcattctgctctgattactaatttattcttcaagcaagtcctttaactcagagttcttaaccttttctgcgccgtgggccccttggcaagcaagtgaagttcgtggactcctacaataatgctataaatgcatagaagaaaagacacaggactgtgaaagaaagtgatgatgcgatgtctaaaacgttcaaggcaccgcatctgtgatcaagaatacatgtgctgctttaccgacacatcaaagagcaaggtcagccgtgggggctaatgaatggctagcataagtgggacaccacggtgggcttgggcatagctgcgactcatgccagtggcagcctgagggagacaccaacttcagctccaaactagcaaagataaaaatgtatcttttcatcaggttagatagtcctgctttaactggaacttgtagattatttatttatttatttatttgagacagagtctcactctgtctccaagctggagtgcagtggcgcggtcttgcctcactgcaacctccacctcccaggtccaagcgattcccctgcctcagcttcccgagtagctgggactacaggtgcacgccaccatgcccagctaattttttgtattttaatagagacggcctttcatcatgttggtcaagacggtcttcatctcctgacctcatgatccgcctgcctcggcctcccaaagtgctgggattacaggcatgagccaccacacctggctgaacttgtagattatttggaagccagaagggaccttatgagcaccccgttcggtttttcatatacctgcttctgtatcagaaagacttgtgcaactaacagaaatgcagctcttcttgccaccccctgcctagacttggggaatcacaatctccaggggaaggcccagaaatgctcctgaagcatcttgctgtcaccagtgcccctgctgaggccccagagggcaggtgacctgggtgaacctcctaacggacagggggcttctccgggccctgggtcccgggtgcccgctcccacccccttagcagaattttggagagtgtggctgtgtttccttcgtggttgtttggacagcggcagagctgtgtgttttgaaggtaaagtgaggaattgactcttctccttccctgtggtaggtgctgtgactcccagtccctctttttctggagctctgtggagcccgtgggagccatccctggagagaccctccctgctgtccccaggcagcccctggaggcccagatgagactatccgctttggctgcagggcttgacgggcctgcctcagatgagctttggggagtgaaagtggctgcctgggaccctgggcgcctggtgtttacctagaaattgtgctaatcccgctaattcctgtgatttacacagcctcttggctctgtgtactatcttcttctccgggaagtggtgggaaggcgaggccacggatgcagtgggcactgcctggaatccccccgctgcatctgctccccacaggcgttcacgaaacctcaggtgcatctgtgtgcacatcctctccctgagccacagtctgggagctgggcatctgaataaatgcccctcctccctcactacattcaccctgtttctggagcgaccacgccctgaggtgtcaggaggcattttggctggaggatctgactgtaggcctggccccgtgccttcctggggagtggccttgggcagctcactccccatgggggcctcagcttcctcccctataagaactggtgatgacatctgctgtgctgaagtgaataggtggggttgccatgaggaagccgcagctgctgtgttttgggtccgttcttcacggatggagccttctagttaccagcttgagctgggcctggctgtgggaatgctgtgctgaagagctcctggcctgaaggtgatgaatgtaatacgggggtgttgagtaggacatgatctgactgcttcagggctgcaatcatgggctaggaggggaagtggggcttcctggaggaggtgacgtctgagtggcatcttgagagtaagagttcatcagacacagaaaggtgaagggtttccagtgagtggcatagcttgggcagaggcctggctgtgtgcaagggcagagccagttatccctgttaggagggtcaggcagccagggagctggtagggagaggaggctttaggtagacatgggaagactttacctgaaggccaaggggctcagcaggggagggatggagtgatatgtggtttctgggaagatgcctggctgaagcacagggaattacctggagtggaccagaggtgtgaaaagtgccaagacccagaggggaaagagtgcctggcacagagcagccagcgggagaggcagtgctggtgaggcgtgcgagtgctggggggtgtggggtgaagtgatggggctcacagtcttcgtgtgtgtggcgaggagaggaggaaggtgtcttaaggatgcagctcaggtggctggtgtggtggtgcctgtgaccaggtaaggggcagaggaacagcaggcacgaaccagtgtatagtgctagtaggccattcagatagccagactcttaaggggcggattttaaagtgggcttaaaagagcaggcagcaatccctgaatttctaggccaaaaggaggcccctgactcaccagcaagcagatttttctctcccccatctgcctgactttcttgggctttctgggcagggagttttgaaagactgtggaaactggccaggctggtgtgtgcagatgagccaggagctgacaggagctgtggacatccttcatgtggcccctccattgttcttgtgtactcatttttttctacttaaaaagatgtgggagtattgtgtggatttaaaaaataaaattctaggccgagtgtggtagtgtgcacctgtagtcccagctgaggtgagaggatcccttgagcccaggagtttgaggctgcagtgagctttgattgtgccactgcactccagcctgggtgacaggagagaccctgtctcttaaaaaagaaaaattcttggctgggctcgttggctcacgcctgcagtcctagcactttgggaggccaaggcaggtggatcacttgaggtcaggagttcaagaccagcctggccaacatagtgaaaccctgtctctactaaaaaatacaaaaattagccgagtgtgatggcgcatgcctgtaatcccagctactcaggaggctgaggcaggagaatcttttgaatctgggtggtggaggttgcagtgagctgaggtcacaccactgcactccagcctgggtgacagagtgagactctatctaaaataaaaaaatgaaaaaaaaaaaaacaacataaaacagaaaagttatagggcctactaatgtggatttagctgagggccccgggagtggagctgaccactggtgtctgcacactgcgacccccgtccccacactctctgcaggaccttcacacagctgcccataacctttctgccccactcctccaggtgtccagccaaaaatgccagctatcttccccaccaccttctttaaaacatgtgaccggccaggtgcggtggctcacgcctgtaatcccagcactttaggaggccaaggcgggcagatcacctgaggtcaggagtttgagaccagcctgaccaacatggagaaaccctgtctctactaaaaatacaaaattagccgggcgtggtggctcatgcctgtaatcccagctactcaggattgcaggagaatcacttgaacctgggaggcagaggttgcggtgagccaagatcgcgccattgcactccagcctgggcaacaagagtgagactccagctcaaaaacaaacaaacaaacaaacaaacaaaaacaaaaaacaaacatgtgaccatcagatttatcttctgatagaaaggctggattgccagtgtctgctctgacccaccactcagctggagacggaagttgcccatgccccgaatcccgctgggtgttcctcccttgctcacagccactttccatccctccttatctagtctgtagcctggtctgttggctctgccttcaaaccatgtccatgtttcaccagctccaccgccacctgcttaacccaaaccaccattgtctctccctgggtcactgcagtagcctcctctccccgaaaagcctgctctccgcacacagcaatggagtgacccttttacacccggagtcagtcctgcccctcccctgctcaagaccctctgatgcctgcacttcccttctggccactactcaaagaagccagcctcctcccacaaggcccctggctcctggctttgccctctgactgcagtggggtggcccctcaggcatcccatccctaccccagagaggcctggcagcgctgccccgctgtgcccctgcaaccctctctgtcctgctttcttttcctgagccacctcccactcactgagattaaatctacatttattttccccttgtttgcccccaaggagaatgtaaactccacatattgtatcttccgcaccaggcatgatgcctgatgcatactaggggcttaaaaatatgttgactgagtgcgtgtgagtcaataaaggatgaacatttattgaatgaatgggtgaaggagtgagcgaacatgcagatgaataagtgaaaggttctggtgagcagggaagccacctgaaaatgagggcctttctttgaggacctctaggtcattgtcactatatttgtttttattttccccatgattcacagacagaggtcattgtttctgactttatttccctcatcagaggctacccgccactcatatcagtaggaacctgttacttagattttgtaaaatctgggtaaaagatgatgagaatggcctgcagttgtccgtgaggtcgttcagaagaccagacgaatcccaggactaataattctcaaaattaattaaaccctccttcccaattataagagaattagaatgaagttggttgctttaggagcgagcggcggtgtgaatctgggtcggcgtttcccggctgggtttgggctcagtgttggtgagtgtctttgtcttctcttttaggattgccacccaggacgatgagcggctgagatggagacgtctgcctcagccactgcctccgagaagcaagaagccaaaagtgggatcctggaggccgctggcttccccgacccgggtaaaaaggcctctcctttggtggtggctgcagcggcagcagcagcggtagctgcccaaggaggtactttctgtttcgcacacttggagggcagcaggggtgtttttcattagcccgttaggatttaattagagtggtggcccatgtcgtcagggaggcatgctgggtttatggagggcgaagaggaaggcacctctgctcccaggaatcccaggcaccatgaaggtcacctgtgagtttgctaagaggtctggccaccccaagtccagggggctgagctgcctcagacagcggtgggtggggcctgagtactgggaggggagagagggaagaggggagagagggaggaggggcatggtcgctgccaggcagccctggggtgcgtgcagctggcacatttgaaatgtgcccagagaacttcttgcctcttgcccgccaaggactgttttggaaagtaattgtctcctgatgccttctggctctaattagagggtcaggttcgggatttactatcttaggtgaatttttggccaacttaattataacaaaagagactacacgagccacagcctctcattttactgccccaaagagaaagactctctggtttctactgggccatccgtgccagcatcccgttgggaaagtttggcgggaaggcgagacctccgctgtgtctgcacagtccatctggaggccacagaactatttctgtctcggaggaatggagagacttcgatttcttttcctccctttttgttccagtgcatttagtcaggccctgttgctctcagggctgaggcacagctcagagagcaggcagggaagagaatgcgccttttcttccggcgggcgcttgggcagcgcccctcacactttgatgtatacacagttgttgggggcttgttttggtggagaccccgattcaattaagttggggcagggctggctgagtttctgcatttccgttgggtgccaagatgatgctggggctgctggttcacaggccacgctggggccggagcccaggaacatggaaagaccctcggaggggcttaggagttggtgcttctacgagtggacctgagggcctgcggggggttgttactgtatttacttttatttttcctgcggttctaagtgggaggtcattattgggatgtgtggctcatgtcaggaaagggagatctgaggtcaaccttcaggccccttggggaggtggccttctgagctggacgatgcctctccaccctgtgccccttggacggggactctctaggccctccctctgtgaggaggggccagctgggggtggaggaagagctcttaggtggagtgggaggagccaagcgcacagggagggaagagctggtggagcggccctggtcctggggccacacatggtcttttccttcccctgggtcagggccatccttggcctgtgggggcacctaaagctgcccctctgcccatgctctgaggccttgtgagctccaggaagcctggcctctgtgtatgtctggcctgccccagggttttcagcgggaaccatccccccatccctccgccccacaccctgcctctccaagccatgagtggatcatgaaccaccatggtgcaatttcctgatgtgtcacattagtagaggacagacttaggcagtaattagacagtaattagaatgtaattgccggggagcccctctagtgtcaggctgagttctcattattggtgcaatagcaacagatgcttgagggattctcaatctgtggcgggagtaggggccaggcaggaggcccaaagtttggagtacagcacctccacaaaggccctcacctcccaaccccaccccactgcagcacaccctttcctgcccaccccgcaggcccttgttgtctgatcgcagggtggcttggctggtgaggttccagcggagggtggacccagccttcgtgagcatagttgccacagggcaggtggcctgttagcttcagagcagtcttgggccatgtgtctgctgctggagagttgtgaggaccccagagcctcctcacccatcgctgctccctgcacctgtctctgagcagctttttttgggaagggtcctcctggagtcaggggagagcagctgtccctgcgtggcgcaaagcagggacatcgtgggccaagtctcctagtgctggtaaaatgcgacggctgcattcgtggatgggatgggaggtgcgctggcctgggtcccagttttcctaatctgtgtcgagagtggatttgacaggtgttgtccacagtctttatgatcttggaacttcgggtcttccttaaatgttactggatggtggcagaggtgcatgagcaagaatcctcatgtattcagcaaccctgagtcccccagaaggctccaaagagccatggatgtgggcctcactgcctgcgggagtacagacctgtcagcaggtgaggggaatgtgcggaaggaggtgcctggaagctgcaggtggttggcgtgggtccccctcaggggcggggatgctcttgtgttcatctctaggtctcagcatctggtgctgggcctggcatgaggggtacccaagggtcttctgggactggaatggtgtaggagaaagggtggcattggtgaaggaggaagtcttcatgggccagaagcgtttgctgcagccactgaggagttgggcactcagccatcaggcacagggctgggtgtggacagtgggtgaggaggggccgtgagggactgtaccaagcctgggagagggacagtgccgcagggtgcaccccgggtggatgcaagggtgtggggagctgagaatttttgttgaggggcccctcttctcgagttgtttctggcaaagacgaatcatcttggtctgggcgactgctctgaggcctgtttgctgggggcaggagcagactgagtcgactcccctgttgctgcgcaggtgaccacttagaagcctggctcctctgaggcctggcttgttcctccaaatcccgtgacattgtcccccatggttcacaccctgatttgctgtctggcggaaagggatgatttattattattattattattttattttttatttttatttatttatttttttgagacagtcttcactttgtcacacaggctggagtgcagtggcacgatctcagctcactgccagctccgcctcccaggttcacgccattctcctgcctcagcctcccagtagctgggactacaggcacccgccaccacacctggctaatttttttgtattttttagtagagatggggtttcactgtgttagccaggatggtctcaatctcctgacctcatgatccgcccgcctcagcctcccaaagtgccgggattacaggtgtgagccaccgcacccggccgaaagggatgacttatacgagcttagtgtttcctgacttattacacatcagagaaggtgtggggtgggtgggtcttatctgaggatgtcaggggcgcagtggtgaggaaacagccaaatcctgcaagctgtcaggggctgtttcctggcatctgtaaggtatccagatgtgggggcaccctgcattccccggcagctcatggcccctcatgcagcctcccccacccctcactgtcaccagttccgagagcttccattccacggctagaattgcatggcttgagttggttgaaacagtacacatacctgcaggcagaaggatttcacttttttgtttgtttgcttgttttttgagacagagtctcactctgtcgcccaggctagagtgcagtggcatgatctcagctcactgcaacctctgcctcctgggttcaagccattctcctgcttcagccttctgagtagctgggattacaggtgcccaccaccatgcccggctaatttttgtatttttagtagagatggggtttcaccatgttagccaggctggtctcgaattcctgacctcaagtgatccgcctgccctggcctcccaaagtgctgggattacaggcgtgagccaccttgggatttcacttctgagttctttatatctgtgaaaaattgaaaacagcctacctgttcattgataggggattggttcatctgtggaacatcttgaatggaacacgatgtagccactgaaaatgttaattaagacttttcaattacagggtgggaacatgcttgtattctaatattaagtgggataaaaagaaggtgcaattgatctcaagcacccctagcaatgagatagaaagtgaaggttcagagtgaggagagaggacatgaagggggtgggaggccccagccggaaagctcggaaaacccaggcaggagctcctggatgccaggctggtgtggtcagagcctctccttcagtacctcccgtattgtagatgagactgaggcccatttgggcatggggcttgcccaaggctaccagctgcttcaaccacgagctgggcccggggcttggggctcctgcctctcacatggtgagagtctctttcaggtatttgcttttagattgttatttagattgctgttagacttgggccttaatttaggtcctactgctaccccagggtgagtgtccagccttggtaaggtctcctcatgtgtcttcatgcctcagttccctcatccatcccaggccctgatggcacctgctctcttccaaacagccagttatttgaggtctggggccgtgagttatttgcaaagtcacctacctcgactggcctctgttgcctgacttcccctaggagtccatgaggtcggacctgttgggggctgggtgtttccacttagagtcactatttccctgtgccagaatatgcgtgagaaatatatttgcagagcagagcatggctgggctggaccgagctggaccaaaggaaaaagcagccctgtggtcagactggggaaaggttagtttaatcatctggctggagcagttcataagagcagacggcagaagcctgggagggcgagttctttcccagtctcttttgctgttgtgctaacactttggaggccataaatcttttaaaacacattttggcccagaggttttcccctcctttaacttctaaaatggtgtaattttaaaagcaatttgattcagatgtttctcattgctttatactgaaactgtccaaatgctgttgtattttcctcctccactgtgggttctctttcaaaaatatttctgaacctctctgtgtgcctcactgagcaccagggactactattcagagcctctgggataatatgaaaggtggagccatgaaacccagagctgggtctgatctcatgagttttgctagtttctggaatcaagcagccagacaggctttagacatcctgggatgtacctgcaatggccaacgcccacctcttccacgaagcatccactgtgtgctgggccaggtgtcctcccagtgtgggccgcaccagcaacatcagcatcccctgggaattgttagaaatgctaattcttgagccccaccttagacctactgaatctgagtctgtgggggtagagcccagcaagctgtgtttacacaaaccctcttggtgattctgatacactcctaagttggagaaccgcatgttctgactacatgaggtagggtgggtcttcccatacataaaatgggagttagacacagagctgcagtgcagagattacaggagacttctgatgtgcttacacaggcctgccagggcacttcctggatagtagctgtaacactgcctctcttagtgcaggcagtgctaaggaagtagtgagaagcagcccaggctctggaaccaggctgcctggttaagtcccagttctgttgaccttaggcaggtccgtgcctcacttttctcatctataaaatgggcatgatcttggttgtgagcattccttgagttagcacatgggaagtgcttcgaaaagtgttgggcacagagggccttgtgtgaggtccaagttgagtatttgctttatgaactattgctattcttcctaccagttttccttttctagatctgcatactctgcctgacttagaaagtttccctttcactggtaacccttgcctgctgacccgttgaggctgacagcaggtgggaaacccaggtttctggtgacttcctacttgagagtggtgggtgccctgggctggaaatcagacctgggtgcctgtcccactttgctttgctcccagggcctgtcctgggtgtctgtcccgagtgggctcctggcctctctgacttggtcttttccccagcacgctggagaccagaccagaccaaaggttactaaagctggccaagccttagactctcgtgacaatcactatgtaagtgcagggtccagggcagcccctgggctggggcctgggcatatgtatttttaatacgcttcacaggtcattgggcgcagtccgtccaaggcatgaacaagatcccttggagtattcaagagtctcagggggggagactacggtttgcagctggtagtactggcggggctgtgaccaggctagcatagctagggtcaagcactagacgactttcagcagagcgctccagtgttccaggaggcgtgtgtgctacctactcatactgacagccctcctatcttcttcattggccctgctgggttcttggaaagtttttctgaggcacagttttgcttagtggcgaggcatgcatgtctatatgggaatgctgtgcaaatagcagaatatttagacgactcattttcattgtgttggccagagctagaaaatcccctcccaccacctgccttaccacacctaggaatctgtccaatacccctccattggtacgtacctccaagtccctggtgtctttgcactctgtctttttctgtgcctccaggatgtccttgtgggcagggcattgcttgttcaccactgtccccacatcaccgcttgcagcagacatcccataggggattatggaatctgatgctatcatgccagaggtgttcccggtgggctggtgtggtcagctgtctctgggtataagggtcagttgaggctggccgtggtctttggcccccctgccaggccccatggccagcagggagctgagtgggccaccttccctggcttatccgagtttctctgctggggccacacacttttgccttggacctgatgcacccaggtgtgactaagtgggcaattactcttatttaagtgattttcaggacggctgttgatgctgctgggcttgttttatggcccagccatccagaacaaccagttcccctcagactttgtccagagagcagagctgagttcccctgacagcctggttcacccaggaagcggggtgcaggctgaccacccagatgtttttcagatggttcaggagtgtactgcaaggttggacgcctggggcgggagcatgaggttggagacttcttcctgctcccagcagagtctagtgggaagagcatggcttggggtcaggcagatctgggctcttcttaccctctgcttaccagccgtgtcttctgggcaaatcaaggaacttctctgagattcgtgcagtggcgatggtagtggtcactacttctggctaccatggaactaagcgagacaaggtctgcagggtggctagcagagcatgtgggcacggaggaagtaaatgtccacataacggaaacccgagcattcctctggcctgtcctggcctcacactcactgccactcagaacggctgccgtccagaatcagcctggccgccccatttccccaagcacaacaggtttgttctctgcttctggccgcagcccggggtctggactctgggaggctctcctggcccctgcctgtcgctccccttggttgcagagaccggcacacatgtttcacgtcacctctgtgtcaccttgttttctggctggttcctataagctggtgaaccctacctgcctggaatgacagtgtcagaggacagtgccggtggctcctgcccctgtgtgctccctggggccttggccatgcctggccggcactccttcatttctcacggttcactgtgaatgttcagctgatgcagagttgggtgaagcttcaaagtcatttccacttacagaactggaagaagcttttgaaatcctctagtttgaatccattcattttacagatgtggaaactgaggtccagagacacaaaatgcagagggttgcctagtgatattacttggactggaaaccaattccgcaggaacattccatcacatgggacacagctgtccctcaacctggccctcctcctggcccaaaccccaacttcccaagtgactgtgtttatgttggaaacatttttctgacgtttggttctgtcaaaactaattttagcatttctaaagcttggtaaaaatacagcctcattactttgatgtcagtgcatagtttactattagtatattctggggtttatcattttagtcatgtttaacacggctgtgccaggcatgcactattaaatctggcttattttacattcctgtccggaattatttatttgtaacaatttcctctctatcaaaagacacagctaatgctgtgttttaatgtgttatttacacacaaaataacctatttacaactcagtatgcgccggagggagaatggatgggcccctgttccctgcattctgttatatcagagtttaacaatctggattgctaatagaaccatttatcattacttgggagggggggaaagagataatttattttatgtttgtggccaggtctcaccgcctctgatcttgggaccattttgaggataatgaagtgaagccctgcatttggtgggggctgtggggcacccgggcctgggtgcctctgggttccctgcattcatgtgcacatcctacagatggtcccgaactgtggaccagagaggtggtgatgacagggacgttgcctctgccttctaggagcttccagttagaggtgacactcagcagatggtgacgaatcctgcccatagggcttcacgggggaggcagtgtctgagcctggggacattcggggttccaccaggtggaaagaggaaagggtgggtgggccctggtgggaggaggaggggcagagtggccccctgggagtgtggggagggaggactgggcgccatcagctcagtctgtatgtctcctgcgtgagtccatatgtctcctgcctggcatatggggtctgaaggacaaggctcctgttgccctgcggggaggcgcagagatggctggcacccaggtgggtgcatagctgatccagggtgcaggccgaggtcccggaggctccactgaagtctctttgaatggacattgaggggtaaggagggaaagcgccatttgaagctgctgtcctctatgaagctctgtgtggacaccagagggggataggaagtgggggaagatgcatttaagaagcaggggccatggccctgtccccaaaagcttgtggttcccccatggagaaaccagacaccccagttacgatgctgatgtgggcattgtctgctgcctgcagtgatccaggaaaacattagggaaggagtgtggtctcagtaggacctggtaacactgctgtgtacagccctgtgacctggctgctcagtcagtcccacagaaagccactgtgcactcagatcagggggctggggagggggtcaccaaagtgtgattgcaaagtgtggcagggcttgggcaagccccctggggacgatgcagggagccatcagccccaggacaccagcatggtctgggggatggggcctgggcttggacaggtgaggtttgaacccttgccctgccccttctcggttgggtatcctgtgctgatccgaaccccagtgtcctcattttaaacgcaggccaaaatgcgtatctttggagggctaggctgaccaataatgagactccagtgcttagagggtccctggcacacagttggcattctgtacatggtagttcagctgttagtattatggttcttgctcttattatgattcttaattcaagaactgttttctgagggtagcgcatacgttccttaaaaatatttgagagagcaaatgaaggagctgagtctctataatgagttagcagttcacccgtgatgtgcaaggaggaaccacactctagcctgagaaacagcatgggcaaaggtcctggggtctgagaatggctggagaggctgagctgagcgggaagcactggcaaatgaggctggttttgtcagccccttggcaaagggctcccttccctccccgatcctggcacaagctcacatctgaggccgagtctagtggcccctcctagggtctgtgtcctccctctgctcacagccacacgtggacgctggtaactcagccaggccctgtgtgcacggcttgcttggaccacccccccacacacctccccgcccccgccaccctgagcatctggcttcttctccttctgggtgggcagggtggggagggagccagaggggctctgtcttgagaagccgcccttggctctttccccttgaatatgtcctggctggccctgctgtcagagggcgtggacctctgctttgtgttttgggggattgtgaagcttgaaaccctggcaccagacagccaggcctctgggcagagcagggcctcatccgccgtctgactttccatctcgttttcagcagtgatatttgagaggaagtttgggtttggtatggagccgggcagtggacaccgctttgcaccttctattatccctgcaattctagaaatggaaggacgtccaggagaagccccttgcagggccaagcatgtggtctctgtgtggtgtgatggtggccagggtggggaagtccctgcccccgccgagtgctgcaatcccaccattaggtgtttacccccttgctgtcaccttacctctgggtttgtgcaaaggcccctgttgtccatcatcctcctgtgacctctccccagtggctcctggatcagctggagagggccaggcttctgagcactggagtacctgtgcctggggaagctcacccaggagagaagagggtcagggagggaagaaaaacttgccaacgacacactttgctgactgggtgagttgctgaggctcgatgtcagcgagatctttgtcctgttgccagtccccagactgtgaggtttccacgctggagtcaatggccctctacgccatgttggtgacaagaaaagcaacaggcaccttcacttagaggacagacaagtgtgagttcacatctaggtgtaggagcaggggccacccttgccttgtctgtctgtgaaatgggggtgacaaggctcccctcagccaactctgtagtgcagggtggcctggcatgtgggcagcgggctgctgttgttattctcatgggatagtggcaacccttgcctgaaagcacctgaggccgtttgtgtcttcagtggctcgggcactgtggagcttcccagctgcccatagttctcagcagcgcccacatgcctggccccctgggttttctagctccaggtcatcagggagggaggacccaccagttccactcttcaagaactacctccgataattgaaaacctatgtgcacacaaaactttgtatatgggtgtttatagcaatgttagttacgatagtcccaaaatggaaatgacccaagcatccatccgctaatgaatggatgagcagaacgtggtatgtatgtacaatggaatattactgagtcataaaaaggagtgaagtgctaatcaatggtatacacaaatgaacctcgcaaacatatgctaagagaaagaagccgggcataaaagcacaaatattgtaggattccattcccatgaattgtctagaatgacaaatccatagagacagaagggagatgaggaggtgccaggggctgggagaagagggaatggggaatgattgctatgggcttggggtttctttttggagggatgaaaatgttctgtaattagatagtggtgatggttgcaacagctctgtgaatgtactaaaaaccactgaattgtggactttacaagggtgcattttatggtatgtgaattacatctctgtttaaaaaagaagggagggaggagaaagaaaggatagaaggaaggaaaagaggaaggaagtgcgggggagggagggcgcctgtggcggcatgggggcctggtcgtgctgctgctcacagcccctgggatctccaagtgccttgtgcaccgctacccctcagggaggaccctgcttcccctggccaatgagcagccttcccatctaatctataggccccagaagctctaaaaataactgaagtggaagggggatgtttaatgacaaagtaaataattacattaagggtgcgagtttggaggggagctgagtaaatcaccgagaaagagcaccagcctccagctaacttccactcctttatcaccagattacatcctccttggaacctgaatcattgactgtggctggtggcaggctctgcagtggtgggggctgcggtcaggcaggtgctgagagagatgccctgtgagcatttcagggtgaccctgctggccccaactccaggtggatgagccccaggggcgggggccctgtgctgctggaaattaactactctgctggggggagccaggtctcagggatggcctcacagccttgctgcccacagctggagggggccaggcttctgagccagagtggcttcaggggccatttggtccattgaggtccaaggagggggatggtcttgccagtgctacgcggtgagtatctaccagatcttggtagggagatttctgggagtggtgttcccagtccaggtgtgctgggccgtcttctgtgttgagagcaacatctgcagtgggcaagccccagacagactgtagccctcggaagtggcagcgttcaccagctttggcatggtgtgggctggggctgtctggcacacctgcccacctcccctgtcctggcctggagccctcatttagtcccttccattgctgtccctcctccctctacctcatggcctcatcctgtcctcagggaggcccagccaacagcctctctcctctccctggccctgtgctacccctcaggatatagaggatgggcaggctcccaggcttatgggatgtgctaataggggcgcttggaagggatgaggatacagggagacagcagtgccttggcctgaagggacagatcttctcgatagaaactgagttaggacacttggtgcaagcaacagaagcccgctctggctctctgaagctacgtggcgttctggtcctccgtaactcagaagttcagggttagatttgcttttaggactagctaagcttgaggctccagtgacgtcactgggacatgtctctttctgtccgtgatctcgattggctttccgctggcctggcattctgatagctctgatcaccagagggtggagttgctgatgtgtgcctgatacccatgagctcagatggaggagtgtctcattccgggtgattccaggaaaagccctgggggcaacttattggctaggcctgggtcccatgcacccttgtgaaccatccactgtgaccgagccatgtagtattttgtggggtcccatgcatacctgtgcaaagtggggtgggtcagcccccttatctgctggagctgtgcatagaagggtggcccatgtgctgctggtcaagccaaataccagtgtccgcctccctgaagccagatggcaggaggagtgtgcaggagacccggagaggcctgggctcctgtagacatccactggtggatggtggggtcagagttgggcccttcagaagcagcaaggagtcctctggtcattctgtccccccagcctcattctttgggttgtgccaggggtgctgtccccctcccctacttgtccttttgagctccccataagggtacacaaagtgctccctgagaagtgccagaccagagccttggagaggaaatgctagaaagttccaggggtggcatcgctaaggagggctccttaaagaatgagagagctactgggaaggtggaggtgagcagaggctcaacggggggtggatgacagggcatatgccagggcagggagcagcgcctgctggagaggaggcttcatactaggggtaggaggagaggtgcagttggaaagggaggttggaatcactgtggggagcctgggatgccctgagaggaatttggatggaggggtagtagggagccattgaagggctttgagcaggggaggggcatttagaatcagcacatctctttgctgattgatttgaagcattccatacccacaaatgaaatcctgctggacagctctgcttttcagaagattctttttcctccctccctccctccttccctccctctttccttctcttccttttttccacaagtgtttactggggccctactatgcgccgggcagtgtagtccctgggtggcagcagcgaacacacaggcaaggtccacttctctggaactgacattctagttgggagacacaggcaagtacccaaatcaatgactgtgcggaacaggatgtaagatgggtattctggcagggagagatgggggatcggcggcctcagccttccttgagacaggaacacttttcccagggttgttgaagccactgtctctctcaaatgtgctggttagggcgcaatagaaaaccacttcctctgctgtgggaggagaagaaactcatcccgaagccagctgcaggctgaagagcgggttcaggtcacccctgtacagcaggacagggccacacacacatgtcgcggcccggtcccctcactgcgttgggagtccggtgtccccaggagccgctggatgggcccttgtgcaggcagatgccctgggtcctggccccacttgtgggagctgtggcggttcccgtgcatccttgtctttcacgggggaatgatgaggacttccctcctagggccgtggtcagggctgaagctgagacgcaggccggattacgatccacagggtcatcctcacaggggttttggaaggactgaccgtgctgccaccatgggggacctgaggcccttctttccatcactggggtcatgactcccagagtggccttctgggggcatgtctggcctctccctaccctcacaccctggggtgtcatggtggaacccatggtctctgtctggggacatcacctttcctagtcattcaggctgccggggagcccctttctcctgttgccgtccttggcatgcgggctctgacctctcttttcctggaactttttctcctgggctgtgtttttcaggtctctgaacctctggtgctggcccaggtgagtgccccctccaatcctgccagtgtgtgagctctgttctccctcttccacatgggggatgcttcacagcagtgagggcgagagtcttctcttctttctgtgtgtccccactgaagaaggcggggacacctggccatgttgtggagcctttcctgggtagggaaagagcgctggtctgggttgggagatggacccccagcactgcgaggtccccagacgatggctgtgaaagggtcccgaagaattttcagcatgccacacacaggatgtaaagtgttggcgctcctggccagcgcctgagcaccactaatatggacaatgtcctggcagggccggggtggcgaaacatgcttcttttgtgcatctgttcccaaggaggaattggaggcttctgaagacttaaaaaccacaccaaaacaaaataaccagagaaaatgtttccctgtgctgtggttctaagagctgcattgctttggggaagaagggaaggcaagaaccccctttgaaatcttttcccggaggaggtgggggatggcgtgggtgcccatggacatgcagtccacgtgatggctgccacgtgcccttgagcatcctcatcccagaatggcccagctgcgcacagaggaacagcctgatcccctcagctgcgttgagtcttgggagagggagagccaagctccaggtgtcgattgaaactctgagtcctgctcgtgcaaggactttgcagctgcgtgactgcccggggcgatgggtgctaccacacttgtctgccaggccattctcctgacaatgttcttgtacatgcagctgcagctggccccagatccccaggtcccccaccaccaccctggcccctcactgctgacttctcctccatctcttgccattcttgcatgcagtcttgtccccaagacaagtagggaagatggtgccagcctagtgggctactttgtcctgagaaggtcatgttcagcttccccaccatccaagggaagtctgtgcccctgatttgaggggaagatgcattttctaaggttacttcaacttatggtgtcttagttatcattcttagaagcaggctcttaagagaaggattctggtatacctggtttatttggagttgtagggaagggagtggtgaggtgagacgggaggaaagcacccataaagggaggctaagagagtcagctgcccccgagaacaactggagcttcatccctggggggactctgggagctggcatggttatcccatcccagagaaaggaagcagctctaaacaccaattgctggcagtgccccactgagggttcctttcgcactccagacctgttgcacagctgggcaaagtgggctttggagacagaaaaccctcagttaaccacggtgctggtggttggaaaggatgtgtgcaccaaaggggtaagggcaccgggatttgagtgggaatcaacaggatctgccctacagagatgggggtggtaagtgctgatcgccatgatttctgggggcttaggaagccttttctgtgtctgtatgattttgtggttaaacatgaatgctgatggctgaaaggtgtgtgagtgtggtaaaatggatacttctaggcagatcacctggctgttgtcagatatcagtgcctcactgggaatgagttgatcagatttcatgctgagagcagtgttgggtggggtggagcaggggtcccatcctccggctacagactggcaccagtccatgccctgttgtgaaccaggccgcatagcgggaggtgagcagcaggcaagagcattaccacctgagccgcaccttctgtcagatcagcagcggcattacattctcacaggagcaagaaccctattgtgaactgtgcatttgagggatctaggttgcgtgctccttatgagaatctaatgcctgatgcacctgaggtggaacagttttgggattcctgcccccgcccgccccaccccccgcccccgctgcattggtccctggaaaaattgtcttccatgaaactggtccctggtgccaaaaagcttcgggaccattggggtagagggcaggacagaggctgcctcttggaggatgaggtcagaaatgggcgtgatggtcctggagatcccctgagtgtatcctcaaagacaagggccagtgtcctgtcctgtcctgtcctgttgatgccagcgtccacgggcctgagacagggagaggtcgatggttctcccagctaagccttttagaatggaggagaccccagaccctgagccccagggatgagcctgatctataaccagtcattgaaaatacatacagtgaaatggaagtttctgccattgagcaggctcttgctgaccgctgtaaagataagtaacggcagttttcaggccacttaaacccttacctttggggtattaaggggtctctgcagacagtaagtctttatcgggaagtgtttactcataaaaaaacacagtgaagccggggagagaaagcacctcagcctttatggcgccacaacccatctgtaacaggagctgcaaatcacctgtgggctgcagacgattctgcccaaaagttgggggcggaagtgagagtaaaagctgacttgctaccatgcagacagcattgcctgccccgccagccccctccctccaccgatagagggactgtgctgccgtgtgtgtggctcagccgtcttgctgtggctcccaagtaccacgggattgagcctgagctctgtggtcacgtgccccctggcccacctctctagcctctgtgcctgcgcacctctgatggtgctccctgcttccagagtgccttcccctgcttttctacccctgggagggctacccaaatgccctccccataccagttagagtccgatcagtggagtagaatcaccgtgagagacttggaaccagggtggtgataggatcagctcctgcccagtcgtgggagcagtgatatctctacaaagccacggtctctgcctctggtgctgggctgaagtcattgtaggtcagtggcattggcgatctgagggggtgttaggtgtgacgtgggggagaacaaggacaagctggaacccaccaggatggttagagttcacgcctgccttcctgtacttccagcttcatgatggataggtggatgcacatggggttggaggtgggttgtatgaccctcccccttggaactatatccactcctggctctatgggagaaagagctggctccaaccctctttgccccacagatcagtgatgatgtttggggactgagggagcctctgggatcctacagtagcagttccaaaccttttggtccacagatccctgtacacttaaaaattactgaggaccccaaagagcttttttttttttttttgagactgagtctcgctgtgtcgcccagactggagtgcagtgcagtggtgcgatctcagttcactgcaacctccgcctcccgggttcaggtgattctcctgcctcagcctcctgagtagctgggattacaggtgcgtgccatcatgcccggctaatttttgtatttttgtagagacggggttttgccatgttggccaggctggtctcaaactcctgacctcaagtgatcggcccatctaggcctcccaaagtgctgggattacaggcataagccacggcgcccggccccaaagagcttttttaatgtgggttatatctattgatatttaccttgtttgaaacttaaaaaaatgagaactatttaaaatattttgtcttcaaattcatttgaaaataacaatgatacaactattatatttatgaaaagagcttctccaaaattaaaaaaaaaagtaagaagagtaggattacacttctgcaaatatccttaatttctgtcttaatggaagacagctaaattctcatgtctacttctgcattgagtctgttgcactatgttgttttggttaaaatatatgaaggaaatccagtctaatacagatctagagatagaaaagaggagggtattttaaaagccttttcgcctaatttggatgttctttgatgctgcaccaaaacacgacattatggaatctgaaacagatcaaaggccttcccatgctgttggttaaaatccatgggtctgtcttgcactttgaatggatatttttttacccatgcgttattttgtatgaccgtgcatcagtcattcagaattagaagcccacatcttccaaattagaagtccagatcttccaaagctacactggaaaatacagagacaatgagcgaggaagacaaatgaggttttaggattattatgaaaatgtgactttgcccatctcttgagaggaccgctgctctatgccatccttcctcctaatcccacatagatttctgctgtggccagccctcacccggaaccacacagggaagtgcgtaatgtcagcttggcgaagtggcctcggtatgaagccacccccactgcctccgtggggtctctcccccagctcccagccccgcagtctggctgcgcttgtgccctgaaggagcaggccatgctcactgcccacctgtcaccccttccatcacatgcccatcatgacaggccccctcacttcaccccattggccccgctgatgagctcgctgtggaccatcgggggatctcctgcctcctcctcttacagtctcatcaccgctccgcctcagccctttccttccctggcttctaagctccccttgtgttctcctgcctgccccttttccctcaggtgaaggtcccaggctttgtcctgagtgctcttctcttgtcactggaaactcatcgcgggggcacctgggtagcaagaccctctcagctgtctctgcccagacccctatatctgtctcatcagctccaactgctcatccactggcctgcctggtgctggatgtcccaggctgtgtacacagtgcccctccccacccatcccacatcacctggccccgctccagactcctttgcgggcgtagcgtcctcacccactcgctcgtatggagcaaacctaagagacccggccggcctgagaaccatgtggcagggctgaggggatggatccgcacgggaccttctgaggacagcttcctgaggcctccatgtcctgccattacacatgaggcccagaagggtcccctggtttgcccagggcctcacatgggatttgatgggatcctgtttctaaaccccgtgctccactcttgcctgtgcttttccagggcccttggttcaagggccctgtggccctgtgcctgcatctggttgaggttcacagctgcctgaacactggggccttgcagagaggtggtgggaggagctggagagctccaaggagccccgctttcatccccgaggggtggcagtgcctcttccaagcctgcagggcaggggtgtggagggtgaagtctaacaccaggacagccagtgggtacatttagggctcttgtttgccatccaagaagaagcctccaagaagaaagtagcatctgcttctctaatcagcccctgggaaggagtgtggacgtgccagtggcctgagacagagataaatggtgtgcaccgaccctttgaactggctgggcctagtctgggtgcatttagtgcagacaaagccaagagccaggaaggactgaaccacacaaggccgaggtgggccaggcactggcattggctaagtccttaccgagtaggtgctgggcactacaggaaggaagcaagagtgcgtctctccctgcccctcctccccaaaccccactcccaacacgaatcactcctgagtcttgataatattccgagtgagtctgggccccaggcgtgtctctccagggactctccagtcccccagtgtctccgcccaggccctgtgccctgccaaatcccaaggctccttcaaggccaaattcagtagtcaattctgtttcattcaaaaggcatttagatgtttacgaaaggcctactggttagcatgttaccagggccacccggctagtaagtggtttgagccaggatttgaacttgaatccttctgagcctcccccaccttatgctgataacctgcttatctgaagcagccgcagccccccgccctcttttactgatacccacttctaggttacgtgctgggaaacatatcattttgttagaatagtttctaagccaagaatccagacgcactgaataagggcctagggggcttttatcatacactcttagtgcaaagcctctgagatgtaggtttaggggctcaggggcttcttggctcttgttgggttcctggctgcagctggtagagttgccttttaggagtgagtgacctccagatgggtgaggtttgtgttgcactttaaaagtactgatagtagatattcagagtgacagagtgccactaatagagatttttttttttttttttttttgagatggagtcactctgttgtccaagctggagtgcaatggtgtgatcttggctcactgcaacctccgcctcccaggttcaggcaattttcctgcctcagcctcccaagtagctgagattacaggcgtctgccaccatgcctggctatttttaatatttttagtagagacggggttttgccatgttgaccaggctggtctcgaactcctgacctcaggtgatctgcccgcctcagcctcctaaagtgctgggattgcaggcgtgagtcactgcaccccaccggtttttgtattttctatccaccctcgtttttaatcttcctttgccattcctcctttagcagctgaaagccaatggcaggcacagagaattctataacctgagccttgttctcaagaaccagaaatctgaaggactttgccacaggcagtttattcatctgcttgcaggcatttaccagttactgtgccagtccgttatgctggggcaaataccccactggccaagcccccagggagctcaccggctaagaagaaggactgatcagtgcaaggacagcatcttagtgtggtaacgactccaagagaagtcatttccagatacttcatcctgctgctgggggaagagaggcagggaagacttcttggaggaggccagacccagcctgagctgggtcttgagggatgaatacgggttcactaggcagaaaagtggggcccagagaacagaatacgagcacaggcagcaggatggccagccgccaaggccatgggaacctggggaaggttggctgctttgctggaggaaacctccagcagcatctactgaggcatccacccttagaaagactgaggctgatgaaggcaagtgaaggaaaggtccaggctggtcccttttgccctctgtctggttttctctgagctaagatagttctctctggctcccttaaaatcaggacagtggagcgaaggtgggtttgggggccaatttctcctcctctcagccatcccaggctttgctttcttgccgagtctaaactctcagctgtcgccctcgtatttgctcaggggcccctgttagggggactgtgcactttcatccagctggacgccggagttccctggaagccgagagggttaaatcaccaagccagctggtgagcattagttcccccctctccaggcagtaacgtcagaggctgatgctggcggcaaagaagctggtggcaggaggaggcggagagctgccttgaggcactccgggggtgggctcctggcctgggaccctgccccagcaacccccaggtaggctggctgtggatgtgtgggctccggacaccctgcggggacggctgctgtccacgccagtgtgtggacgtgtgtgcacaccctgtgtgtctgtgtttcttctctttgtgagagttagccttctgctgtggcaaaaacttcagtggagaaggaaagagtgagcgctggagagggtagctttttttctagtgggaaggggactgacttctttaaacaaacactcaagtgttccagtggccacggagcaggcagacgtgggccacactgcatcttccagggtttctctatgccacttggggtgcagtcttgagtggccagaggagcagtttgctgaggtggcttaagaacatgttttctcatctgtctgtgaccaggaggcgtttcgaagggcttgccatgtgccgactcagtaactagtgtgtggcctcccggtggtttcagatgccttgccaaggccgacccacccccctcctcgaggaaatgcaaaaagtgttttcagggcccagaacactaagcctgggatgatctgctcctccctgactggcagcctgtcttgcgtgggcggccgagctcgcagccaccaggacctgatggggacagtgtttcctggggcctctgtacgggggaggttctctcgagttgcaaaggtgcagatgcgccaggagggttcttggcccctaggcttcatggatagagtttactaggacaagcaaaggcctggtgtgcgatctgttttcctatttgactggatgttgggagaaaaatgtccaaattagggatgggcccatggctcagctgagcagaacactgggtgaacttctactgtgaaagaaatagcagatccggcggacatttatgggcgacagagaagggtagctcagcattgaggagggagtttggtctcattctggccgagactgtcaaatcctcggatgggcttgtaaaccagctcctggcctagcctcatcaaacgtgaggatgaggaagagagagcctggtgggccctggggaggggacctgcactctcagtgggacacctggtgaccagtaagcctggtccactgcccttcctcaccctctcgtctttctaataaacagaggggaggtgcctgtgcatagacttggggactattacattgactcagaaagaccctcttttcccttttgccccaaccagtgctttacgaggttgcctaagcctgtgctgcgacccccagaggcaggtgcaaccccattttacagatggggatgctgaggctcttcaccagggccgcccagctggatggcagtggggtgggtcacaccgagcctcctttcccctgggctgggctgccacccgaggcccccactatgtgttcctgtttgcctttgactccacgggggccgggagaaagtggcactggggatgccaccaggctgcttgtcaactggcctttgctgtgttccacacctctgacatggagatgaggctgtggtggctaagaccgggcggtgggccgagttcatgttcctgctatgccagtgatagctggacgagacctagagcaaggctgtgaactcttgtggccttggagttcttgtctgtgcagcatcctttcgggtgcaaggattgttacaagggttgagtgagctgttatcagcgaagcactgaacagtgtctggaaggtgacaaactcaacaaagtgtctctggagttagagcagccttcttgtggtccctggacccggcagtgtgctatgggcatagtgccctgcacagcgggtccagctcaagggacagggacaaaatgaccttttcagaagcgtgttaggaaacagcccgatgggccctaaggctccagaacctttgtgttccctgaatcctgaccctcacagggtccttgcatgaacttgacacaattaataccaagagagatggtgctgtccccattccacccctttgcatgtggctgaaggtcacaaggatagcaaatggaaatgcctccgcaaatcacctgtttactatttttctgattattaaagtgattgaaaatgtgatgactgtggaaaagcccaatgaacatatcattatgttcttccctgattccacctcccaaggatgaccctcactcacatgttagtatgtttctttccagttctttctttccatgccatacttcccttccaatggaaggttcaattaaggacgttaaaatacaacaacaaaacacacaaaagtaactccctgggcttttgaaattcaaagcttcagaggaaatggtacgaatgcaacccaaatggcaaatttcccatctgattttattttcagtacactctgaacccatcttctgccccttaccctagctcttcctcaggcaaccttgagtttccttctctaaggggaatcttgcaggagtggtctaggactgggaggctgagggggcattggaggagacacctggacaggtgtgcacagaggtggatgtgagaggtggatgaaggacatcccaacagggaacctgctcccaccccctgcacccccgccacccggctgtgtgtttcccaggcgaggctgtgtttgacatgcagcggccgcacaccgtctttggtatgccgtttggtcccggacttaatgagttctgcagggacgctccactgtagctaaagatcatttacctgaattgctttttaatttctgccgtgggaagctgcccccggtgtgatataattacattataatttacagcaatcccaaatctataaatttagccatacagtggggggaagggactggagttgtgtgtggggctgggggagaaatcccccccatcattaagtaaacccacgtttctgggtgcaggttccagtccctgggcaggtgtggaggaggcagagagggacatcactcgcccagtacacgctgaagtgtgctttaacaccacagagcattcgggctggagctgctagtgggagaggatgagagggtgatgtgacattctttctgatctgccctcttatagcatttttgctgtgggatgtggggagcacacagaagtgggtagcctggggacatctatggaatgcctagcattggaaggcaaggatcggaatccttccctgattctcttatgggaagatctcccggctgtgggctgtggagaggagagctgggcctcagggtggagtcccggggatgtctctgggcagatggagccactccctgggagcttgtggcatgtgcggaagtgaagccgtgtgggattccgataggcctaggcgaaggcgcagtaccatgcaggccaagggaggggtttcctttctgcacccacaaaagggttcacattcctggtggccctgccattccacgtcactgtgtaatttgccgtattcctgtaaaaccatgcatggaccaaaattattcatattttatgggcataaaggcagttcattaattaatggaattctatggtgaattaactttatttaacaaagaaagaaccaggtttttctgattcgtctgctctggagatctaaacgttcatatcttggggggattccgttgggatgactttgtagcagtgggaggcagtatagcagctaaagcaccagtggaacccaggttcggagaagctaagtcacttaccccacatcacgtagctggtggaggagaaaaagaccctgtgaaggctgttggatggggaaggtaagtagggggatagagagggaggaagagggaggcagcaacaaatttactcgctgtgttgaccttgactgttacgagtttgccccttggccagggggactgtgtggagtggtgctctggcagcagccttcccccttacaggggtgtgggcccccaccctgatacaggtgattgtccctcgccaccccgggaagctgctgatcctcaggcccaccctctgagctttggctcttacgttcacgagcgctggggctcagagatggcagaatggcggctccagagtgtccttccaggtgcttgtcattagccactgccccctgctccatctctggctgtaagcccctttgggccccctttgggtctacaccagcacctgtcaaactgactctgaggaggtcagagagggcaagtcatttaccccaaatgacacagctggtctttgaggatgtaagcctgtcctgagggccttgctttgagataaggtgtcccacagcctgatgttccaaccaagtgggacatcaggacctgaactcccttgtcagtgacacacctgacaaaggatgtccccatggcatttctttgttgttgttgttgttgttttgtcttgagacaggttatcgctcagttgctcaggctggagtgcggtgacacaatcgtggcccactgtagcctcgaccacccgggctcaagcaatcctcccacctcaccctcccaagtagctgggactacaggtgcctgccatcacacctggcttatttttgtattttttatagagacagggtttcaacttgttgcccaggctggtctcgaactcctgacctcaagtggtccccttcccaaagtgctgggattacaggtgtgagccattgtgcctggcccccatgatatttcttatagccattggtactgccatgatttgggagttttgggagaattgaagcaagtacttagaatctgaaagaatgcatttcctgtttaaggagcccatttatcactcaggttttacaaatacatgataaagcccaaggaaggcctggccctgtccacctgtgcagccactcactgccctcacattaaaacaacctcacctggctgtgagtgtgtgcttggctgtgaggagtgtgcaactggctgtgaatgcgcctggctgtgagtgtgtgctggactgtgtgcgcctagctgtgagtgcacctggctataaggagtgtgctcctggctgtgagtgtgcatctggctgtgagtgtgacctggctgtgggtgtgcacctgactgtgagtgtgtgcctagctgtaaggagtgtgctcctggctgtgagtgtgctcctggctgtgggtgtgcacctggctgtgagtgtgtgctggactgtaagcatgcacctgactgtgagcgtgcaccggactgtgagtgtgcacctggctgtaagctccttctgcccagatgcctgtcctttgcctgctccttccaggaaagctgccttgatgacagccctccctccatgtccccctcctggtgcttcctgcagacatcagatccctgtgggtgtcttctgacaagtcttacccctgcccctagggctaagccccaaggccaggagatgtttggataatctggccagggatcacaggagcgctccttcctgtggctgctggttcgcagatggccttgcacaagccttggctgctcagagctttgcactccagctgtggcccagcagtgtcccagggagggataggatgctgggtgagaacaccacaggcccttactgctgggcacgatgggaggctgcctggtgacggccgcctttgttatgacagagcagagcgttgggccgtggccaggctctgtccagagacagctgcgaggcttccaacccggctgggtggggtgggagggagctgtggctggcatgcatctgcatgcacccaacttagcaagttcagcatggaggagagagggagagaggggagaagctgagacagagaggggctgagtgcatgcagctgaagcagtgccctcgtcccagtctgaatgtgccagagccaggttgggcgtgagggtctgccgtcctgtttacatttactcgtgcctcctgtactgcaggctccagagctggagtttttattcagcttctgatgtttatatacacagttttcatgcacaggcccagaacccagccagccccctccctctgctgctgttcgatctgggaggcagtgtgcgtctccacacagaggagaccgctggactgcactctggaggaagtggggtcccctccgtgtgggaccttgcttgaggtgggcagaggtgctttggagtggtggagatttttatctcatgtatggtctttcgtgtctaatcttggcaaaagatgggattccctgcattgccgttttacagattagggacctgagtttcagagagcatgtactctgcgtcacacaggttggggaagtggctttgaacccaggcccatgggattccaatgcctatggcctcttgaccccaggcctttcgggaatgatttgagaagcaggcagttcagtccctctgtacctgcggtccccagtgacagctcagagcccgtttcagatccgcctgggcaacctgcccggctcccgcttcctctgtctccccttcaaatgctggcacattctccatagtgacttcccagcctgccacatctccccacaccccagccacgcataaccactggcggctcccgggacaagtggggctcccaccatttcgctttcactgtgtggtgactcccatgggtccatgagggactgctgtgtccccagctcctagaacagggcctggcactgcccatgccagtggtttgttgactaaatccgtgaccggatgagtgcttcagggacctctaggcttccctcagagccagcccagaaacacaaacatatgactatgttgcccagacccgtggctgtcttctttcaggacagcggagttggcacagccaaacccgagtgtctgctgatatgcttcttgctaagtggtgagcccggcgtctctaagtagtgcctctgcctgtgagcgggtgatgaagagtcagtggggattcatacccatactgtgtgaataggatggctactattaagaaaaacactcagaaaacagaacaggtgctggtgaggatgtggagaagttggcctccttgtgcactgctggtgggaatgtgaaatagtgcagccactttggaagacagtatgggagttccttggaaaatgaaacagaattaccttacaatccagcaattctccttttggatttagactcagaaaagttgaaagtagggtcctgaagagatatttgcacacccatgttcatagcagccttattcacaatagccaaaaagtggaagctacccaagggtccattgatggatgaatgaataaacaaaatgtggtgcgtgatacagagggctgttatgcagccttaaaaaggaaggacattcggacacagcacagatgaaccttgagaacgttatgctaagtgaaataagtcagtcacaaaaggacatatgctgttttattccacttatacgcggtccctagagtcgtcagaatcgtagagacagaaagcagagttgtgattgccaggggccggagggaggaaggagtgaggagttcatgttgaatgggtgcagaatttcaatttgggaagatgaaaaagctctggagatggatggtcgtgatggttgcggaacaacgtgaatgtactcaatgcctctgaattgtacacttaaaaggcatggaaatggtacattttatgttttgtatattttcctgcaagtttagaaaatgaaattattgaagagagcctgaggagcaggtctaaacacccatggacttctaaagcttccgtgaaccttgggtcctcctggttcctccaccatcgatgaccagtgtgtcaccccctggttcagtgccctctttatgcatgagagcagcttgctgggccaaggcccccgggccaggtggcttctctgaggaaacgttcgttagttctccccgctctctcaccagagaaagcacctgtgaggccagcctcttgtctgagcccctgcccggagactccgaggacattcgagctctcaaccccagacagacgctgagggtggaacctgtggaaaatatgttggttttagaaatttaaacctgatttttttctcctctgtgaaaagaatcaaaatccagcataagcttattacaggcggactgaggttattttgggaagtagcaattaaaggttttatatttttcctctcccttttgcccttgcagcttgcacaggtctgtgaagctattaaaccttcacccaacccacagcccggaggaatctgccctgccccgtttctcctccagttcagtgccttgggaaagaaaagaaagttaaattcgtattaattacagccaaatccgctcagtaagcacttgctgaatatgcttgaggatgaggtttaaagctctcctccaaacaaaacggtaaaatgaaaggaataatttatttggtcagacactataatttgccacgtcattccatttctcttgttactaaaatggattctctgctgaggccgtgacttccaactccaaaaaaaaaaaaaaaaaaaagatcatccacagccactattcctcacaatttctctgaaaggtcctccttgccccaccacgctgaagctaggcccagggctcttggaagaaacacacagcacttgctcctgcacactgacacactctgtcacccaaaatgacatgctgtcactcatactcacacaccacatgctcacagtcacacacgtacgcatgcatgcacacagggacagccacgcacctgcacccacccatgcacgcactcactgtcacacacaccatcaccacgtgcacacccagcacccacacgcacccttcatacacttatacacacatgcacacattcgcatgcacacgcctgcactcacacagtcacagatacacagggacacagagccccaggggcagtatgcctcagagcatgttagtacttccataaacgatctctttccacatcatttacagagtgggcgcattgtgagtgtcttaagtttctgaccagggttaatgtctttctgaggctgacttagctcaaaggcagtgtcatgattaagatctcaggcccaggagttggacagtgctagggctgagccccagcccagccacttaacagctgtgtgacattcgtcaagtagaaggagttcccccagccttagcttcccatctctaggtggtgataatgaagagttgacctcatagggtacatctgaggaataaaccaaggctgggcctaacagctgtttcccaggaggttctcatctgagttggctgatatcgtcattattatcaccaatccgtaatgctggtgtcccatccgttctccaagtgctgacttggctgtagctgtgggcccgggcctgggagaaggggactgtgtccaccagggtggctgcaggagggcctatgtgggccttgagatcctgcttcctggccaggacccattccttcatggggcaccttccccagttctcagggctgggggcactcagagggaagtgcagggctgagttcatgtaagttctgcaagcaagttctggtccctttgagtcagcactgtgctaggcattcagaggggagggggcgcatgttttgctaagggcaggtgtgcctgcgtgtgtgtgtgtgtatatatgtgcacgtgtgtgtaaagtttccttagaagaggtggcttttgagcagaagcgccttgggtgaaaagtgtagcaggcttggaagtcagagtgtgctgctgagtgagtgggagtctggtggaggtggtctttctaaccggccacaagaccctgggcccgctctgcccctccgtctgagtacctgccatcccagggggtgagtgctggctgggctcctggtgcagccacctgcaccgtgcagtgccatcaccgggtcgtgtcttgagcccctccttgccctcctgtttgtttaagtggccttggcctagctccctctgccctctgagggtctcactgtgccctagccctgtgggcatagtgcctggcacatagggggccctcagtctagggcacagggtgagtagaggaggaggttggccctgctggggcagcatgcttgccaagcctgtgtgtgtgtgggtttttgttcatgcttctgctggtgtgtacggagaagtgggcccagacacacacagacatacacggatgcccaccaggccccacgtccatccatgggaagggcagcacatgctggtaatgtgttccccaaacagcagcctcttgggctgcctgagctcagggcagagcagggacggggcctgtttgttggggctccagcagggcaggggagggcagagagtgtgagccctctggagaatgtgcaggtggctgggggagtgcccttcccagaacctcatggctggacctgtgagactccctgcccgtcctggtccccaccatgttccctctgttttctgggtgactctctctgcctcctttctctggttctctctgtccttctctgactttgttgctgtctctctcactgtttctttgtctgtccctctcttctctgtcattctgtttctctcacttggtccctgtcctggatcactctgtgtctctgtgtcttctgtctctgtgtcctggtttcactctgcctccgtatctctctctgtctctttttttttttttgcctgtttggtctctttgttttcctgtcattctttttccctcatttggtcctcagtttcagctctgcctgtctctctctctgtttctgtcattctctctctctctttctgtcatcctctctctttctgtgtcattctccatgtttgtccttctgttccctttccttgtctgtctctgcacaccaaggttgctcccagctgggaggttggccctgtcccgatgcctggcccttcttctgccaaaggcatcttggaaagacttgaggttattctggtgcattcagtccagcgcttgataattgtactaacctggcaattggcaagtgctcctcccaaagaaaaccctcacagtgcagggtgctctgctgtgggcaccaggcctccctggaggttacagggctcacagtgtggggacaggttgtccaggggcagctggagcatccactgggatgctgatgtcaggccagagggcacctgtgttttcctgggtgacaggccacaagcaggacagctcacacccaggaaaataaaagccaggctcagagtacttgattccttgttatggttggggatagtcagtaaaatagtagattccgttttgagagcagtatcagtgctctggggcctgtgaagggagctttgggtgtgctctctggttgtcacacagcccccggtggtgcaggttattgtcccagtctgtaggaagggaggtgcctcctggtctggtggctgggagtgtggctttaaatccagctctgattcttaccaactcacccaactctccaggcctcagtttctgcatttgtctgtgggttgttgtgaggattcagtgaggtcatgctcacaaagtacctgcgtggagtaaggatgaaatcaatggcactagtgtcagggctgtctcaaagattatcacttagtctcaggggctggagtgccagtgggattacctacgctggactgcgtctgctgcccacccatcgcttcccatatggggcaccacaaggcggggtggttcttggtttgttctttcaatcagcagtaaacaccaggtacacagcatggtacttgcttggtggagaggaatcagtgtggattggggccccagtccatgcccacctggcacagggtgcaccatctggtcccacaaggagtcagagccccggccactgaggacttcatctctgtgtcttaagagctcatcggtcttgaatttgccccctggctgcccctggcaagtgctggggcttatacccaggagacctggggtcaatgacttgaaaatgaagtacccagaaccccatcaccctaccccacagacccagaattttagagagatggcagagagaagaaaggaggtgctaggaagggttgcagaggctgcctgaggcacggggtggcaccaggctgacccgggcagcagggcctggggctgaggcccaggctgtgtcccttcctgatgcggcctgagcctgggcactggtcagtcatccctgtgtggcggagaactctaaacctcgcttgcttctcctctaggcacactcgggcccttgtaagggaacaatatgtccctctcccacccccagcccagggctgagcagacctcaggccctttgggactgctgcttctgcccagggtgaggctggctgtgactcttttggagtgtgttcgggcaatgagaaaatctgtgactttctgctttgagaagagacaaacctgggctggaaggtagctctttccctgcaggctgtgtgatgggcaggtcacgtcactccctgagccttaggccatggagtcttcaagaggacgggtgggctgttaggtggcagcagaccggggaaggtctggtcctccacagggcagcagcaggtggctcaggggctctgctggtctctttcctctctgagacccttcctcagccgggtgctggccaagaatagctggaaaggaccttcctgcctgaaggatgggatgtactaggttgtgctcagggaccaggtcagacatggaaacttggggcctggagtccagggacatggctgcccatggcctcttaccagcctggattgctctgggactcttcctctcccagcccacctccaggcctccttcattttcttctcctcgcctttgcctttctctcctgtccaccctcctgcatttcctttccctgtcctagctccttttctttcttcctcggcttgtgcctaaggcctccagggcctacgagatggtgtttgcctgttgcggattctcagggccagaggcagtatagctgggggcctggcatttggggagggttcctaagggctgtaaccccagaaacattccccctgcagagggcagtctgctccctccctgagctaggtgagggtctgcaatgggtccagaacatgggatctataccaagttctgggaaccagctcaacaggcctgggcctgcctctcacatctctgtgccctggctgtgtgaccctgggcaaggcactgcacctctctgagacctgtttccccatctagagcacccaaagaatcaggctgcctttgcagggctgtcatgagtggaagcctcatcccccaaccttggatgagcagacccctcaaatgtgcagctacccacagagattttgactgtccatggactttggtgttcagacatcacaacagccacctcccaccaccgaggtcagctcctgccacgcttctggtcatcaacaggactgccaagactcctgggctgggagcatcctttagctccccaaacctgctagctggcaggaaacatggaggccatttagggacattcagcatttgaacttaagatttgttttcagtagaacccacaaacccagttttaaaattcagttggaaaccaatccacaagtcttcaaagtcatcttagtgctgttcttaaacttgcaaagtaacacctagtgggtctgtcattggcttgtctggctcagctgaagtcagagctcacagcacactggcctaactctcagtctggcttcaaagtaacctgtgatgctgctgcacagctctgggggtgctcagtcccccgcccccaaccgccacatcatcttgcccagcatcctctgcacaatgtacaaaaatgttttcaaatgcaggttttagcatgattcaggtatggtgaggccagtagagcaggggagagttgccattgaaaagatgatttgttattcacacttcccagtgggaggacaccccacaccatacaggactacttggggaagcatcagggtcagtcagtgaggcatccaggggagagcatgggaaggaggcttcattggtttttgtggaagggctggcaaggcagggccagaagcttagggttggccggtttgaatgattctagcagtctctgggccataggggccatcgctctttgtctgagacctggccctggggtgttagggcagaggcatgtggcctcccagagtgtagagccaggtaggggagatggtttggagtatggactctggatcagttggtttgcacacaaaaaggctcactcctgggtgagtgctttgctgtcactcagccagccttgggaggggctgccttccctcagtcatcgaagccccagatgtgagaacattagaaacacagaaaacaagaaagtagagttaataccaatcatcaggagctgtgagatggggtctgggttcttgcagacccctttgttcacagaccttttcctggatttcttttgcacctggtttcagatgcctgtgtccccctgcagtgatggctaccgtgtcatccaagtcatcactaactttctgtggggggttatgcacaaggcatgatcctggtgttgttctggtttcaaggctgagaggtcgtgtgtaaggaccttctggtgcactcctcatgtggcatttcaggggctctgcaccccatgttctctgggctaaacccacatgggtcctcactcttcagctcgttttccactgtttgtgtgcgacatttgggtggagttgtgaccaggcagccttatcatttttggagcaaacattactattttgataaattgactggtttttgacaaacacaccaaactgaaaaaaagacaatctctctgagggaaggaaagtgatcatcaaacagtgaagaccaggatttgggggtggtatgggtggagccaatggtcttttagtggcattgctgtactcatttgatagacaaagaagctgaagcaggaaaagaagcttaggcagtgccccacagagctgcccaggagctgagcacaaccaataccaggctttggtgggagttgatcagatgcagccttagggaagattggctcccgttgttgctcaggtgaggcgtcagtcctcccaggccccagccagtcacaggcaccagactttttttttttttttttggagacagagtctcgctctgtcacccaggctggagtgcagtggcatgatttcggctcagtgcaacccccgtctcctgggttccggagattctcccgcctcagcctcctgagtagctaggattataggcgcccgccaccacacctggctaatgtttgtatttttagaaaagatggggtttcaccatgttgaccaggctagtctccgactcctgacctcaggtgatccgcccacctcagcttcccaaagtgctgagattacaggtgtgagccaccgcatcggcccagactatctgttttgaccttacatgtaactttgctctggaagtatcttaccttggcatgtctggtctttggagaacacacatatgcacagaaagagatgtgtgtgtgcgtttgtgtgtgtgtatgtgtgtgtgtgtatacatatatatttaaatatttaatattttaaccacaccaaagagatgtaacaaatacatgtacctccatgcagcttaacttttttttgccatttttagtctgcagcatgtcaaggtgggggatgttctgccctggatgcagacattagggagtgtgcattgtttatagagaattcaaaagcaataatcaaactggctaacagtttactatatgttattactatgtcctggcaattttaacctatgtcagtgatgacacagccctgactggggtagtctgatcccatggcccccccatctgggctgttaaaccctgatttgaacccctatctattgctcttccttgattccatcaccctcttctatctcctgccccccaggagtagcgtcagaccagagaatgttgtgtttgtcatccctctggcatatttccccgtttttactttatatgtaaatgcccatacagggtgggtttcaaaagttgattaagatgttatcttattatgtgtgtgtatatgtgtatatttttttctgtgcacaagattatgtttttgagatgtattcatgtcgttacctgaagctctgatttgctcattgaaagctccgtagacgccacaataaatgaatattccacagccgatttctctcctcgcctgttgaggtaatttacattatttacacttttttattgttgcagacattgttgccatgggtggcacacctccccctgtgtccctgtgggagaactttcttcacagcaggggtttataaaatcaatttcatgggaaacagcatttaaaaagatgcaatagaaaatatcacaatacattgcaagtattaaagttttgtcagactgttttatttatgtgtgtgtgcctgtgtgtgtgcatggacacctggagcacattgcaacacaacgtgtgtttctttctctgtatcacactgctcatttagaagcccaagcccagtggaagggtagatgtgctgggctgttgggtgtacacacttgtagctttgttagatattgccaaattgctctccaaagtggctgcacagtttcttcagcctcacttttcatgaaatggttgacaatattagactggaattttttccagtctaatagtgaatgatcttagtttcatttgcattctgctcttttgcaacgtattggacgtttgggctgcttctccctgatttgcctatccatctcctttgctgagctttttactgggttgctgtgttttcctgaaagtacttttaagagatactaatcttaaaaatcttaatcttaggccgggcgcggtggctcacgcctgtaatcccagcactttgggaggccgaggcgggcggatcacgaggtcaggagatcgagaccatcctggctaacacggtgaaaccctgtctctactaaaaatacagaaaactagccgggtgtggtggcgggcgcctgtagtcccagctactcgggaggctgaggcaggagaatggcgtgaacccaggaggcggagcttgcagtgagccaagatcacaccactgcactccagcctgggcaacagagcgagactccatctcaaaaaaaaaaaaaaaaaaaaagtcttaatcttgtttagacatgttataaataatttctcagtcttctgttggccattatctttgggtatggcatggtttattgagacaacggttgtacattttaacacagtcgagtgtatgattcttttcctctgtggcttgtgtttgtattttaggaggttctttctgtccttgaggtcatacggctattctcctattctaaaatttaaaaaattgtgcatttacatgtagcttttaaatttagctgagactgttttgtctttgacattatgtagagatcaaatttgttttactttatctatgtgaataatcgtctcagtagcaattattctatttcttaatttttaatgatttttttaaatgcaaaaactgtcacatgtcaattttccttgcatatgtagctctgtttccgggctccctactttgttcctttggtctattagtttcttctggtgccatctcacattgtcttaggtcttacagctttctgttaagcatggcagggaaaatcccctcatgtgttcctctttcaaatggtcttggctctttttctgcccttgttctaccgtgagaactttaggatcaacttgttagagtcctgaaaatccctgttggggttttgattataattgagttatttgtgaatgaatttggagaagattgccatctttgtcattttgagttttcccgcccatgatcacggcctttctccctatacttattggttattttatgtctttttgttttatcatttgtatcataagggtcttacacattttttgttacatttattcataagtattctgaagttttctttgctgctgtaaatgttatatatataaaatatacacacacatatatatatgtttaaaaattacagtttctagttcattattgctggcatctaggcatgtagttaaattttatatattgattgtatttctagcaatcttgctgatcttttactagttttaaatgtgtccctacaaattttatagacattttatttaatcttgtcatttacaaatggtgatagctttttcctttctttccaatttttctctctttagttattttcttgcctcttactgtgctgtctagattagcactgtctaataaaaatataatgtgaaccacatttaattttaaaatttctgatagccacattgtcttagtccactttgtgttgctataacagaatatcagactgggaaatttataaagaaaagtcatttacactcatgcaccccataacaatattttggacaatcatgaaccgcatataggacagtggtcccataagattataatcccatgtttttactgtaccttttctaggtttagacatgtttagatatacaaatccttaccattgtgttacagttgcctacaatattccctatagtaacctgctgtaggccagggtcaataggttccaggaagaacctatatcatatagcctgggtgtgtggtaggctatacatttagtgatgcacctagtgatgcatatctcagcacatatccctgtcattaagtggtgcaggactgtatttctcacagttctggaggctgggaagtccaaggttgaggaacctgcatctggcaagggccttcttgctgtgtcattccatcagcagtgagactgacccataaatttccattcttctccttatttagttgaattttcaactaaattaacctcataacatgtcctaaggaatgcttccctttccaatattcaaatatttgcataccgtatggattatcttcaaatattttaatatatttgtatatgttcatatttgtatatgtcaacgatatgttaaggattgttgtcaaatatttgtacatgttacaaagtttggaaaaacccaaactaccaaacctcagcctgggtttgttggtttcttaacgttttttaaaaaattactaattcagtttatttaatggttagaggtaattccagttttctatttctttgtgtcatctttcattcaaccaatcaatctacctctgtcttcaggaatgtgttcatttttcttgtttttaaatttagcagcagtgtttataactatatcccctttttcattctctatgttatttatttgtcccttccctgtttcttggttagtcttcacagagttttattttttatttatttttttgagatggagtctcactcttgtcactcaggctggagtgcagtgacacgaattcagctcactgcaacctccgcctcccaggttcaagagattctcccgcctcagccacccgagtagctgggattacaggcgtgcgcaaccacacccagctaatttttgtatttttagtagagacgtagtttcatcatgttggccaggctggtcatgaactctggacctcaagtaatccacctgccttggcctcccaaagtgctgggattacaggcgtgagccactgcacccagccttttcacagagttttattaatccttgcaaaggtctaattcaggagttggttgattctctttctcgtttctttgttttctctcttacaggtttcttttataatgatgtcattatatcgtttcctttctttcttaggtgtgctttgacattattttcccaattccttgaattgggcacctatgtgattgatttttagccttcctccttttctactcttcttgatataaacatatttctaagttatgcttcagttacatcccgcacattctgaaacatagcaattttattaaatttgaagccttaggatccacgtctttgtacagttttgaaaaatttccaccaaccatctcttcaaattatgcctttccccgcttctgtccattctctcttcctggaactttcttattctgtcttccatgtgtcggcacctggtttttatattacccatgtttctgttatgcattttctaatcctctctcaagctgactttgataatgctctttgtggtatctggtgactcttgtgtgtgtgtctgcatgtctgtgcatgcacgcgtgtgcatgggcactttgtaatttcagataatgagtggagatttatttgaaggaaacctgtgcagcatgagttaaggctatccctccaaagtgcttttctgtgtgactaccaggttcttcaggagtagcacagatgtgagatcaattttgtattcttttgatagcttaggggtcctggaccacatggggactataaatttgaaccatcactcagcgagaaggcaagcatgtggctacaaacactcagaagatactttttcagctcctctgcccgtttcccagcagaggcgtgagaagccaagcatcttggtgtgtccctgtgctggtgggcattgaagggtatccagcctgttactagagatgcagcgatcccatggcctttgcacgtgggggtctcggatcccccttcttgtttctcccagactccaggcctcctgtcctctcactgcatggtcgctaaaaagagatccactgggttactgaggccaacacccactcctgggctgcttagtgtcagctctctgtctggtctttggggtccctttgttatctggccctacgtggcctctttccttgccagctgaaatgtgcatctaaacagatgttcattctgtttattgagctggagggcctttagtttcccttgttgatcgtatggctgaaactcgaagtcgctacgctgttgtttttcctatgcaaaattaaaggtagaaaatgaagttgatggagaaagaaacacacattttgagaaagaactgtgtaattattatccactccctgcaaaagacccatgaagtggtcggttttcagaggaggaaatccttggcgtctgccttattccaaaatccactggctaagtcactcaccacctaagccctcttggacgaggaccaaggcttctacgctccatactaaggcacaatgtgagggattctacagagggcctagtgaagagagaggagagggcccatttcatctcactttgcctggggccatcctgcacgctgctctgctgtgtgatctctgcaggacacttgaccattttgtgaacacatccttatcagtgaactgctatttttgtaatggcagttccccccagacactgaatccacaagcttaaggtaagcttaagtcaagagtgatgacttcttgactattctagtttttctgtcttcattcatttcaacagtatttaccgagggtcttctgtgtgcccagcactgtcctgggcactgtttaaaacattgcttcattgcctctggtatgccaggtgctggcaggacagaggagaactggacttgccttctagcctgctcagagtatggtgggggagaggcctgtccctagattccagtgcagagcagaatgcgtgggccagttggggtctctggttccccagttgggaggaggaccattgcaagccagtctggagggtgtgtgtgtgtgtgtgtgtgtgtgtgtgtgtgtgtgtgtgatgctgggctctgggaaagataaatgaaggcccttctccttcactccagttcacttttggatgaactgttggaggtatttggcttttggtaagttttttttaaaattttattattttagctacagtaatttacatgattcaaactcaatagttacctatttgtcaactcaaaaaaaaaaaaaaaaaaacagacttctttgcttaaagttgatgagattgaaaccaaaaaaaattcaggagttactaaaggttatatggtgaaaaatctccctctcagccagccccctggttcccctccctggagacgaccaatgttccctgcctctcacatatcctttgcaagagattctagatgtatacacataaataaaacattatttgtttatatttatatatgtgtgcttacctataaatttacacacatacatacatatatatgttttttaatgcaattgtcagcatcttgttttttttgcatgacaatgtatcttggaaattggtccatatcagacctggagcgcttcttcatttgtttttatggctgtttggtattccattatgtggacagactgtaatttatttaacgagtctccctctgatggatatttagatttccaatcttccgctattttcaaacaatgccatgagaaatcatcttgccaaggtgcgtcccacatttgagagcatgtttgtgggatgcaggatgtagcttacagggagctcctggcatgccgatgtgagaaccgaccctccatagcaaggctgccccacatggcgtgggctggcctggcctctgagcttcctaagggctaaacctatagttacaagaattttcctaagcccctcagccacagatatataatgtgtagtttctgaatgagtgaatgaaaatacttacacttcagagaaattgtccttagcagaaggcataggacatagttttatttgttagacttacagaccatctgcctgtgaattcaaataatagttttcttgttgtttttgaaatgaatacattccatgagagctgcttactcagaccttcagtggcccagctggaagtctggttggggaatcattccctgggttgtacaagttggtgcaccagattaaagataaagtcatttatgatgacactaaaataatatgagcatcacatttggtagagactttgtttttgacgtaacccaagataagaccttatctgctgtgtgtacgggaaggtgcccttcaataaaggcctcattttccttttaatattccagaatgcagtgggagtgaatgaatgctggcagccagcctttacggagctacctccccaccaagatgctcccatttagtcctcccaaccctgttgttactgccactttgcagacacctttggctcaggcggtgaagtcactttcccaagatcccataggcaggatccataccaggcttccagccccgaggtagtgctgttcagagctgagcccatcactgtggctacccaggcacacttagaacttagacgtcaggacaagatctgtctatacttacagctgtacccagtctgtgttttggagttcacaaaaataacctcaaatgagattacaagggtaactgaggtgccgtttaaggacattatgtcccctgtttcttccatgaaaatattttgaaaaggaaagcaaataccccgctttggttaaggtctgtgtagtggattgcagggcagctgggactctgcaggttccacgggcgtcagaggggctctggatcagggaggagtgtggtttatttttgttgttgttgttttgagacagagtctccctctgtctcccaggctggagtgcaatggcacgatctcgactcactgcagcctctgcctcccgggttgaagtgattatcctgtctcagtctcccaagtagctgggattacaggtacatgccaccacgcttggctaatttttgtatttttagtagagacagggtttcaccatgttggctaggctggtctcgaactcctgacctcaagtgatccgcccacctcagcctcccaaagtgctgggattacaggcgtgagacaccgtgcctgtccaggagtgtggttttgctggagcctgcagtgtggtccccggcaggacccatctctcactgggcctgtttcccaccttttacatcagggcaagggtcctatctgatgtcaccaaagaaccctgagtagctcctagcagagggtgcttgacattttccctagttcgaaattagcagtcagcacacgtgtctgttaagggccagagagtaaagatttcagtctttccaggccatacgtatggtctctgtcacaactactctcctctgccactggagctcaaaagcagcatagatggtatgtgcatgatcgagcagggctgtgtcccagtgaaatgagcagtggacagatttggcctcaggctgtagtttgctaatccttactttgattgcctaatggcattagatggaatctgcataaaattagtacatccagccctacttgggtacaagctccatttcttgtgtctttatagtgggtgcaggtggggcttggagggtctccgtcccttcctgtcactttgctggctgggaaatcagaagaccaactgctaactgactagcctggagcagcctttgttgctctgaacctcactttccccatctgtaaaatgggaaggttggactatggtttctcaaagattctttccagctccaaaatgttctgaattctagttagaaaggaaattaacgttttcttccctggaggttgtggtttcagtttgtgtctttggtcaccaagacaaagtggatagggtaatttggtgttgtgatctgcaccccaaagggcacttactttctggggcaccccatcctagcagagacccctcagtctcaggagccagttgggtagggataatccttattgctttcttggcccacatagtgtcctgaaaataaggcttcacctgtgagttgctgcatgattccaggtgatgaacgttaacctctctagcctcctgttctccacctggaattgccccctgtgtagactgggtgggaggagcaggtgaggaaaaaaaggagaaagaagctgggcacggtggctcatatctataatcccagcactttcggaggctgaggtgggtggatcacttgaggtcaggagttcgagaccagtctggccagcatggtaaaacctcgtctctactaaaaatacaaaaaataggcagccatggtggtgcacgcctgtaatcccagctgttcgggaggctgaggcatgagaatcacttgaacccgggaggtggaggttgcagtgagccgagattgtgccactgcactccagcctgggtgacagagtaagactctgtctcaaaaatataaactaaaaatgaaggagaaagagatgctttggaaatgcaaacagcgctagggcttcattaagacgatgacatgtcttgtggttgttccaagggaagacatgctatacagggaggaaacatccccacttggcttcaaggaactagatcagtcctggttcagccaaggcccaggcacgcccacgtgggcctggactttctgccgtgctcacatgctgcagctgccagttggctggggctggctgcctccagtctccttctcagacactccgcccagttttgggtggcctggggactggagaggtgctccctgggagacctggaaagcaaacggcacagcagtcgggagccccggtcagcttcttgtgctgacttggctcattctaccactaatgaactcgggacactgcctggactctttcctgattggaatcatgggatggggtggtacccgcatggatacctctgtttctgtggcaaatcatccacttagtaaatattcattacttattaggttccaggtattgtgcctggaatacgtggtagtattatgtagatattgttgctgaggttttcctaattgccaggcatcagactaaatattacacaggttagcccatttgatcctcacaacaaccctttccaatttacagatgggaaaactgaggctaagtggaattatctaagtcagtcagctggttagaggcagagccaggatctgggtctgtaactggacatcactgggggctctgcctttccccaggtcagctgggagatgtcactaggggggtccgaagcacgactagacctactcgtgtgttgtcatttgtggagtgggcctggtttagatctcccccgtcagtcattctggtttcttgccgtggagtggcctcccttccaccttcttcaaagccacccaattggggtcattttcctagcttgctggatggagctaattacagcatgctcctggtccctggcccttccatgtgcatctgtctggtgagagataggtggagttctgggctctctgtttctggctgctcagcaaaaatcactcagaagaggttttgtgaaagcctttgtgggcctcagccataactggctgggcctgggaggtgcccaggtatctgcatcgttagagcaagctctctaagggggctcttcacagctgctgggtctccgggcagttggtaatttggtgtgggctgagtgcacaggtggtggtactgtacctgttctgcaggggtcctgaggggctggcacctctccgggctgttttccaacagcccctggtcgtgccgaagcacctgtcctgcctttctgttccaggccactcaggtgtaccaggtcaagaggcagccgtgtttggttcccctcaatgagtctggctctggcaaaaccatggctcaggcatggagctgggcagtcccaagcttggtcctcagccctttcccttcaaagccagttgggtgagttccttgacctccctgagattctcttttttcacctataaaacccatgtttctagctgcatctcagagttgctgtgcagatggaagcgtccttgtgttcagaggagtgacagtgaccgtgtcttcagcccaggccttgcacagcgcgggcaccgcagctgtttgtttgcagctcctgggagcaagcatgggttttagctgtgtctttccagctcctaataaagtcttggcctgtggcaagagctcagctactctggtttagtctccaggtttgggggttgtgatggttagaccgtcatggctttccttgcttctcgggggctctgcgtctgaaacaagaggtgcgaggagggcaaccaatcatccgggtttgcctgggacttagggaattcctggaatagtcctaggaaaacctgaggctctggcaaggaagaacagtgctgactgctccatcaggctcagcaggcactgtgctgagggctcgtcatcctgggatgggcccaaaacgttttaattttttaataatcggaagaaaataaatgaatataatccagcccagaagcctggattatattcgtctttaaaccaacacattagtaaaatataatttttaatgtgtcttatggaggaggaggtccacacaggtaaaagcgtttcgaggtatgagagggaccatgcagttctgggagagaccactgcacccagggaccccctgccttccacgtctcttgaagatcaggaggaagagaagacagccaaagagaactcctgcgaggctcctcctgagtttccagcgatggaaggaagcggagcaatggctgtttctgggcctgccaccgcctagaacttggattggggggttggtgaacttggattgggggatggattgggggattggattggagcaggctgaatgtcagccctggaaactgccactggcctcccagagtgagctgggagatcctggtgttcagatgttcctgccttggctgcgtggggggcaggggcgggggggcggtggttcctatttggagccagggagttgatttaatacagctgaggccaagacccagcgtggagcctacgactgcagctggatccctgccagccctctttcccagccgcatgtggctccaaatcccagaaagggagaaacccgctgtggggagggggtgcagcagatgtcactgtccccacatggtacttcttgtttatcttttattaaaggcaggcgcttaggcaggggcagtgctcagagcagcccttgtgagcgggccatggtggcggcctccctcagaagctgtgggaagagggagaaggcatgaataatgcaggctgcatcttgacggagcttgtccggcccccgcagaccgcgcagcgcgcacctgagcaagcactttgaatgcctctggcttctgaacttgagaaggaagctcccgggatgggcctgactccgccgcctggttgcaatagtcctggaaggggcggcggagcaagcagaagcctcctgccctggcccgtgggtttgcaccagctagaacgtggggctcctccattaagagctccttggcgttgggagctacgcagcctcacccctcatcttatcacaccaggagaccggcgagcagagtggggatggccacacagggagttcgcagcagggtggtgctctgcctaccgactcgcccctggggttgtccctgtcgcctcagcctttctctttattttgggtggaggcagggtactcaggacagggatgaaaacttaggtctgtttttcattgttcatcctattcttggcaacttttgcagaaggcgctggcaggaaggagaccctggggagggaagagttggaggagaaagaagtctccttggcacctttgcctttcctgctaaaaatggtggcagttctgcatttctactaaaaatagctagtcctctgtcaagaaggccacccacactggggtgtggggactggggacagcaagatgtgggccctgggccacacattctgtggagaggcctagaagctcacagatagtcacttttcttaggaagaaggaaggagtggcaggaaggggctgggatgccatctctggagagcggagcggcactcctgcccctgtgtgacaaggacaggtctgcacactctgtcatgtattactctaagtggctttaatattaaatggatgatgaaggcaaggataaacaaactgtagcttaccatataatggaatagtattcaaccatcaaaaggaaggagattctgacacatgctgcaacatggatgaaccccaaggatatgcgctaagtgaaacaagccagacactagaggacacgtcctcatgattctacttatatgaggcccctagggtagtcaaattcagagagacagaaagtagaatcgcagctgtcagcggctggggaagaggggaatgaggagttaatgtttaatgtgcacagagtttcagtttgggaagatggaaaagttttgaagattcacaacaatgtgaatgtatttgatgccactgaactgtacacttaaaaatggttaaaatggtaagtcttatgttatatatattttaccatcattttaaaaaaattaaatgggtgtcgttgattcctctcttcctctcaacctcccatatagaatgactagaatccaggtgtttatcttttatgccaatagtgatgatgatgatgatgatcatgatgatgatgatgatggcggcaattgtgttcttttgtagagaaagtaaggtaactctctggggtaaccagggcagaccctgtgagtattggatcctagtgccaagcttggagcactctggcatttgggggtctccctatggaattgctaaagctaccattggacaagccccactcatctatgcagaacttctaaccaagtttccagtccctcttctttaaatgtgagtggacacccagggtttaagtgacatctgaagaaaggctgctatgtgaaagagcaacgtccacatggacgactgggaaagcatggttcccaaagcagcggaattcaggaggagatgaaaatgtaaacagaaaattgacctcccacccattggtatcctcagaaaggcccaagaaagcattgcatccataaaacaagaacaggatgctatgaaataagaatatttggagaacaaaaaagagctttagattaaaaatatgatagttgaaataaaaagttcattaaagggatacatgacatttcatgaaaagaagaagaaagcaaagactggaacatctgaaaggaaagctgagaaagatgcaatacaaaggcaggtgatggagtatttgactaatggaagtttcagaaactgaaacagaaaacagacgggagaaggttatacaagaacaatacaagaaaattgcctggatcaggacaaaaatcttcacattaaaacatccctcagtgtgcccagcactttaaaagaaaaaaaataatttagacatgtgattgtaaaatttcaaataaccaagaataaagtaacgcttctgaaaacttctagagaaggggagaacagaacagaacagaacagaacaaaacaaaactaaacagcctaggtcatctacaaacgaaggaggactaaactactacccttccgatcaacagcagtgagtgtgtcaagtcagtgaatttgccctgggaaattagcaatgaaactatcagacaagctctcaggcagatgggaggggacaataaggctatcttcagtcatataggagggactcaaagcatttaccttctgtatatctttggcctttacttaaggattctctcttacagcgtaagggagtaagtgaatgcagggaagacctgaggtcccaggagggagacccccaagaagggaatgatagcaaggccggggctgtgcagctgccccctctctacagtcagagcagaggcttgagggattccaggggagggactccagaagagggctgcagccctggtgcctttggaggatcgggagctgctgtcatcactgtgcgagaggcaggggttggccttatacaccattctgtgtgtggtgggggaggtccaagtgaattgagttgtcctctgtataaataaccaataaatcagaaacattaagctcataggattaaagaatcaaaacgtggtattttaataccttccttatatagatcagatagctgccagaggaattaagagcaggaacattttttcaaagttaaaagtggttgcctccagggcacagggaggggactattgcctttcattataagccctttggtgctatttgttctttaaaaaatcatacgcagatcttttctcagccttttggctaagatcaagtgtaaaaatcatatgcaggattgcttagatttttttaaaaaaagaaaaagaatcatgaaaattaaaatgaaagaacttgcatgggccccagtttgtaacaagaactcattgggggtggactcagggcagcatggaacaggcctctcagtggtgttcctgggaccatgggctgggccaccttaagggaggtcatgatggctaggctgggctgggactggagtgacctctcaagtgaggagttttcagttctatgttgctctgtttggatttacttttttggaaatacacaaaaatgcagcccgtgggcccccagggccaggggactggaggtggcccctgctcttgttgcctgcaggttgtggttgggcttgtctgacatgcagcatgaccaggaaggctttgtcaaggctgctgtgtgcctggggtcattagatcctgggatgactgcctgtgacttaggcctggtccctgcccttggggcctggctggtactgaactggagtctggtgtagctccaggcagactgaaaggccccaccagggaggtcttcacactgtccccgaacacagaggaggcagtgagtgccagccgggcatcaggcagtgggcttgggctaaaccagtgcagtccccacctccctggcactcctgttcctgtgaggaagaatagacaatcaacaagtcaacacacaggtgaaacactttgagggagaggtgctatgaagaaaatagagtgggcatgagagggtaactgggagatgccccccactgggtactggggaaggcctttcccaggaggtcccatttgagaactgaaagcttagatagcgtgagccttaggaagcaggtttgcagagaatacaagcagtgccatctggtaggaggggcagcattgccacgtcttggagaaatacaccagtcaattgaggagtgagctgagactggaaaggcaggccagaggtgggacaaggagcctgactccacactaagggcgagaagtcccaggcccagagtgagtggggaaggccctaagggagttgtaggattagaacccagatggcattcgcctgtgtggagggtgaacctgagcttggagtctttcaggagttggagagaggaggaggacaggttggagcacatggagtcatccctaccctgcccaggcctatggatcgcacagagacggatgggcagagagtcgttccccatgcagcggggctcctcctgagctccattttcgggccagctctgtgctgggcttgggtggggccactgcaggccaaaggaggtgctgaaacacatagcactcctgcctacccccaccaggggtgccagggggacagctggctttccgacaggacccccagatgatatgtcgtgtccgtgccaatgaagtcgaggcaggactgagggacgagtgtgtttctgagggatggcatccaggaccagtgccagcattccagaggcagggccgcctgtaaacacagacaggggaggtagctgtttatgtggttggtttgaggaaggcttctctgcccacagatacctctcctgcctccccagcccactttgggatcaagcctagaattccaccattataggttcattcctttggcttgcaatacaaacatcccagtgaggaggtgatccctgagctgtcactggtactgagcaccccgtatgccttggtaggtcatcaggacctttgccattcaacaggacagccagccagcactcgctgtgcccagtgtgtggccactgtgatggttctgggtgtgtgaagagggtcaggtgctgtccacccactctgggggagacagacgcaggaagggataatgagtaatgaattctgtgagagagtggccaggaacagaggagcacagagaagacagcaatgtgcatccttgggcaaatcgaaaatcccaaatcccctaccctctctggccctcgacatgatcgctcaggagacagtagacgacactgtctctgcaaggcgagtgaaggccagcaaggtgctggccctcagagggtctttggcaaaggctttctgcgggggctggaggggggtaggtctaggttcagctgaggctgaaaggagggccaggagaccttcaaagggacagagaaggtgcaggcagaccaggacgaggaggttggcacaaaggtgtgaggcatggggctgccaagagcagtttgatccaggacagaagctggagatttgagttcagagaatgacacctcaggtcactagggactgggcctggggagagaggaggtgtcgtggaagagaaattctgtgacatggttccaccattggttctggggagaagattctcctgcagctcagaggggtctcccttgagaaaggccctgggcctgtctagcaggagcagcaggcctgccagtctgcaagggctggcatgggattgcaatgctgagctttctggctgtttggatctgttgtttttctaagtcactagtcccttgcatattaagagaaagaagagagtgaaacccaaaagatgacataatcatactttccttcattttccaatgaaggtctcccttttgcttttccaaattgttgctatcaggagaaagacgcacatggtttctgtatgacatgtgttgagcctctctcctcgcaggccccaggggtcaggtccccaccttgggacttgctttgattctcacctcctggcatctgtgtggggtgctgtctgaatggcatggttacaggtgcagctggctagggtgggtctaggggactgcatttgcacggtggtggtagtggggatgtgggtcccctatgagatggagcagcttgggggtaacagccaagatgtacaggcacttcctgtccatggtggcctgtggctcccccgagcccatttttgtctcctccttcattctaccagcatttatcaaacacctattgtgtatcggggctatagtgggaaataagacagattcctgccctcaaactgctcacattctggtggaaaaaaaccagccaagagtgtaggagttacagtgtagagaggtaagagcacaaaagggcagcccaagggcagggccgggagtcaaggagagcttcctggaggaggtgactcctgagctgagtctcagaagaggagcagaagtttgggtcaaaaatttctaggcaaagagtacagcaagtgtgaaggcagtgaccctggcaggccctgtcagttcacctccatcctctggtcacacttgggtcccacttttaagagggtctgcctgccagttccagccgcgcatagccttccctttcctgaggccgacaggatgtgtcatatcacctgcccagtgctgcttcaaggggggctgccccagtcatctgctgagtgtgtgagcagtcccctcccctgcaggctgtgacaatcaggggaaatcaggatcccagaagaacctttggaaccctgaggggctacagctgcagaaggggtcgtgtttcatgtcacccattatatttggtctccacgatgtgtatgttctgaggttttctgctttcaatgcctgggacacgcctgaagatgaggagaaaccagaaggaaggcatgtgcaccagaatggacttcttgagtgctcgctgtttgcctagcatggggttcttaaattatcaggtgcatcagaatcacccaagagacttgttaaacatgagattctgggctccatcctgagtttctgactcagtaggcctgcgatggggcttgaaagtttgcatttgtaagtccccagatgctgctgctgctgctgttggcccagaacacacttggaaagcctctggttcagcccagggctgggcactctggcctgtccagggccagcatggggcaggaccccttcgtgggctggcaggagccctgcacaccctccacacagagcaggctcccctcgaggtcatcgcggaatgaccctgatttcctcatctaatttgagaggaggtttatttgggcaggaataataaaaagcacagcaaatgagcagaggaaaacagaacccaccagacatgcaaactcacagaaataaacaatttgccgatgatcagggaagaggctacaggaaggagtttgtgcagacagctcctatgagaaaatggtccctgggaggtcccagagggctttccggctgcacgctgaccctggaggcagctgtcagctgtggcaccatggttgttctcgtgcttggagctgtcttcaaagccagtgagcgagccactcaagaaacttggttggtcaggtggcttcacagatgtactctgctttttacccaaacagtctgcacagtgcattgtccatcagcatgtgtacccagggagcactgtgaattcagggccctgtgtctccagtactcagcatggttacagaatgggtgaaggtgcagtgaagtgacaccctcttcccatcactaaggatattcacaaggtttaaaaacagttcccaaagcaggattcccaaagacgctctccagagaaaccgtggagccccccaggggaattgagatgatgaaactactgcgagctcacttttcttagggttccaggcactgcttggttttccatgcactggattatttaatcctccaacagccctggtaacagtcccataatcctcactggacagtgggggaaatggagaccacagaggtgatgtgatgggcctgaggtcccacagctggtaaggggtggagcagccttccagccctggctctctgaccctgggcctctgctctgagcctctgtgctgggcctcctctccactcaggaaggcacacatatgttctattaggttcattaaggaaaatcagttaccctatttaaaacaccagcaggcaccatttgtgcagcgcctacttggatctggggacctggattatctcgtgccatcttgataaaagcaaggtcactgtgcttgtccccagtttacaaaggggtcatttgaggctcagggagggaggtgacttgagcagggctgtacaactggaactgatccctgggctgctgactcctcagcctgagttctccctgctgtccatcccgcacttattttccaacacctcaggctgagaagctgcctgttctgcctgcctggcttctctcatgatgccagccaggagggagtgagggcagggggtgcccacctctagcagctcaggcaggttctaatgtgggcattggcagcgccttctgggatcagagctgctgtgccactcaccttgccaccctttgttgcaccttctagctccttcctgtggggctccaggttgggaatcaggcctcccatttatggcaggtttgggccgactgtgcccgggccaggaagcaggacggctcctaggtagagatttggatggggttctcaccatcatgggcctcgttttaaagtggacctgcccaccgccccgatctccactgcctgtagactttgcagtgtccggacctggctttgacctgggaccagccactgtgtaagggagctggctcagctgcctacagaacactctcatggcaccggaacctccagggccccctaatctccagggactgcagtcccgagccctctgtcattctacttgcctgaccactgccctcccatggctctgcagaccagcgctttcctgggctgctctgttggctgtcccactgcattcctcaggggcgtctgaagaagcctcgtgtggctggaatggggataaaatccagacggaaaggcctctgatgaggacttgggcctttggtgtgcctggctcacttcaggcctggagggagtagccctctctgggttgaactgggcccagaggccctctgatttatatcaaggtgggagctgcctgggcaggcagaaataataaaggtgtgggccggggcttatggaagatggggtggagggaaagctgggcagaaaagctcatccttccatgccttttggccatgctagcctaaagaccaggggaaggcttagagcttagtgatgcacccaagacgtgcagggctgtggatcttaacctctgaagccactgcccactctgtgggcagctgcacatcacaaagatctaaactgaaatggctatggaggaaagaggagtgaggtggggaggagggtagtgacagagagatgacaggaggaaatatcctgactagagagcttccatccattcaaccacccacctacccatctgcccatccacttacccatttgcccacccacctacccatctgcccacccacctacctatctgctcactcacctacctacccatctaggcacccactcagccacctatccatctagccaccacccatcctactatctacctatctgatcaacgaccaactagtcatccaattatcatacagcgacacatctacatactgaccgcagtacgagagacgatactcattagtgattatatgaatcacaggcaaacnnnnnnnnnnnnnnnnnnnntacgccatctgcatactcacacacccacctacctacccatctgctcacccacccacctacctacccatcttcccacccagccacccacctacccatctgcccgcccacccaccgacccacccacctacctacccatctgcccacccactcacccacctatccatccatccacccacccattaactgatccacctcacccaaacacccacctactcatcaacccatccatcctacccaaacacctatccattcatccacccaccaggccaccccgctatccaatgcatttttcatcaatcacctgctatattccagcattttcatccaggtcccacctcagtgtagcccacaggggatcaacccccccacccccacccccaccaccagtttctgatctctttttgcacgcacagcctgatggtggccctgggcccttgtaaaccctccttcccattttctgatactctgcttgtttctcctcgtggcccactgagatagtaagctccttcactcagagttgcggttgcttctaattccctcgcacctttcttagagctctccttggaggagttgctcagagcatcttttgtgggtcgatggaaaggttactgggaaacttcagttgtttgagactgggatcacctggcctctgtgtagggtggtcgaggtgagaagggagctcacgttaggtgaacacctgctgagtgctcagggggcgggggagaatgacagcttggtgctggggaaagaacccatgtttggagctggcaggggtgggattggttcccggagttgatgccagctgtgtggctttcaacaagtcacttaagctttccgagtctcagtgtttttatttgtcaagaaacaaaatataaacaaacctgaacaattaaatgcacatgtaagtactccttgtggtacttggcatgtggctagtgggtgatggtctctccccatgcccccgccatgtccatagatttgaagactgatcaaggctactttgttgagttaaaatgggcatagatgaagcttggctctgggtcagggccaagctagtgaacaacaatgggcagcctctgatgtttctggcctctcgcctccacccttgtcctgtctcatcctcttggccaccggcctgctagtcccctgggcaggatgggggaagagacaagctgctgagttgctggagggcaggatggcttggattcagcctgctgccttgctgtggaccctgtggctcaggccctctgtgcagcccagtggccggaggctggttatccataagcaggaaatggtggaggtgagctgagcatgagatgatgtcaggagatgtggggcaggaggctgggctctggggagggcctgcagtgctggggggcacaggcatttaatcaactgaattcccactgtcctctctccaactccatttattacctattaaataattatctcatttggaaagtgtttcttaatgtagggcagactctatccccagggccatgggttttgcaacgagttgtctcctgtgtgcgtgttccaggcttgggcaggaccggagcgttcttgccctggctgtgcctctgcctgaaccaggctttccggaggcacggtaaagcgggtgccccctcccctcgacctggctaatagcctcattacaagggttttcttaagcagtattctgtcttctaaaggggactgcctagggctgggcttctgaagttacttgctattttctgggactctgccttaggatctccaaaacgtctgaaaatgtcagggatgggagaggcctttgtcgtttttacaggtgaggccactcaggccctgagatcacacattgagttgatggcaaaagcagaagcctaggcctcccgcctgcaaatgcagagcttgctctgcttcatctccttttgtcttggaatgtcattggagcttaagggtggccccttcccctcttgaaggaagggctgtttcctgaaacaagagcagggaagctgtgttgagtgaatgcagctctgcctcacaacagccctacagatactccctcctttttttttttttttttttttttgacagagtctcgctctgtcaccaggctggagtacagtggtgcaatcttggctcactgcaacctctgcctcccgggttcaagtgattctcctgcttcagcctccggagtagctgggactacaggagcacaccaccgtacccagctaatttttgtatttttagtagagatggggtttcaccatgttggccacaatggtctccatctctcggcctcaggtgatccgcccgccttggcctcctaaagtttggggattacaggcgtgagccatcgggcccggccttttttttttttttcttttgagatggagttttgctcttgtcacccaggctggagcgcaatggcacaatctcagctcactgcaacctccgcctcctggcctcttggccaggctggtctggagctcctgacctcagacgatctgcccacctcagcctcccaaagtgctgcgatgacaggcgtgagccaccatgcccggccaatactcccttttttgttattaataagttatacagactttctagaacatgtgcaaacagtactgaagcacgtgtagaaacacaagccttgcccctctgtctgctccccagaggtcatggtggtggtcaggcaggtgcacgccctcctcctggctgtggtgtgagggtggattgaaggggaccaaggagagtgcatcggagtgcatcattaaggtcctctaggcaagaagcagaggtaatggaccagggtgggcttcagatttgtcttccagtttcaggtgtttagagtaaggtcaagcggtcagtaccacagcgtgccctgaggatggcttcggtcagttccagtacccccaaggagctgcatgaaggtctcacctcatcctatcacctaccctgggcttcttcatctgcagggtggggctcactgtcctcaggtcctgagattctctcaggcccccaacacaggccctggggctgcccatgatcaggccagctgtcagtgtccattgcagaagctcagagggccccctgggacttggctccctttcgagattctgggagcagactacagcagcggtcactgaccctggagtggtcacgggccactttgaggagttggatagcttgaaggatgaatggctgagctgcagggagagatctggggagggcatttcaggcaacggttctggtgggtcaaaagatgcaggagggacctgggtgtagcctgtttgcctgcaagaaggccctgtgtggaagaggcagggttccttatggatcctgggcctggcccattgttaacagggagccgtctgggactctagagcagtgagggggcagcccaggtacaagacacatggtgatgaggaaggagctagggtcagaccctggctcggccacttggtttcctgaggccctgcgtggattaccccatttctaatatggccagggttaatgtacctggcccaaggattgttgtgaaaattagagatccgttatggccagcacacaggagtgtgcaatggtgatgcaaatgatataaatgatgatgaatgaggcagaagctggaccactctgcctttaaaatcctgaagccctagatgcccaccctaatcatgagagctgtcatttattatgcaatgactgggtgatgattagagcccatttaccctctgcaagagagtctctatcacccattttacaggtgaggaacccgagtttcctgatgtctctgaggccatgtagcccatgagtgacggagtgcgaattccattctgtgctgtctgttcagtgtggttcatattctaccagactccagccctgcctgtgaaaccccatatgtagtgggtgctgacgtgaatatgaaatagcaggtgtgccccatgagagaagctcagcaggcccctgcaggcttcctggaggcacctcctgtagtatggcccttggatgggcctgctgcccctgtgattcagctccaggtggagcctgggaggggtcccagtcctgggcctgtggctggagtcgcccacgctatagtcatccagtctcctgtcaagatcttttgctcactcaacttgctttttaaaacaaaaaagcatccaagtggttcagtctccaagcctgggctgctcttgggccctcttgagaatttggacaccagggtttgctgattgccacagcagggattaaccctccacggcccgtggcattctcccagctcgctgaccctgggggaaccggggcctgctgagctgagccctttgttaatacagacgaaaaaggcattaacctgccggtcctgaggctgtccaccgcagaaatgtgacttccctgcctgcacgttaagtgctaatatgctcactagctggcctgtccaccccacagactcattaccgcctgaccacagtggaattgcagagccaggcaggggttgtgtctgcaggctctggcagctcggcagatttcaatgagatgatcgcttgtcatttcttattaatgagcgagtgcctgattcattatacatctgaggggtgaaccaccccagatggggaggaggaacacggagatgtgcaggcaccacagaaggggtgacgtggcccgtgtgtgagtcttttcttcctctttcttcctgcaagaaacaactaagaaaagctttcccgctttggcaggcaaggcttgggtgacaggctatgtaatggtgaaggggaggcagccccatggcaaagggaaattatcgcatagagggcagatgtctatgcaggagggcttccaaggagacctggaatgaatgtggggtgagccctggcccaaaggcatttgctaaatgtttgtggaataaacaaatgcctacacaggaaatgcctcctaacataaggatgcagttcgcccacccctccgccaggctcctgctgtgtgccaggcattgcacgaggtactggggacacagcaggccttgccgtctgggggctccagggactcctgggttatgtctgccctgccactaaggtatccgtgtgacttcaggcatccctgtttccttatctgtaaaacatgctgagctgtgcgtgaccccgtctctctgtcttctgtggggtggattggcaagagctgtgggagccggagcccttgtgggtccatcgtgagcactttgtgtgtaggtgggccggtgagggtgctgagctgggcaggtggggggccaagcctgggccttctcagatctttgaggaaatgcacaatatcttattcattatcgcttcactggtgcctgtgcagggcaggcactccgaggttctgggtgagcgagtgtggggttagcaatacagccaaagtggaaggctggccccggctcagagcggggctcctcccgcctaagaggacagcctgctcagacctccagctaatagggctggtggcaaattgtactttgtgttcattggtagcatgagattgtagctcgtatctctttccctccctggctccccagtcggagggagcttccagaggcagtggagcagctggggatcagctctgccccttgccagctgcaaaaactcaagtcttgggttttcatccatgttaacaacatctgcttcataggcctgcaaggtgaccagagcgcctggaaggggctattgctgtggttgagccattggaggacttggcttagacaactcacaacttggacttagtcaagaccaatgagaggacaacatgcctactgatggattaacaggagtttctgggagaccctggaagcatgaagcccacaagttccctaaagaggagcaattgcaggcatttctccggcagccgaccactgcccctcaggacccttgcatgccttggctccggccagtgcccgtgttgcccctggtcaagggctgcctgacccagtcagtgcttgcctcttcctgaccgcggtctccaccccacacctgtgattgcacaaccccagggctgtagaatccaccacgggccgtctctcctgctatgatgagagcctgccttgcttcaagcactaggactccacgtgaagaacacacagttctttattctgttttaatcagatgcttaatgattttcagtctacttaattactagtattgtattttttaaatagaggttttaactgcatctatgtagtatcttagccacaatgtggattatctgggcatttgtgggctaacatggaaagctactcatattatgttacattattttttatgggaaaatgcatttaagttccaaatcattgatttataatatgtcgacctttgagaacacagctcatttgtaagtgggaatagcctgtattcagaacaacataaagggtctgatatgtcctgggaacagcacagataagctgagtcacaggagggcgaggccgaggcagcccttccaggaagccttttgcttggaggaggagttgatggggctgaggcgtcaatgtgaacaggagagagggtggcgtctgctgtgtctgctgtgtctgcgggcatattagggtcaatggaaaggccagtttggcagcaaaatgacttgtgtgtggagggcggctggagaagtagacaaattcccaagggcagtcactggacttagaggttacctactgggctttggtggagccagggaaagttctgggtgtggagagtcctggtggcagcctgcaggaggaggctctgtgagggcccgtgtggggacactggtaggatgccatggtcttcctgcagggctggcacacacagacgggagggctgcttccaggaaaggtagttctgggagacactgtcccctgggacaagagcacacaggctggtcttgactgtagttttgttgcctggctgtgtccgtttcccacctgctgttttttacatgggttgctcagggccaaggcagctccagctgatcccatctccaacctctgcccctgcaagtcctgctctgtgcagagcccatgtgtctcgatggctgaaggtaggggtcgaatggggattggagtgggcttgccagaggcactcccaccctctcttttttttttgagacggagtctcgctctgtctgtcgcccaggctggagtgcagtggcacgatctcggctcactgcaagctccgcctcccaggttcacaccattctcctgcctcagcctcccaagtagctgaaactacaggtgcccaccaccacacccagctaatttttttgtatttttagccaggatggtctcgatctcttgacctcgtaatccacccacgttggcctcccaaagtgctgggattacgggcgtgagtcaccgcgcccggccccatcctctcttacctgagcagggctttggctctctgtgggtcacttgtatgtcatggaagggcatttcttcaaacccctcctcctctaagcctggctgaagagaaccagctcagaatcatcactgcctatggaaggcctggcccaggctgcagacaccttgggaaggggtctctctggagatggccgtggggtccagagagcagccctttctgtggggcattcactgttggggtccaaccagttctcttccaactcggtagtgcctcattctgagcctgaacattgccccagggaagctgaggggaagggctggtgatggtgccctgggattctgcctgaggcctcatcacttccatctatgggtagtatccggggctggggagcccgagccaggagggctgactaaacgtggctcgagtgtctgagcgcttgcctgtgtcagtggagcccttcgcggttccagagcagccactgcatggaggggagcctcatcgatgagctcactgcatgcaaacagtagctgggccaggtcctgctgtctgcatagatgccctgccccccatgtaacacagttgccacccgactactgtcagaaggatcaggattctgaacttaaggagttctgtcctcgccactaggagggacggggtccttctggcaagggtcccatcaggaaagagttggaggctccattccaccagcctccagcatggtctagttctcccccgaggctgaggaaaagtttggttcccttcccttgttttctttctgtggcctttgcggtgcccttggaggcagtaccacccaagaaggggttctgcttttcagttttgctgacccgggagcgttggggttgagctttttgtgtaagtgaccgggacaaacctctgatccctttgcaaccccatggccctatagaagtgtcgctgaagcagcgtctggtttgaccatcttctccccatccctgccatcccaggaagccacctgactcatctcaagggctgctgtatgccgtggggagggtatatgcggtgctcagatagtgccagccaacgcctgctcatgcagcccctctgcattcaaggctttgccatgcgtcccactccgggtaccccaggcaggccaggctctctctctggacctggcaccccccctgttcaagagagggaagagcaggccatttccagcccaacaccctgtgcctggggccagcactgcccagactcagagtggggatgcagttggtgtttatgggactcactcttgctccccatgctgaaagatgtccacagttccttcaagattcgaggaaggcccatgcaggcctgagctgatttcttggcttaagatggggtcccatagccccccgcctcctgcataagaaacatgtcttactctagaggcctcagcctgtgcttctgcaggaatgtagcagagggtgttggggatagggtagggctggagcttggccacagtcagagggtctcgggtagggacgtggagtctgagcctgtgacgaggagagctacgggacaggtcagggcaagggcagcgggtggccgactctggagtgcccccctcctggtcagggcccttcctcccatcctgtcctgggattaatgtcaaatgtcttgtgcttaatggtttaatgtcaaatgtcttgtacttaatggtaatcccattgcttaaggtaagatctcccttttggggacagaagagctgtttttcatattcttgatgccttgagatcagatgcaaaagaaggtatagaatgccattggggtgacaaagagtgatgacgacaatagcaatgacccctccccaccccattatgtctcctgccatcccccacccccattagcagaaaatgcagcatccttgcacatggcacctggcagacagggcgggtggtgagtggctgagtggaatcagcagtccgggcagccctcaccagcgggtccgtgagctttggaggtgctgaggttccagtcttctgtttgattggaactccgtgtcccaaagtacttttcacgtgcccactccctgcggaagggaaaagagggtgggtgtgattttccacagcttgattcgaaagactgaaactcgatgagtgacatttcaggctggctggggatgtgggttcagatccccccatgacccctgtgtgtgaggagccaccttcacctgcactgcccgcagggactccacttccaggctctgcagctctcagtgccctcagggaactgcagggagccggctcagaaggtgcacagtggcctgggggccagtcatgtctttcacagccttgtgcgccttggacaagtctccctcccttcccgggcctcaatttccccttcttacccagtgggctgcctagtccacatggcccctaagatcccacccagcttcctcttcctcttggggccacagagtcaggagttggaggcagcatgacccccaagttccagaccctggagggcagccgctgcccctggaaggcatgccgacgtcagcttctcccgggaggcggaattcatgcgggccctagtctgagaaaggcacccgcagggtggacagcatgctgcccgccagcagtgtggctggatccccgagtccagccagcctttccgttagccagccagccagcgagcgctcctaaaccctggccgccgccggttataaatgattcatgcagccccgcctccctcggcggccacttgatgttccctgcgctccagcccggcggtccaccgcctctcctgccgctgggcagtgccgccgctgggcagtgccctccccgcaccgccgcccctctgggtgctgcgtccctccgccctccccgcacgctgggtaagttgaaggaggacggcagcttttccggagacgctccctggaaaggagtgctgatgaggccgctcttgtgtgtgaaggcctggcctgcagcgcccttctcccacgtcccttccccttgtctgctgcgctccaagtttgaagccagcaagcataagtaggcgccaaggcagggaggctgtgctgggcctcaggcggggggagctggagggaaggagggagggaggatgggggaggaaaggaaggaactgggtggacacagctggaggggaggagagagagggaatgtggggaggcatggaggcactgccgagaaaatggagcaagaaagtgaggcggctcctgcgtggacccaggcgagcgtgccagggactgggggctctggaagattcacactgtcagccgtaggcgttctttcctgcccccccagcctcccgcaacggatgtactccgagcccttcgaactctcggggtaccagtgagaactctgaactgagagtttcttctgagatccggcaaagccgagcttctgagagctcagtcttcgccacttcaattccccgcggtttgagctgcaaggaggactccagacaagaagctttattgtctgcgagtcccagctcacggttacttagaaaaacatgtgtgtgttaaaacagcttcccgggggaccatgctgttttcgcgtgaggaatgaatttggggaaagttaagtataggagagaaggaaacaaaatcatatcgaacaggaatgttctggaggcttggcaaaatctagaagacactttatttcatcgtcttttttctttgcaacatctatcgaatctttcttcttttgactttctaaagggctttacccagccctgccttctgggccccagaggtcctaaaagtgggaggactttttccagtgggaggtgatgctgcccctaaggccttgcagggaaggaacaggcaggggcagctggccccctccctcctggggacacttgcattttccctttgccattcagaaacaaagttaggtaaggaggtgagaccttcctgggagctgccttttgggaaatggtgattgtgacctcaaatcatgtcagagtgtgacttgctagaagagaaatggtcgagggaagagggggcgggtgactggaaccctcaggtaacaggtagggatgcagcagcagtgtcctggaaagacccttctgtgcattttgtggggagactttccaggccaaggcaaggagaacgtgtggcatcttctgagagggaaagaggagctcaaggaagaggggaaaggtcattgcccttggaccttgcaggaagcaaggtgcaggggcgggcacatcgtattggaggtcatgagatttgggatcctctcagtgcactgggaaggacatgaccaggtggttgtgtggggacatggctctagctgctttctggagacaggactgggccaagagttctctattctgttccattggtctatgtgcctgtttttgtaccaatgcttttttggcagggaggtcacagaggagaccatttctgggcctggaattcctgagagtggcctggccccagtggggacagggaggggagagaagcaacctggggcacacttccctagccagtcctatgtttgtgagacctgggagggctgtggtcagggggctgggccctgggggcaacagtgcctttgcatttgaacacaaagtgccacttggtataatgggcacagctcagtcttggctgttcttgagttttaaacaaatcatgatccccaccttccaaacaatttagtttttttcccctagctagccccatcacaaacttttgaagcatgaaatgaattttgctggccctcaccaataggatcctttccctagataatggattttatgaaatggccataatcctcctaggtaatgagcaaaagctacactctccacttgggtccagcattcctcttcctgatttatgatagattggttaaaatagtaaactgatagcagttgcaaaatagtcatcaatcaccaggcagtgtcgcttaaactacagaaaggtttccagaagtgagatgctggaagccagagagagaacaatttggcaataccaaaggcataaagcaccaatgaaatcaaatctctgtatttgtattctgaagacagaggagtagagtggctcagggtactaaggaaggaaggaaatgcaagcaaacccgttccccaaggtcaaaggacaccccctcctgagctccaggctgcagggggccctgcagggggaccttcagtccagggagttcttcagggggactgtccagagggctctgcagggtgctgcagagctctcaccagtaggtttagtgttctgtttctctttctagacagttttggaaagttttccaatttctaacatgtataaatatgttgggctaatatacagtaatggcttttaaagcaaagtttttcaaaagtataagaggattgaagtgcaaagctatcaaggccatgcccaggtctcacccgtgctccctcacccccttgccccttcgtccagacacctggcctgccacacccagcccaggacagaacttttctttcctcctgtacgctgagctgtcagaccatgagtgttcatcatgggctgaggtgatagttgatgctggagaaactaatgttttagggaccaaaacaaggtctgcagcagtgtttccatggaactgccttagtctggatgagtaacctcatggctgtagattacttgcatcatcagttcaggagaaaacattctcctccattggatgaatagatgaatgagtggtgagaagctgtagagatcttgtgtggtgtcaacgccctcatttcacaggggaggaaactgagtcccgagagagggcagcgacttggttcaggtctcagggaattggtgaaagagattggagtatggcctcagcggaggtgtgactgccagtgacacctgccggaatgtgaacttcacggatagcgctggctcacacctgtgttgcttagtgtaggctgctgagctgaccacttgcccttgattatttcaagtgaccgcgccatgtgccaccttcagacctgctcccagatcgatcccagagcctagggtgggactgtggttgctgtcatcataggtgtgtgattttccacaggtcatataaccctcttgagcctcatcttcctcttctgtgatatgagagactcttcctgcagaacctggcgtgtaatacatgcaacctgcatgcccaccttcagtccagcaagcagccatcaggcaccaattctagaccgagtcctgggccgccacagaaactcaaagttagataggagctgggtgggaaggcaaggaacactcaggattttgaacacagctgtcaacccctattccttaattgagaaaggcaaatcctgggacttgaataaggagattgggaagactcatggctgcactagtgcatgaaatattatggtaaaagcaggagaataaggcagtccttttcttagccctgttcttctccaggccagagcctgggctttaacactgactcaggcagcagcccctgcagaagctacctgcagccaggttggcctgtgctcccagagcccctgccatggatgtccataggagcctctttatcccaaagccatggcttccttctcaaagatagggctgtacttccctgctttcctggtgcccacacagctgtgcatggtggacgctccatgagtgtttactcagtgaggatgcacgggagctggctgatgttgagaaacggagatgagacttcagggctggaaaacacagctgcctgaacccacgcccaggcgtcacccatgctccctcgtcccctcgccactctgtcctgacacctggctggccacacccagaccaggacagaactttgctttcctcctgtgcaccggagctgtcagaccgtgggtgctaatcatgggctgatctgtgctcttataggtatggcttgcaaaggacgtcttttgttcctgttagagtagctaacctctaaatctatttaatacctcttccctggttgtccatcattatgacacatgattttccaaaggatttactattagttagcagcacagggctttctccctggggtagcagctacttgcagtgaagaaaatgcatgttcaatgtagcaatttgtctttttttatatatttattataagagtaaatgagttattgttggagacttcaatattattgcaaattaggtgctgcaaacagagccgggcccatttattatgtttctcaactcccacagcaagcctaccagttcagaaatcagctgagagttgtggcccttcccagggtgagcatggagggacccccggggtctgggcatgacaaccacgacgtcacattgtgccagaggcaaaagaaacaggagccacctgtgcaggcgggtgaggggccctggaagggagcacaaagtttgttgtgccaggtggtcagtggctggtgggctgacagctgtggtcagagagctgtaggaggtggagtgacctcacgctgtgacacttgctccaagcccatagctgtggtcatggagcagaggtgaggtggtagatgtttccagagtggcccctaagccatgaactcactttcaaggtattggcagtttaggccacagagactggacccaggttctgatttagggtgtgccccgtgacagagagtggtggctggaattaaccagcttacagtggggtcccctggaatggtgcactccccagtgaggagtggctgctgcctagtcctgtcctttcgccacctgcccagactaggggtggacacaggggctgcaggatgcatagaatgttagggtcctgcctaccagagatgaaggtcatactgcaaagtgggcatgctggctgtgtgtggtcaacaccaagaagtgggcaggctgaggccctggcatacagccctgctccatggctggaagagtccacagggaaggccacctagcccagtgatcaggagcacaggcttctggtgacaagccagcccagattggagtccaggtgtcgtcacctgctggttgtgtgattgcggacaagatgctcaactttgctgtaacctcagtgtctcttctgtaaaatggggctgataatccataggtattattggcgttaaatgagctcttgtgcttgaaacactcagcatagtactagcccatggtaagggctcagatatgtcacttgttcaattactattcagtaggcttctctgaacgtgacaggctaaactcgaaacattaattagtcacttcatttgatggcaatagtaataaatgtgagtgacagacacgaaagaggctaccctcagtgtaccacccagggagagccagagttaagattttggaatatatgcttgcagtcttctgtgttgtatatagtgtgtgcacaattattcacacacacatacctgcctgctttttacaaaatgggattatattgtgcttgctacctcgtaacctttccacctgagaatggatactgtcattactgatgcctttccgttcaagtttttctgcagttgcagtctcaaactttttggtctcaggacccctttataccctcaaaaattattggtagcttcaaagagcttttgtttttgtagtgtgtatttattggtatttactgttctagaaattaaaactgagaaatttaaaagatattttaaacttatttaaacctaatagtaatagacccatttcatgttaatgaaaacaaccaatttttatggaaaatatttcccagaacaacaacaaaaatgtgaaagatggcattacttttcaatttgacagacctctttgctgtctggcctagtggaaggatgcattctcctagcttttccgccttgggtctgttgcatagcagcctctggacacccacagtgtctattcaagagagaagaagagtgaaaaacacaaataatgtattagtatagagatagttttgactttgcagaccccttgaggcagtcttggggatccccagggctctgcagtctacattttggtccgcttttgaatgcctacagaatgtttttgaccttcccacctgaggctgggctgggaacatccctccagcaaccacaggctccccgagcctcctcatctgaccgaacctgtgtccacagagcatctgagctctcctctctatcattgtgaaatggaccgacataaaatctctcttgtttgcagagttcgtaacgacagagaacatttccataccttctcacaatcatctttgtggggagacagccaggagactgcaccctcttgcctagaacacccatgttgtggccagatccccatgtcgggaacctgctccagggataatctgctgcccccaagtcctgggggtctggttccatggggtttgctcatcttctaggactttggtcacaggggaacaatccaactcctgcctcctcctcaccccagaggctcccggctgcacacagctggccagagtgacggtgttcaaccgcctggtgcctccttttcagaaccacccctcccagccaacagagcccggtctgtgcgggctccgtgggtctgtgtgagagcccctgtttgccttggctttggtctgtcttctcaactggctggccggcccttttcaaaaatcggctgggtgttatgaaactttattttccaaagagaaaaatttctgggcctgtagcaagagggaaaaaagttatactaataatcaaaagcaccagtagtcaaagtaggatggtgagggtttggagaaacactgaaagttgtcacaaaacactgcagctcacccatcagccgcagcccccgtctgtgcgcagagccctagccatgctggcttctccctgcgtcagcatttggggaaagacggatgtgcctggaagcgggccttgctcctgtctgtgtagacaggccggcgttgaatgtctacgggtggcatctatcatccgtgacctgtagcatttgtgctttttgtttatggtctctcggcatgcattgttttctcggggctgaaatatagcacgctaatgaggtatctctctgctcaggaggacgcaggcagctcagaaagacgcctcggcagcatgctgactagtttgtcaacagccactcgctgtggcagctgctgtcccagccaagaagaaaagagtaggaaatgctaggagaagctgcagctgggggtggagggtactcggtgcctgggaacctcagctcagttgagtgtctgccctgcaggtgacttgatgtttggccctggtgccagtcatttctaggaggtatacgacttgggggtgtcaagcaaactaggttagggtcctagcttcccagacactttcggcctgaaacactcggctcctggagcctgtttcctaacccataaaacggtgaggtgacctctgcctttgtgggtgtctgagactcgccagtggcctgtgttctgtgctgggtaaatggcatcagggagcctgctggtggtgcctgtgcctggcatggggctactttgtatgtgcaggtgtttttcctaagctgggacctggggacaggcatgtgccatgcatgtcagcactcagtgtctgagcagagttaggctgactcagtgtctgttgttggctctgggtgctaacaggcacagtgtggacaaaggagcctggaaaagtggaccacatctagagggaaggcccataaagtgactttgggctggccatcatagcctagggattcaagctctgggaacgagagggaccacagtgctgctcacttggaggagggtatatggggaaggagcaaagtcctttctccgtggggaaatggcccttgaggctaggcagagaagaggacggtcttggaaggatttgcaaggagagttacagtagacacagcctgtcctgcagaccccgccctgtgccgagtgctaacggcggtgctaacagctgctgctgtttatggagcactagttgcagccaggcttctgcagacagtattcctcttcttcgcctcaggacacccttgcgtgtgttattacctataaattctgggcggtcaggcacgatctaaaccccaggaggattctagtggaattctctaagctgactataaaattcacatggaaggcaacaaaacgccaaagagccaggactaaaagatgacagtgatgggggatgaggtgggggggctggcctaccagatgctaaaccatactataaagctgtagtgattaaaacacagtgttgggacagaacggaggggccagaaatagagacaagtacaactggggatttcgttctcttttaacaaggatggcagttcaaatcttagggaaagaatggactgttcagtaggcagtgctgagacaattggttatggaggggaaaagttaaagccatgccaaatgctccttacaaaaataaatgcaggccgggtgcggtggctcacacctgtaatcccagcactttgggaggcctaggcgggcagatcacgaggtcaggagatggagaccatcctggctaacgcggtgaaaccccgtctctactaaaaatacaaaaaacttagccgggcgtggtggcgggtgcctgtagtcccagctactcgggaggctgaggcgggagagtggcgtgaacccaggccacggagcttgcagtgagccgagatagcgccactgcactccagcctgggcgacagagcgagactccgtctcaaaaaaataaacaaacaaacaaataaataaatgcaaagtggaatcaggagctgaatttcttaaacatccaaaatggtggcagtgggtctctccgctcagctgctccagcagccacacttcccccggaagctcactgatattctcccagcagcgaagataaatgagatcaaatctcaccaggaggaagatttaaaaatcacttaatacagtttaaaatactcaccggagaaatcagacaagtaggggatggcagaaggtggaggagggggacttttcttgcaggggtttgcagctggcagggttggaggagggacacaggtgagtcacatgccctctgaggaaggcctggctccactggggctttgtgtgccagctcccagtgggtcggcagggaggagcaaggttctgctggctctgctgaggccgcccatgtcagggtcaggcacgtggggtccgaggcaggtggaggctcattctgaaaaggcagatgcacttgcagaatgatgtttaggatttgggccctgtttgcacggccctttccgtgtccctgtgcttaactgtaggttccttgtttaatattcttttacttaagacgtgcccccaactgtgtaagcttcaggccccatggaacctgggctggtccactgctcactcagtaggcagcagtaagttggaagacaagaggcctgagaaggcctgggaggagcggggcctcggcttgggtcagccggtgatgcatttgcatggggcttggcccagctcctcagcatgaccttggggtggcttgcctggcctcccctcctcctccagcaggtcagagcctgcccctgagcactgtccctggagctcttcccagcttgcctatcacaccacatcagtctgaactccctgagatcagactgtggacccaatgcacagaccctgggtcacttatttgtttctccagggccttgtgtgtagatatttgagaaagttttaaactattttgatgtggcttcaaaatggccacgcatccttcaaaaaaaatatgcaaatacaacatacataaccgtaaagtgcatgcatcttaagtggagggcgtggtgaatttttgtcgtttgaacacatccacgtaaccagcacccagatcaagagacagaccatgaccatgagccgaagcccccctgtgcccactcccagtcactagccaccactcccccattttgggacaaccatacttctgacttctgagagcatagcttggttttgcttgcttttgttctttatgtcaatggaattatgcagtgtgtgcacttttctatctggttgctttcttatgtttaggggattcattcgtgttattacctgtagtcgtggtttgctcttcttattgttgaataatattttttcctgttattgtggatatagcacaatataccaacgttttctgatgttgatgggcatttgggttgtttccaatttggggctattctgtgctgcttatgaacatccttgtacggtctcgatgaatgtctatgtgcatttttcccaggtatatacctaggaatggaactgctgggttatagggggcacatgtggtcagctctgataaatactgccagctgtccaaagtggttgtaccaattgccttagttttgatactggaatttgctattaaaagatttattttctcgaacattcttttatattaacatctaggaaaaactgttgagatcaatatggatacattaaagtgttgactgagcctgggtccctgatgagaaactgaagaattgtgaacttcagaaaaatagacctgggggaatattctgtgattcactgactccctcacttacctatttgttcttccttcagccacagatattcattatgtgtatcctccctcccaggggcagagcaaggaagtcaagacaatcttttctccttacgataccaccgtcaaatgtattagttatttcttcttgccaataatggctctaactgaggaagcccatctctttatacaaaaaattaggtccaggaagagctgcctaagcagaatcatggttgcagtaaagtcactttatggtgtttaaagacttggctgaataaaggggaaagtttaaataaattagtgtctagctatggactgagacagtatgaatccactgaaatatttatgaagaatcttaatgacatagtacaatattaaaaggaaaaaaaggatacagaattacatacacagtataaaagttatttttttaaactcatatcctgtcacaaaaagaaaaaacacacttggtctcatttttctggttttaaaaatctttcggccaggcacggtggctcacgcctgtaatctcagcactttgggaggccaaggcaggcggatcacaggtcaggagatcgagaccatcctggctaacacagtgaaaccccgtctctactaaaaatacaaaaaattagccgggcgtggtggtgcgtgcctgtaatcccagctactcaggaagtcaggagaatcgcttgaacccaggaggcagaggttgcagtgaaccgagatcacaccactgcactccagcctgggtgacagagcgagactccatcttaaaaaaaaaaaaaaatctttcttctggctgcagtcctccagctcaccccttcttgcccaattctgttatctcagcatcctcagaagctcagtctgcgagcatggagaggatagtgtgtgtctcctccggcattgccccgtggggtttggaatggcgctggctgctggctgcctgggcctggcattagctcatggatctcggttgcggatcagtttccttccccaggaggggcagggacttcactttctatggcttatgtgctttcctggggcccagcatgaggcctttcgccagacactgtgcagcccagacttgttcccaggacaatgggtgagatgaaaaagggcttggtactagtggaggcacttagtggctgcagctgagtgttgggaagggctggagagtcagttgcagccaggtctggaggggctgtgtgcccagcttcagagcttgggttttgatcaggtttttgtgttagaatcctcattctggtggattggagggagccccagagtgaacatagagagacctcctagccaggcaggagataacctgagatcagtgcagtagttcctcacccgtgcgtggggaggcagcatgagcagttaggaggaggatggtgtccacagtggtcggatggcaccccagccaggccacggcgggctggacagcactctcaggtgacacgtggccacctgcctgcctctggctgcggccccaccacgggctggatgcctggatgaatctcaggctggagtcacttaacggctgggctgtcaccctgcagtaacccataattactacttaggagtttgtggacgaaaagcagtagattccaattgagtgtgttaaactctgcacgcgcctgttctaatgaggagcttgtaacctatgagagcccgtctgccgcgggaggcgggctcttgagccagagaagccagccagtcattttctccagcctctagctgagcctccacggccagccatatttcagcatttaggattttaagtgctggttaaaatgctcatatagggaagtgtgtatattttcatatttctgcacatcatgctagagacgagggtaggaataaatcggtgtggccagaggtgccgcttcaagctgctttattccctctctgtgcacagtgttaaactgggctgtgtctgacttcccaaccttcatcctgtagggggctgttactggggaaagaaagttgtcttaaaggaccctggagtgtgagggatggaaaagcgaaaggtttgtctctgcaaacaggtagtgctgagtggtcgccagcttagagcccgtcgtccagatgctttgttttctctctgttttacatgaatttccactgcacagccattggagttttgctagttgggaattttaattagagaattgggcaaacttcattacttttcattcaggtttaaggcaagagggctgattaaattcatccatcttccccaccgaagtccagcctctgaggtttaatcccattgcctgaagtccccatcaccccgccatcctccttcctccttccccgcctcgcagacaagggctctctttccaactccaccacctgttccagccccggctctgcccgcaggaggggaaaccaggtcacatctgtggtcattcacaaacaaacatagctctgctttgccccaccaagaggctgagcctgtggtttttctgtccaggtcctgaaacaccccagacagcaagaaaaccagaaaaaagcagctatgggctaggttaggacaattgaggtatctgcgtatgagagagattataaatgtgtacctcctggctaaagtatgtctttctctagcagaattgtgatttgaactgcttttgaaaattaaaatgttggtatgtgaggtgaaaatgagcttaatctggggtgttgaataattgttttcagccattgaacacaagtcccagcatagcatctacctagctacatggatggaaatgcaaatatccccccctgcccccaccagggagcaaaatgtgaaatttgtctttcttatttgccatccttcgaaggcagcaccccctgttaccatgataacataaccttgtgcacctccatttctgaatctgtaaaatgggggcaagtcactaaccttataagatggtcggtggaattaactaagcaaatttatctaaagcacctgacaccctttcaggcacacagaggttccaagatcttcaatgtgacgctttcaagaaaggcaactcaagttcagggcttctgaatcctactccaaataccctgtcatagtcaacacatccctgaagttccctacaccatgcctagaagcactgaggctgggcagtatctccttgtgaaaggcctggcccccttccccagggtcctgcttgaatgtcagaggacaggtggggaggaggatgggtggagaaggacagtggcagggaggacagtggggagagggcaggtggggggaggacaggtgaggggaggacaggtaggggagggcaggagtgggaggactgtggaaggtggacaggttgggggaggacagtcgtggggaagacagtggggagagggcaggtcaagggagggcaggtgggaggaggacagtgggggaaagacagtggtggggaggacaggtaggggagggcaggtagtgggaggatagctggggtggcgggggggaggacaggtgggggaggacagtgcaaggagggcagtttgggggaggacagtgtggggacggcaggtggggggaggatagtcgggaggacagtggggagagggcaggtgggggaggacagtgcgggggagaacagtgcggggtggcaggtggcggggaggacagtgggggaagcacactggagggagggcaggtgggggtaggacactttggaaaagacagccgggggaggacacagtggggaggacagtggggagaggacagtggtggggatgtcaggtgcggagtaagtatgtgcagggcaggtagtgttgggctcatgtatgtggggtagaacattgagtgaatacaggtgaagtcggacagtgaggaggatacactaggtggagtacaatcgtcggagacatatacttcaagcacagatgggagaaggtcatttagaaaagagttgcagttgagctcgccgcatcatcgactgttataatagcatacactagtggtgtgtctgaatgtcagcccagcaaccaaagatagctggcaacgaatggtccaggtcttttgggatggaatgtcataggggacaactaaggccctgtaggttgattccagaatacactatccaggtccagggtgcagtggctataacttgcagatcaaacaattcacaccacttcaggagttgaacttggctgtgagtttacgtctggtctctggacccatgtggctgcctacagtgaacttgacctttaggggctctggcttctggaaggagggagttccaggagccacatcctccttccaggaggccaggtgacatggacaacgtgagggaaggcagccagggcgtgaggccttgggttgggtctccagggcagctcaccacagggaaggagtgaaggtggtgaaggatcacccgggagatgctgcttgggctggagggcgcccgctgcaggcgtcagctgctgccggctgcgggatgtgatcagcactcctcacttcatggcctcagttcgctcgcctgtgaaatgtaggtgtgtgtccctggagtccctccaaagctctgtgaatttgtggaacgcagatggagggaaggtcaagcttgggagagggcggtggctttggctgcaacgcgaagccgacaagcactggcagcaggcctgctgggctgtctttgagcgcgggtgtctgggcccaccctcctctgtcggatccctgggtcttctgtccctcactggacatgtggatctgaccgccatccaggacgtcccctctgggtcctgctggcattactccagaaccacttcatcttccttgccctccagggctgagatagctggtttggtctcacatctggtcttaagtgggtcttttttttttcttctcattttgtctatcttaaaatcaggtttatgaaggtgtaaattacatatagtaaaatacacccttttgaggcatacagttctgttaattttaacaaatgtatacggttgtgtaaccatcacaaccaagatacagaacagttccctctccccagagcgggcatcctgtccttccgtagctgctctcccaccctcctacccccaacagcccctggcacactctattatgtttcccatccctataattttgccttttcctgaatatcatataaatggcatcataaagtatgtttagctggggcttttgagagagaagtaataggttccttccgtgggtttagccttttgtttgcatctgctctcatgaaaaggtctatgcttttatcaagcctaaaagataaccttggccgggctggtggctcacacctgtaatcccagcaagttgggaggtaaaggtgagcagatcgcttgagcccaggagtttgagacaagcctgggcaacatggcaaaaccccatctctattttaaaaaagaaaaattagccgagcatggtggcacgtgcctacagtcccagctacttggaaggctgaggtgggaggatcacttgaggccaagaggttgaggctacagttaactaaggtcgcaccactgcaccccagcccaggtgacagagcgaaaccttgtctcaaaacaaacaaataaacaaacaaacccacgataaccttgaagaagacagccgcactgtacaggaagctctggtgtgtgcaggtatttgtagagcatttgctacgctgacccgttaagtccctacagcagtctcatgagggtagttattattgtaatcctgtttaacagatgaggaaaccgaggctcagagaagtgtaatcattcactgtggtcacatagctcagatctgaacccacttctgtcatcctcactattctgtgtggttgtttggctgagtcttggatgagggatacttgcaatgataggtagcctctggcccctggtggtgggggtagggagtgggagagtcggagaggtagaagaaagccgctagatccaggcctctagcccctatctctacgggggactcccttccaaggaaaattgtctgtgctccagacccccgcagcagatgagtgtgtggaggcctgattttggagagtggggatttgcacccttccgcaggccacccctgtgttcctgctcatacttttgcatagccaccacctgaagttagggcagccccagccctgggggagactttaggggccaggggcagctcagtgctgggctcacaaccacagaacaccagctttcctggcctaggtcacactttgccaggccacaccatgaaggggagagagcgcccatccttggggagcaggatccagggtctgtgagacccaggcgtgggctgcagggagagtgaggtcgtccgcacggatggtggagtggacagaggccagcagaggctgcgcgcccatgtgcgggccaaggggagagcgtaggtaaaggacagtattgcagtcttgggaccaagtgccactaaaccttatgggtaatgggtttttcatcccctgggtaataggagacaccaaaaaatgaggacattacttagtgagtccctcacctccctggccccattcagcagactcggaggaaggacattgcccagcattgagccgtgtgtggatttaatggggtttccagctaaaccttccatcaaatttacggctgtgcctgtctcctgaccttccccctcacacattcttttcagaaatgaagctgtgtgcaggctgtgaggtgtcacttcccccacgctggagatatacagcttgggcctgggttgagacagtggatttaatcaggctgggtccccgcagttcacccgcccctaagctgagtgacattagggtggccgtcggagtccagctagagtgggcagcacggagccagcaagtgtttgtcctgccagccacaggcttctgctcagccttgcctcgcctccttgctgggagagtggcgcgtgggggcccaacatctgctcaccccctgggccggaaggtggggttcttcctgtaatcttctcccacagcccccacctcctaccattgctgccatggcgggagcatcatcagccggcctcactcctgctttccccactatcctaacagctgggctgctcctggctccctctccattcatttcttgccttccatcttggaagtgttcagtgtctgctgaatcctcccaccccaacctcactgcccctctagagcttattgcctttcaaatacagctcaaatatcacaacctccaggaggctttccccgatctcatcacccccagggaagagatctcccttctgcacatcatgcagaccgggtcctagagggtgaacctttctctgtatgcctttctctgttgctgggcctggcccatggaagagacccagtaaatagacactgtcattgtcacagggccatgttgtcagatgcctgctccagagagtgaagctgcagctacattgccaagctcactgggctttgtaaatggcccctcaacctcaaaggcagcagctgcagtctcacagctggcctctggggaggctgccttccgagggtggctcccctgagcctggccaccccagcctcggaaatgctgacaaggcctttccacccgtcccttctggggcagcgtgtgttttcatggcccttcactgactgatcccatgttcatctcaccgactgcctcagaggcctcggggcctggggcggggcagctatagcaacaggcagcgtccagtgcccactcggacacacagggcccttgaggcagctgctggcagcaggaggcgtctagcaggtgggcagagggactcaggcttgaggccacggggaggattaaaaataaaattgcctctgctccctggaagctgaggcctctgtacttggagttggaggatgacagacacaggaggagggagaatctgctagcaccaaactcccctctacctggtcatgtgtgggagcggggcctcacgtgtgggacactatcattcacattcaagtgatcattattatcacacagggccgtgagctaaaaccatacttctgtcattctttggctctaagaaaatgaaaaagggaagtaactccatttactgagcacctgttatataccagataattttacatgcattagcgtgccatcctcatgctggcctcaggaggtgagaacccctattctcatttttccaaagtaaatttgtgtgtgtgtgtgtgtctgtgtgttttggttttggggtttttttttgagacagggtcttggaacccctattctaatttttccaaagtgtgtgtgtgtgtgtgtgtgtgtgtgtgtgtgtgtgtgtgtgtgtgtgtgcgtgtatattttggttttgggtttttgttttgttttgttttgttttgttttgttttgttttgttttgttttttgagtcagggtcttgctgtttgcccaggctggagtgcagtgtcattgatcatggctcactgcagccttgtcctgctgggcttaagcgattctcccacctcagccactggagtagttgggaccacaggcgcgcaccaccacacttagctaagtttttaaattttttgtagagaagaggtctcattattttgcccaggctgatctcgaactcctggactcaagtgatactcccaccttggcctccctaagtgctgggattacaggcatgaaccactgggcacagccccaaagtgtttatgaaagggagtggcagggtcagacctgcgctccagagagctcatactagccttcctgaggggcgtgagtgggtgaggcagaggtggaaaggctgggagcctgcttagtgagctgctgagacagacaggaaataaaggggcctggagtgggactgcggtagcctgcatgctggccccaagccgcacctggtgggtggacccagggccccaaggaaccccagacgttgctggctgggtggatggcggtgcccttgctgaggcaggagaccctgcccaggagcaagcacaaggtgctgggagaagatgccacggtctgtctgtgtcaggcgaggcacatccaagatgcctggggctcacgcaagggctggacggagagatccagggctcagaagagagatctgggcccgagacgcagatgcagaaacacatggtgaaaatactcatccaacacactcacgtttttcctccgtaggtgccagtgacactgtgggaagatgcctggcttcccaagcacacctcagacgctggcccccgatcaatgcctgtggtccttgaaagcagatggccagatgccctgcctgaaaactcccacatggcaagtggtagatgtcacaagccacagagcaccccccgcccacaagatcccccagcctgcttgtgggagggaacatcccattctggtgcttttgatctcttcctgcaaatatgcagctcaggcgacctgggaatattcccccacagtgaacctgaattgatactcaccaaattagatcaattccagccggagcctggagcctgtgattatcaccctctcaccgtgctcttttccttgctgggctgcgtgttggatttccaaaaggcttgtaatcaacagcagagagagctatgtatagcccactccccgcgctggcgaagcccgggaaggccactgtttgaggttaggcttgagtcaacttgtaccatgtacttgggagccattcaaaagaggcggtgcacacacaaatcatgatggggctaatcagaagtttgggtatttagtgggatatgtacacagcaatcattgttggaagcgcccttctcccacagaggccattatcccggagcggggtgctgtttgcctggttttgtctgggccacaatttgcattcacttgatggattgtcagggtcgggggtctcctccttgggaaacagtggagtgactgctcagcacactcttaagaggaaggggagcgctaataccagcgtttgcccaggtccttgagagggcccggggatcctaacgcagtgctagatcaatatgacaggcgctaagaagcttgggacatgcattcacaaaccccttttattgctccactccaagccagggagaggggagctgcagcttgggcacagctagcaggacctggccgacaggctcttgtttgttttcccggctgcggtggcctgcggttcagttcaagtttgccaaagtgatttggagtggccttccccagctgagccttgcgtgggacctgttaagcccctgctctgtcacctgccttctttctgtctggctggatgccgaaaagaaacctccagagggagaagggagtcggggaggggtagaagggaggcctgttttgcccgctggggcaagggcagctgtttctctgggggtaaacactcttagttgccaaaatgccctgcagttgagtgatgttgctttctcgtttggcaaggcgagaggtgtttttgttttatttttggtattttcctgggacatctgtgacacctgttgactccatgagttctctcaatctcatcgtccccgagcattaggaacaaagcccaagggttccacattctctccttttgaacagcaccgccatcacttttatcttcttaattttcagggtgttttcttctcttcagacaggagagaccctgtgcagtgtgattcaggggagagtgggcaccagtgagagacacacaggccgtgagggccatgttccctaacaaacagtgtttggtgtggacagggcctactagggtgtggtgggtggggagattgttgagtttttttttattgcaaccagtcttcagagcaatcagggattttcttttctttcttcgttcagaaacgtgtgaggaaagctgactagcatcgacaatgccaggtttcctctgttgggccttctattcagggtcgctgcttgcatgttccagttctgggtcaggactcatggtcagcgttggctgacatctcagtagcaagtcttttttccaggagaacccaacacttcaaaggcttatcagttagtggtgacttcgtgtttctagttctccatgttgatggctaaaatggagacagttgagttgtccccaagaggggaccaagtctttccttttccctgggggtggggagggtagagtgaaggaggcccaggctagacggccgtgaggactctgtccagaaagggcccctccagcaagggtgatgggttgggcgctgcaggaccgcggagaaacagaacgcatctttatctggtcctccgaaagaagtgcggtggccatagtctcctcttttagcccttttctgcccctgtgtctcagaaaagtcttgaaagggctggaagtctgtgggtgatgttagcctgctgagatgctcgaggaaactcaaatggctctttctttgtatcacgtctttcctgtcaactcataccccaccttgagccagccctcagaagatggttgcaagagacacaccttgggtagtaaaggtggagaaagaatgctttccagttcagacagtcagctcctccatcgaggaaggatgagaaatcacagccttcaggatttcaggccaggcacaggactcttagacttgataccataagcatgattcataaaaggaatgattgacacattggacctcgccaaaatcaaaaattttgctcttcgaaagaccctgttgagagggtgaagagacaggctgcagaatgggagaaaatatttgcaaacctcatacctgacaagggactagtacatagaatatgtactcaaaactcaacagtaaaaaagaaacaatataattagaaaatgggcaaaaaacagaaagagacctttcacaaaagaggattatataaatggccaataagcacatgaaaaggtgttcaacttcactagccattaggaaaatgctaattacaactgagcgaggtattatacacacatcagaatggttaaaagaaaaaatattcataatgagaatgcagagaaacaggagcactcacacatagctggtgggaatgtaagacggtacagcctctctagaaaacagtctggaagcttattataaaggtaaacatactgcataggacccaacagttacacccttgggcatttattccagagaagtgaaaatttatattcacacaaaaacctgtacacaaatatttataacagttttatttgtgatgtccccaaactggaaacagcccagatgtcttttcgtggtcgagtggttagacaaactgtggcacattcataccagggaatactactcagcagtgaaaagggacaaaccatagatgcctgtaccaatttggctgaatcttcggggaattatgctgagtgcaaaagccaatcccaaaaggttaccaactatgtgtttccatttatgtaacatgtttgatgtgatgaaattttagaaatggagaacagatcaatggtttccagggtttaatgacagtaggggtgagggagaggagggcagcagaagggtgctcatcgtgacagaactgtttagtatcctgactgaggtggtagatattgaatctgtacctttaatgaaattgcataaaactaaatgcacacacattcacatatatatatatatatatacacataaaactaaatgcatacacattcacatacatacatacctgcgtgcaagtaaaactgaggaaattagaacaaggcagatgcattgtatcactatcagtatcttgattctgatattgcactgtagctttgcaagacatgattggggaaatctaggtaaatcatacacaggatgtcttcctgttacttcttacagctgcatttgaatctcaaattagcgaaaaataaacaaggtaattaatatatgcaatgcgaattacgtcacgtgtcttcactagcttgtcctcaagtaagcaagccgtgctgtttcccaaggggctgggcctccttcgggacatctatgcttacctggaggctggtgggttatagcgaggtgggggcacgggtccccccaaagcttggcttcgtgaagctggtacccaggtagtggggaggagagaggatgtgtgtcctccagttctccttcagtcattttcacctcttggagtttgcatcttggggatggcttctcctaatgccttcccaggactgtgttcatttgttcattcattcattcatcagtccatttgtcagcagggatttcttgaggacccactgggcaccagacgtggagcccacagaaatgaaaagatggacctttcagcatcagggagctgatggctggtggggagcaggcagtggcttgaatgccacacaggaaggtgctatgggagagtagcaggcacccctcacccaggagtgggtgcactgggcggggtgtctggtggataaagaagaaatcggggagccttgctggaggtgatggtgcttgtgttgcctgttgaacaagtgggtgtaggcagagaaggaatttcttgagaggcagtgttgcctagtggttaagagttggctgcctgggtttgaatttggtctctgtttaacttctcttcttcagtttccttttccatgaaatgaaggcaaaaagggaccctaccttataggcatcgtaatgtggatcaaaccagttcacatttttcaggacctggcccatggtgaatgctgggtaagtgtttgataaattaaatcacacaaatagatgaacgggcgtacagaatgtgattgaagcctgggctatgctgggagaaatcagagctggagtacaggctgtgaagggaagggggagcagcaaagggcagggcctggctttcccctggatgcttatgggcacctctcctctggggagccggctatgctcctggctccagtagagtggagggcaccacacatgctttctttacaggggaaggcgctgttcccttctcttccttacttgccctttccatgcaccctgaccccactgaaaaagcagcagagaggggctttgcacaccaggctgtcctcatttactcagtccagatacctgggagattgtgagaagctggatgcaccttcctggaccagcgacccctctttccactgcactccaggtgtgaccaatgccagtcttcactgagcacagtgggtgaagcccccttcccatcccaccccaccctgcaccttgtgacctcctgcttggctctgcggattgtggtcaccaccttggactacttaaccccagcactttggacaaagcttgacatctgatcaggtgctcattaaaagcactgtcccattgtcgggcccccatccacctctctcccccgtcagccagggaagggaagatttggtctctttgctcacgtgacagagatgtccccacctttttgacctgttgaaggttcttctgggccacaggagaaacgtttgtttcacgagaggtttctgcaggtggtgggcctgagccgcctgctctgggaggactgaggtttgggctgaggaactacgtggtcattcggtggttgatgtggagttggaagcccttgtgggaccttgggcagggcacaggcctctgtctgccccttggaaaagtgggtgcataaatcctgctctgtgcataaatcctgtcccagctagccaggggctgcagaggggagagttctggtgctggcccggtaccagcttggatggttagtgtttgtggcaggagccatcatgctctgcctctcctgccgccacctcctgaccactttactggatcctgcacctgcgtgtttgtgcctgaggggctttttcttgctgctgcgctggtggcagttcagggtgccaggaaattaacactgataatcagtaaccctacttaacaaatgtctatggcagaactggtgtgtaaataccccagctccctcacccctcagctgggtctactctggttctcagaagttctgtgtggagctcagctgcccttgcccagagtggtagggggtgtgccattgtccctgattcaccaccttcggtgtctcttcctgatgtcctcagctgccctgtcatctccaaaataaaccacttgcactcacatccttgtctcaggttctgcccctaagagacccaaacccaatggggttgttgccacttttctgatagatgctgtggatttgaagtcaggaaggatagaccaccgctaacccgaggagtgaccgccagtgtgaaatgtgggccatgacccctgcctggcagagctcctgcccccagcgtgcatagttatgagttatttgactaaggcatcttgccacagccttctcaaatatctcagcagctcagcctgtcctctgtagtttgggaggaaggctgaatggccaggaatagctggggcttctatttcttgtttcctattttagtttttgtccttgttgttggatgacgtggagggagaagggtgggctcaaggtgaataaccaagcccagcccctgaagggagagttcttttcaaaccctggtggcccctgcccgccccccagcctcccctcccccacctggggtatgtgtgtggctctggcacaattaagattcttgctgggtgcccccagcccccgctggccccgctgctgagcagcctgtcttgaaggatcttctgagaacggactccttttctgggagcgtttataagagatttctcatggctcagttcccctatagaaaaccaggaattgtaagtcttacatagctcaagaaagaaagtgaagggagtgagtcagagccggccaagaatgagtgaacagggttggtggcagtgtctcgggaggaattaccaaaaaagaaatgaaaggaaaaaagaagaaagaaaaaaaaaaaggaaaaagaaaagcaaaaccaagttccccccaaccccccacaaaacagaaaaaaaagataaacttttagcaaactaatgtggacagggggcctctgaactccctggcaaagcagttgggcgaggaagcggatggttttctgggtcttcaagtgcattctgcctccttagtccaggcctttgtggacctggtctgggggaatatttagcaaagttgtttattttgcataaacccgagtaatgacccagccctaggggagggaattgtgtggggctgacagcagcgtgatttaagggggagccacctgacccctgcccctcccaaacgtcccctgcagaataaactcgctttcttcccagcccgctgcatgttaatcaatgccgaaggctgaggcccgagaggcctattgtggggacagtcgggtcctcctggggctttgtggcagctccagctgagttcctttctctctgctgctcactctgactttccggaaaggccccaatctcaccctggagctcagcttgctttcctggttcttcccaagcaattgtccgtctctcagatctgtgcactttttgaaagcaaaactcattagtatattttttaaatgtgtttttgtgacagatgtcccttagaaaggacaccccttagaaaggatagctgcctggggcccgcgtagctgatagctgcctgggaccggcgtggctccgctgactcaggctgggtttcagctacgcctctgggggactttagccttgagtatacgcagcctgggagtctccagtgctcagagtgcctgctctgttccctcctgagcattctgttcccttctcactctctttctagagcgccagtgtgggatcagttcttactgccaggggtgggggctaatctgtgtcttgtgtccttgaggaccacaaatgaagacatgcattaacccttgggggggggtaccagtgatttcaaaccgcccccccataaatccccccacttccattttacctctttcctcccatatggttttcttttctttcttttttttttttttgagacagagttttgcccttgttgcccaggctggagcgcagtggcgcgatcttggctcactgcaacctctgccttctggtttcaagcgattctcctgcctcagcctccggagtagctgggactacaggcgcctgccaccaagcctggctaatttttgtatttttagtaaaggcagggtttcaccatgttgaccaggcttgtcttgaactcctgacctcgtgatctgcccgcctcagcttcccaaagttctgggattacaggcgtgagccactgtacccggcccagtatggttttctttctagtgcctcaatgggtgcctccttgaggacctggctgatggggaggggaggggaggggctccccggtggaggcttgggccaccaggctgtggacactgcatggacctcagccatccctgcaggctggcctggcttccctctgtgtcagcctttccagcgtttgcagccagcaattctctccttggaaactgggagggaaaagaaaacaacaacaatgaaaaaacaacaacaaaactaaacgtgtgaacttggctgtaagtatggagcagaaaagttttgcttggatgtggcactggggaactgatggaaggaacagtcctttgttagaaggggaggaaggggaagtgaagtagtctctccttagaattggggtgaattgttatgaataaaaaatacatacttctcagggctggatgcagtggctcacacctgtaatcccagcactttgggaggccaaggcaggcaaatcacctgaggtcaggagttcgagaccaacctggccaacatggtgaaacgccatgtctactaaaaatacaaaaagtagctgggcatggtgacatgggcctgtaatcccagctgctcgggaggctgaggcaggagaattgcttgaacctgggaggtgaaggctacaatgaactgagattgcaccactgcactccagcctgggtgacagagcgagactccgtcacaaaaaacaagaacagaaacaataacaaaaacaaaacaaaaacatgcttctcagtaagtttccctgggaggatgggcccggaacccagagacacttcgtctggtcactggtctcccctcgtcttgtaatcccttccttgcctctttttaaaaggaaaggtttgagcccactgtggttgctatggttttctaaccaacaccttgatatttgcaaagggctctgaagtcattagagctatttcttgctcatcacctcctggtgagacagatgtgactctcccctcccattttatgggtgaggaaactgagattggagaaggcagacaagggccagggtgtcctggagctgtgtgaaggttctagggttgtgattcatcaagccaacagttagaactgtcatagttttcctgtccctctctgtccctgagtgatcttgggcaggttggttctcacctgccttgatggtctgtggatctcatagcattaagtgtggctcagatttctccctcccttctttcccccaccctctctccgccccaccctgaggtcagcctgaaggcagccccctagccccaccccaggcctagtgggagactcagacacaccaggggtgtgggtaggcgagggccatgaccccagaaggctgtttggggtccagagggagcccagaggggccctgtcttccctgcctgaggcagggtgggatccggcatgtctcagagatatgagtattagccaggcccaccaagctggggtgggggggtattgacagtaataaggaggtggtttctgttctgaagggtgaaactctgaaggccctagtgctggtgtggtggtaacagcagtaaaaattttagcaccaccaacaactggcattttgttttgaaggtggaagtgtcaacaggtctctaccatggcttcctttgaaaaacacacatacacacacacacacacacacacatacacccacccccccacacactcacacacacccatacacacacacacacacacacacacacacacacacacacacagccttcttcggaggccttggccctttttctcaaggaatccccagcttgggcgttaatccctcaagagtcaccaagagttaactcttgagaagctcgtttattcatttttaccctatgtagttctacaggcagcctccaaaaatgcatagtgtgtaacagggctgaacaaaaagtggcggagatcaggggaaagaaaaaaaggggatcatgaaatagaaattaacaagttgaagttgaggccagtgcttgcctaggggcaggggaggaacgtgtccacctctgtcccaggtggcctgtgtgagggagaggggctgggggaagagattcctgcactgttccccatggggctgcctgcgggcacatgcctctccccagcaccacccccactgacacgctccagccgccacgccctctccatcacaaatgtggccacagctcctggtcttgtccgggtcagcctcagaagtagcaaactccccgtgttgacttcctgttaggggaacgaggattccatcctttgagtcctaaacctctgaaacagcatgggcccctgctccctggctctgcccagagttgtcagagattcagagaatcgtctctcagttttgctcaagagcctgaacactaccgctttcctactaaaggctaaaaataaattttgaagcaataaaggtgatcacagtagagacagttctccacttacaatggctcgactttactgtgggtttactggggcatggtaagttgaggagtaaatgtgttactttgtaaggagggcaaagattgtaggcacagggtttttggaggccaggggattgattctgttgggtttctagtctcctctggatgacatcaccaacctgaaatcccttacctgtgtcataacaaaggacactttgtgtaattttcttagatactcacatctttaccactctattctggaaaaaaatacccatttaggccttgccgttaacatgtctgatctcaggcctgaagatctcttagagactcagtttccctttctgtacaatgagtgggtttgactgatactcatgctgagctggtatcttttatcctgtatttatataacatggtcacctctttagggtgctaacattttatgagacctctttaaggtgctaaagtctcatgatatcatccagtaactctaccccatgaagggacattttattactcattaggcatcaatgtcaggttcagcaagtcttatcttgatgctgacccttgggaactgcacctttctgctttccaccgttcagaggagttgatacactgtgattttcagtgaagggggaccacaggtccccttcacctgtggtcttttcttgttgctgttttgtggagtggtttccatccaccccctactccctcgaaattagggttaaaacgcaatggcataaggcactgatatagattaaaacacacacacacacacacacacacacacacacacacacacacaaaatgattgtcataaagaaaatcattccagtcctgtgagtttgggattatattttccccagacatttactgtgtttatagagaaaaataaatatctctgtaaacatgtgttgtatttacagtgaaaataaatatctaaataaatattaagcttttaaaattggagcactcgcagaaggaaatgcaaatggatgtgagcgagggctgcctcacttggggcgtgcatgcctggattcgcactgaattggggtgcgtttgtctttctttccagctcggagtgcagagccatgcttcagggaggggaaatgaacatttatggagcacccactatgggctcgacactttacaaagagagcttcattttatcaccacccggctctgggtggcaaggagtatctgtgttactttgtaaagagggcaaagattgtgggcacagcgttttcggaggattctgttggtttctagtctcctctggatgacatcaccaatctgaagtcccttgcttgtatcataacaaagtgtcctttgttattttctcagatagagaaaatagatgaggaaactgcagctcagagaggtgaagcgacttgtccaaaatgacagttaccagttggggtagctggatgttgttctcacccagaatgaaagagcaagttatggaacaaatctgtacatggctgctggtgctaagacttttctaaatccaggaccagggttagaaaagccaggagctatggcagttgtcagcacgtggcacctccagacacagaaacgaaagggtctgcggtggagtcctttttcctctactccctccgggagggcctggctgctcacgcatttacgcctctctccaaacactgggtccttcactggaaactcctctgaaggacagcaagcctcctgcaccccgccaggagagctctttcctggagatcaatctgcagagagcaggctcattgtgagccattgtgagccagagcaggctgcagctgggcctcatctgtgcatttgtgttttacaagcaggcgtcttggtgggagatgggttttgcagatcagtgtaatatagaagcaaacacttgaggatgggagggagagcacgtttctcactttaggggtttgcttccaggacttccttttttggaagtatgttctttttctctctcatacacacttgtgtgtacacacacatacacacacacacacacacacacatacacacatgcacacacattccaccccacagcctgttcctcaggctgcagcttccccaaggaaggcgagtgccccgagcctgctcctagctgagcctgcgcaaggccatcagccagtcttgtctgggtcgaaaaggtctcgttggctgtgtgatgcaacttgcagtgaactgagggtgactgtgggcgtcacagcagcgtctcagaaggccctgttcagccctgtctgggacctgtatataacggaactcagtctcacctctgcagaataggaatggcggtgcccatcttcctctttcttgtggctactctgagggttaagtgaagtcatcgatgaaaatacgctttagaaatgaggtttgtacagcgagtgtaaaggcaggctgtttttctaactggtgtccaagccaggtgtggacctgcagtaaaatgcaaatgaccctgttatgtggacaggggccattgtgacagtgagctttgttaggattgctgcatcacccacaagcctgttactgctgagccccaactccagcttctgattccaagggcctgggaaggtgcggaggatttgcgtctctagcaggctcccaggacatgcagaggctgccggccgggggccacactgggaactgctggggaaagtttgctttactttgagttctgaggcaggcaaggcagaagaggcagaatctcctgggggtgggagggtggttacaaaatgaggccccagcttgtttgcagcccccattgcctcttgaatggtggatatcctggctgccttgctcttttcccttccggctctttcttgttccttctttaacagaatatatcccttaaaccagtgcttcccaaacttcagtgtgcaaaagaatcagcccaggatcctgctaaactgccagcttctgaatccacaggtccaggatggggtctgggagtcttcattttaaacacacaccaggtgatggccactgctgcagctgctgagaagcaaggaccaaaacaggcagtttccaaatagtaaagtcacttctgttttgcaaactcagatggcattttctccatgaagctctcattacctagcttggtgaccctgtgcataggatctgagaactcgctgccttggtttcccttctgcaccctagcgatgttaacccttggccctatgagggttctgtggaagaaacaagatgaggggacaacacccagttccttttaggctctagataaacattatttgctgtcttcttctgtcttttactttcacagcccctgggtaaaatagacaagggatgtgcgtggagacggacattgtatccaaaaatcggaggtcagtgatgttgagcggtttgctcaggatggtagaggcggctctggaggtggccccacatctgctgacttccatgttcaggttcagagttgtgggttcagatttcagaatgcggatccatcagagaatctgtctggtcactcactttcctttgcacttttcaagaatttgatcctttttctttttaagagggagaacagagccctcttggctggcaggtgtaaatcttcactttggggtttgtttgtaccagggtatgttctttctcacacacccacatacttaccctcgcccccacttgcataggtaaacagcttttaaatgtgtattttctttcaaaataaagccacttaagctttaccaaaatgcactgctgacatggaattcacatttggcaaacccctgccatccgtgttttactgagtgcagactattgtaaattaagggaagtcactgtgtgtgtgtttttttcttccagactgttatggaagcagagctggtcctaagtaaaagataaattatggcgggatctaaagaggcatcatttaaaaagtgtcaggatacaattgggttcttaaaaaccatgcagagctgctaaattcacatgaaaattgagtggagctggattgcctggggtgacagcgtccttggcattgatttatcccatctgtttggccggcccatatgacttgaggcctctggtggagaggcggcttccgctgggccggtgctgctccgtggcctctgcaggtcttcctggccccagcccccagccaggccactggggagcatgaacaggtccaggggtcttcatagaccactaggagaaagacaccaatgaaaggcaacatccacggagtgcacatcctgtttcttattatttgtgatagaatccttgcaatatcgtcttaaagaatgattctggactgaatctaaccacttcccccttgttgagcttttagattagattacctacaattgtttggtattagaagttctactgtgattaaaatctctgttccagtgctgtttaccacttagatttttaccctggagtagattaaggaggtgagattactgacaaagagtaactgtttccagcaaggttcttcacaacactcttttcagcattgggtattctcatttttaaacatatacttgtaattttttaggtagaaaatcgtattaatttgcaggaaattcagatttgttgtgccttttttttaataaaaagagtgttgtggagactcaatttggcagttgcgtgctggagccagctcataccagctaacaccagcttgtgagagctggttctacgcatctctcccaaactatatgctcagtgtcttctccttggtaccttgaaatcagccacagtgagagcatttacaccatggaaattggcacatgctacaagccattgacacccacccccccccacccccaaccccttgccccattgcttcccccaaaagctggttgttaacatgtgtcagcataccactgcagctatttaacaaccggctatagaggacttgctgggaaaacacacaataataagaaaagcctagggtccagtgagagaagaagcaatggtggttaatattataataattgacactctgtggccaagggctgtatctttgcagtactcatcgggtgtagtgggaggggaaacagtcccttcaaggtttgagtatttcaggaaggctttgcaggagaattagagctccagccagattccccagagtgtgcaaaataaggagggaagggggaatgaaggctggaggtatggtgtgctcatgggggtgtcaggaggcactcattccttgttgtagatgatggccaaaataaaaattccagctggtgctgtgaacctgaactttgacattagccagagccctccagaggctgtgctgcccctcgccgggtccctcctgggtgatggccatgatagcaggatgctgtgcacctcctgttcctggcatctggttcctattttattagaggttggagttcaccctcagcaatctacagcatgcatgcatttcaaaggaaatgcttaattagtccccaagcctgggcttctttaggctcccaaggagaaatgaattttgttgccttgatggattggggaggacaggtggagctctcaagtatgtttgtaagttgcagaagttgttcatttggagactgtgggtgtaataaatggtatgagctgaggcaggagagggaagtgagactcaagtgatgaatggcagagggggcatttattgaagccagttctccatggcaggatttggggccagacaacatgggggaataaactttttttaatgcaattcagggccgggcgcagtgggtcattcctgtaatcccaacactttgggaggctgaggcaggtggattacttgaggtcaggagttcgagaccagcctggacaacatggtgaaacacgatctctagtaaaaatacaaaaattagccgggcacagtggcaggcacttagaagaattgcttgaacccaggaggcgaaggttgcagtgagctgagatcacgccactacactcaggcttgggcgacagagtgagactccatctcaaaaaaaaaaaattgcaattcagacagtttctttaaacagtccaccagcctcttgattgtgggttctgggtgctagtgaccctccccctgagagcccccaggcaggcctgggcctcactgagagagacaaagtcccactgtcagttctgactgactgtccccaggaccctcagccttagatccctggactttggcataaccacaggcaggttggctaaggatgcctgagaaaaaatagccaggctcttggagtcagacttagctcgctggtcctttatttcacatcctgccttcatttccagagcgggtactgtgcaaggtgggtgagtctctgtccacttgagatgcagggtgacctacacaacacacagtaacatctgggtggtgacagccaagtgacaagcagccttcccaaacccctttgtgcttcctgcccttggctgctgctgttctgcccctctttcctgctgagcccagatgtgttcctccccaaggatccagagggatgaagaccaggaacttatgaagcgggcgggtgactgtggtgacttcacatgggccaagaaactcaggggttcattgctgcaggtgggctttcaggaaggggagattggggaggggcaggtgggcagtgcagagttttgggggaatataacaagcatggagtgtgatccaagggtggggaggaggctgtccccctcccccagctcacctcatccccaggcatgtgtttatcccatgaggacagccatgggcagtgggcatgtatctagaaatggtgccaagagtgactgggaggatggagacccctgagttctggaacattctaggcccttctggaaagagcatttggaacaccaagcagtatccttacctgtaggacactgagatggctgaatcagttactgtaggtaaaatcattcatggatttattctttcactcattcttcattccttgagcatgaacctgtgcctgctgtgggggcagcccaggaccagtcttcacccagatgctcgttctaaactctgcctgctctggtgggaaggcagggccctgggctctgagagcctgtcggtccctggctttctgtgacctcacgagctctgggttttggttttctcccatcaggagaacgtctgcctggcacctcctgggtgcaggacagggtctgtgtgaacatgtgtgagccatggagcggcctgccaagggaagtggcactgtgactgaggaaggacccaccttcccaggaggagggacccacctttccaggaggaggcgcagctgttctcaacgccccctgcccgatggaatccactggggagctttttaaaacgctggtgccctggagccaccccagagagtctgcttctgtactgggctgggttttggcctctcttgattccctggtgtttctcctatgcctccagagcctgcgatctaccaaagttggaaaataaaggaggtgaggtgggggtggatgatgtctctcccaactctattggcccctgtgcttcggcctctggcccagcagagagaagggagggagtttggctggtgtggggcagggaggcaggaaggacagagcgcctgagctgcaggctttccctcagccattaaagtttatcgttgccacggacagtgattgaaaaaggctttttgcaggactgaaatgtgagcaatgaaacttgccagttggtaccgacacagggcacttatctcataaaaatatcctccagtgtcaaaaggtttcagtaaatgtggctggaagtattagcagtcatttctggcagcctcaggctcccttggggcctgcagtgaggggctgtaaaagggggctctcagttcctgcaaagaagaagggagggagggagagaaggaggaggggaggggaagcccaaactcagcctactgctgtggggaaagtgctggatcctctacggggcgccccacagcatcagtgggggtgcctgtccctgtgcatactccagctgctgacttggagggtgggagaactgcctaccagaggggccagcgtgccgacttccagccagccagggagtgaggttatgggtatgtgatcctgcttctgctgacctgcaaggaggaaatggagactcagagaggttgggtgatctgcccaaggtcacccagctgttaagtggcaatgtcaggattaggaagctaaagccctcctcctttccagacgctcagagcctgggatgagttctctgtgtctgggagcagggagttgccaaagaccaggctgacctgggcaggcctctgcccactgtccagtggctcctcagggcttgggcttggggcatagctcaggcccgcatctggagggcccttcagcaggaacgaacgttctccaggaaggcctgggcttctcttgttcttgttattccatcaggacccaatatagtgcccaacacaccttagctaattgtgaagcaggtgttggctgttgccctgaggttaccaggggctgattgggggagggctacactgccccccccccgcccccacatgggccccagtgtccacccaggtggtcagtgcactcagcttatcccgtcccctgcccgtcgttgggctccggttacctgcgtaggccacccttcgcccagatggggctgtgcagtcccaaggagggccggcgcttctcgccaagatggcatgccctgctcgctgtgggcacagccacctgagcccagcctcctgccagcagccacacctacttggggagctgggccagggacctggtctcaggcagcacggtggggggcaggcaaggtgttcaataggaagtcagggcccctggggtgaccaggactccttgactctgacttgaggggacagtgggagtaggattgggtggccacatccctcgagtggtttcccctctccctgcctgtaccagcaggtgggtgatgaggcccactccacacatcaggcccggagcccaggggtgctgggtgcagaccatggggttcaccctctcctgccctggactccaggcaggctggaaaggagtggagcacccagggtccagattcagctggcaaggctggcagctcaggaatatgcctcagggtcagaaactaaggggccaggtgagcaccgggcagctcaggcaagagccctgtccccaggctctagctccagcgcactccctctctttacacactggccgtgtacaatctcgtcctccttcaaggtcgcagccaccacccaatgtctcccagaggacagcctcccaccaagagctgagcccccagctctggcctcctttctgtaactagtctctggacacagccactctgtgttccacagcatctcaaactcagcactttctcgccctcaaaacaggccttctcccctgtgtcccctctcatagttgaggccaccagcacccacctaaggtagttagcatccttcctccagaatgcttgactcgccctccctgcatccccgcgtggcagagtcctgctggccctgcatcctgcattgagcatgagtgcacccctccctccttgccgcctctgcccttcccgccctggtagaggccctccatctgtcacccagtggtcacaaggtaagaccagtgtcttaattcatccccttgtctgcagcatcacacacacaccccaccctccacaccaacctgtccctgtcacccccttgcataaaccttcctaatgtctctccatcaccagcagacttgtgcccagcgtcattacatcaaacaagcctagtcgcagcccagccctcacctgctgccttgccgctgatgctctgaccacacagggctctcggagtcccagaagactccactgctcctcatccctgtgcctttgtgtgtgccttctcagccctctcctcggcttggcttcacctgttgacgggtgccctgggtggtccttgagacctggcccagcactttttcctctgtgcatctttagagcagaggctgggcccgagatcctgctggaggtccgtaaaccagagaaacttccctgacctgaagatgtgggctgcacggtggagactgaactgggagcctggagactctggggctctgggtggcaatggcctctcgtaggaagatcccacagggctcatttatccattaccatggggagtgcgttttctgtagtcagggcttttgcttctcacgttattcagccgggctgtgtaatgggaaagaacagtcaccatctgcatggcatcttcctcgccagccagtgggcagggcaggtggctgcttaaggctgcaagctggagaatcgcagacgagggttcagatcttccttgacagttcctcactgtgtggtcttggatgggtcatgtactcctcaagcctctgtttcctcagtgtaaatgggggtggtgatcataacccccccaacacacacacacacagagttgaaatgaagagcaaatcaacacaggaatatgaagtgcctacaaccgtgcccgcaggggaacttgcagcagcttttgtcattgtgtggtacactgagtgcttcccaccggactgctgggcatgggaaagcaatcttactatcaggaacgatgcagctgtgatgggtgctgccctcaagggggagccaattgatcctttttcaccacctggtgaaagcccccagcagggggctagactgtcctcaggagccctggtgtggacagcacaggatggcctcatgcccacatggggccctattataggtcattaaacctgcccttggcactgtggggtcagcaggactggttgatagtggggactcttatagcagaggagccatggcctggggggcctgtcacccaggggtgacccttcatgccctggtttggtggtctgtgcactcagccgtgcttggctttggcctgagtggggctggccattggggaaggtgcccaagactgtccagagcgtggcatggacatgggtttcagggtgactcatttgtgcacacttgggtagaacaagagaagtggcatcctcgcctcccctctggtgggcagctgcatggggacccctttcccaagccccttgcatatggaggccccctcttctgagcactggatctgcttcccgtgcagactcatgctctagagtcatccactgtgggtccctctcagcacctgaaaagggaaaagaagcctgggtcctgggctgagaactatgaggcagggccctgcagccatctgtgatgtgggagaaggcagtttccccttcctaggagggaagacaccccctgccccccaacagacctggccactgcttgggccccctggctccagcccctcccaccgatgggccacacatagcatgtgctctgaagctgaagctgtggtttaggggaaaccaatgttatgggaacagctcccagctctagcttgtgtcactccagcctggaggcagattcagggtgggtggtttggtttgggaatcttattttgcccagaaaggaaggggggagccagccactaaggagagtgctgaatggctgatggctggaggacagactgtctacaggagtcagatgcaggctgagaaggcttcacgttagtgcctagatcaccccccgtctctgcctgtgcctggaaaatggcatccctgacccagggtggggaattggggtgcagtgttgtctatggcttgtgcttgtgctgaggagttaacctccagcagagaggctgtgaggctcccccagttccccggtcccctgagccaccagaagccataggattgtggcatgattgttgtcattcattgggaataaatgcaccctccgccttttggctgacgtggggagggcttgctcctgcccaaagtgctcttcctggttgggtcccacagagagatcacctggaggtgcctcccacctggtgttccctgcctggctgggccctgcagcctcttctcaaatgtggccctactgtctccctccccaccaagcccagctcccctcccctgctgcccttccctcagccactatctctggtcagccctaccccatgccagcttcctcccactgcacctggctctgtcccttgctgtgaactgtcttttacaaagtgccatccagaaggaaagaaatgctcaaaggacattgacttcatggccccagacctggcaacctgatgcccagaggtataaaaatatgcctctgtgactgtggttagatcgtgcacaccccctcatttataaacccactttaggccgggcgtggtggctcacacctgtaatcccagcactttgggaggccgaggcaggcagatcacgaggtcaggagattgagaccatcctggctaacacggtgaaaccctgtctctactaaaaatacaaaaaattagccgggagtggtggtgggcgcctgtggtcccagctactcgggaggctgaggcaggagaatggcatgaacccgggaggcggagcttgcagtgagctgagatcacgccactgcactccggcctgggcgacagagtgagactccgtctcaaaataaaataaaataaaattttaaaatccactttacaggtggggaccccacaaccctggggacagcagacccttcgtaggccttcctacagatttattccataagggaccgatgactgaagccatagctacagctcctccgtgtaggcccagctgggggtggagtgagcctccgtccagccatagctggggctgtgggtcccatttccctctgggtcccctccgttttcctgtgctgtggtttcctccttttagctgtcatgtcccaaccttgatccccctggggcatctggtccacccctgcccatgaggcctatgtccatcccacaacttataatgctaacaagccgtttggggcctcccggtggtcagcaggcctgagccaggggtgacagcagggccctcagccacctggtcccttggcacggtctgtcagggcttcttgcctaatcaagggatgcattttaatttatgcaaatgggggagggatggtggcagggagtcacagacatccatcaccccatttcctagcagcagtcattcatcagtggggccttaaagataatacactttttgtttcaggcaattacttaatcttgacaaactcctgtgttaagcagggctattagcggggtccatcattaatcagcgcagaaccaagtgggtgctttttctgaactgcaatcactcttggggacccggggtgggccctttgccatcctcgccgccctaattacacaagcagcatgctaacaaccagcatcccacacgtgttgcaggggcgccaagccacgggcagaagaggggcccatttttaacgccagtcagaatgttttcggagccaggcagaatgatacatgggggttattagcagccaccaggaacacagctggggaaacagataactcccctcccctgggtccctcccggacttgcctctgacttcgctgggtacctgggcagcacttagatgccgctgcatggcagacccattctgttttaaggggttacatttccttttggaaagaccacgaatgaagtgaaaataccaaggctggccttgtgtttcctggagtttgttggtgctccacctccttaccagggcctgggtcacagagtactgctccctcctccatcacacacctgtgacccttattacaccaatgcctggcccaggctgccctgagggggagtgggcacccaggagaacaggggatgagtcgggcaaagactgggacctgggccttcccccggcctcatttcttcttcctggtccaagaagagctcataccgccctaccctaccccacccatgtctggaatttcagagaaatgggcatgaggtctggctgtgacacagattagccatttgactgacccagggcaagttactgaacgctcctgtgcctcagtttcctcatctctaaagtggagataatagtaacaataccttcatcaattgctatgaggatgaaatgagttaacaaatgcaacatgctcaggaaggctccagtgtgaaggaagccctgtgcactggctgttagaaccactgcggtttccagtctccaaggaagggccagtgcgtggctgactcctagaaactgctctgtctcctactgcggccccgagcagcatggctttctctcctcggtcctaaattaatttagactgaccgtcggtagctactggccacccttgttatcctcgggttctgttttccaatagtgggaggattcactcattcatgtattcattcattcactcactgggcacatactcctcacctcctccatgccactcgctgggctggtcgttgactcagaggaaatggtgtggagggagtatcgtctgcctgcggtggaggggggtggcagaagaaaggtccaggaagcttcctggaggcaggctcgtgtggactggggttgctgagggcaggctgagttggcatgatgaggatgagggggtgtggtggggaggggctttctaggcagggtggagcctaggaggcatggggtctgcaaggctgtcatttgaccctggggctgggagagtctgtggggcaggatctggaggtcctgagtgccaggctggggctcttgactccattctgctggcaatggcaggacctggggaccacctgtcagtcactcagaccctcctcctggtccccctactgaggtgtgactggacccacaaagcagggcctttgcccacaaacgcctcggatgagagtgcacaggccaggctgctcttgggtttgtggaagggcagctctggtttctccggccccgaaacacattgtatttgggagttttcccctagatcttaaaccctgtttatttaaaaagaagtagactctgtctgcttttaattcacatgcttagctcatcaaaatattgttttgcaagaggtttttttttttttttttgatgtcaggaaggctttggcatgttttcctcctccctttcttctacagtcttattctaggaaataagattctgggcaccgctcagggctggagggttgggtcatgagaccacatattctgtgtctcagtttctgaaccaacaaaataggggagcaggctcttcccacggattcatggactggcctccagtcctgctggtggacaccgtatcccagcaaagagaaatactgtttccatgcgccacagtggtcgttggtggggagagtggggagggtggtgggaatggcatgtgctccaaccatcattcagttaactgggtccagaatcacacgggcagggagccaggcgtccgaaagtgtaacacggcttgcccggtgtttctccacggtcctgccgcactgcccctcatgaccccggcatgggctttgctttctgcggaccctcttatttgtcgaagatctcgggagtccacacacccactcccgtgtctgggaacactccaagcttatcaagaacgcagcgggcagcaatccagggcagaacaagggaggtgctgtcgaccagctctgcgcggagaggtcaagggtgtggaagggtggggagagaggcacaggctgacttaatcccttgggcggggcaccggcctcacccacagaatcgcaagtaaccctcctacgattctgggaacgtttgtgagttaaatgaatggaagggagggaggaaaggagggaagaaaaataactgtgttttcatcagtaaatgtaagcgaccaaatagaagtctgtaggaagctaagattcagaggtgaggaaggactgaggtttggggagaattctcatcaccatattttgtgtattgatgggacttttactaagctagactagaattccgaagcagtggaaagtcaataatgataacgagttaggcctgagctgttcagtagggtagccgcgagctgtgtgtggctgagtgcttgcaatgtggctatcctaattgagatgtgctgtgagtgcaagataggtaccaggttttgaagacgtagtaggaataaaagcatgtaacacatctcattaacaatttttttactggttccatgttgaagtgatagtatttttgacgtactggttcaattaaattgtgttattaaaataatcacctgtttctttttagttttttttaaatgtggctcctagaaaatttacaataacatatgtggcccacattgtatttctgttggccagggctgcattggatgagtggacacctagggaagattctagtccaaggtagagagaattgtaaaggatccctttgagtaacataattattgggactgacaagaggctcccagaaagtggcccttacgggacctgcttggatgaaagaatggagagcattttgtcattcccctgttgattgcagaaagacagtaagtccagccccagtgctcgtttgcttgtccaggtggctgattccgctgcccggttttaaaggtcattgattgtctgtggcaggccctgcctcagaatgcagcctggaataaagaggtgccttggctcagcctgggaaaccatcaccagggcctggtggagaccaaatgtggtggccttactgtcgtctcaagagctatggcagagtgcaaagctgggacttgatgctctcggcaggacgcaaggcaggacctataagccagatcaagaaacctcttgttgggctctgcagggaaggggctggatgctagttaagtacacagaatggcaagtgacaccttcacgacccgtggggaccagacagaggaatggcatggtcatcctcctgaaagggagaatcacctgcgacaagtgggcttcttgccggggaccagtcagcattgcaatagctagccgacaaggtccctgccagctgacggggtcgccagtgtatactgtcaaatgagtatgtcaaggggcagcaagattttaggggaaagcctgaatccatcccaggccacctggcctagccctggcctgtgacaggtggaaggagcactagggcctgggcaccgtctcctccagctcctgggctggattcctgctttctgcattggattctgcaaggtgccagggtccctgggagccatggtcctctgggcttcaaatctattgcattttgcagtggggaggctgcacactacttttttagaaaccttctgtgaccaagacagagttttcaaccttaagcaagcttgaccagccctattgtttcttccagccctaaaattctctaatgtgggactctacatgtctacccagacagacaggcagcccctcccattccttgtgatggcggggatctcccaggtgtccctctggagctcaccccagtctcccaccccttgctaaaggggcaggagcccagcagaggggtctgtagggatggccacaccggcacccttcggggccctactgcgtgcctggccctgcactagctcttctccacttcacagtctccctctgacatgggtcctgtccctatcctcattttacagataaggacaccgaggcacaggaaggttcggtgagtcagcaatcaagccagacttggctgtggcactggcggcagcctcagctctgtccaacaggacactatgccgcctcttgtggcctgtctcctgtcacttcaaggccactgttgcagggaacagatcccatgactgcctggctcccgagcggccagacccaaatggcacggggctggcctctcccgtggcgttggctggagcacactcctcaccctggaatgtgcaggtccctctgcatccctacctgccctcaccaggagaccagtctcagaactctgtgcctggtgtggagtggctgtgctggccccagcccagcacactctctctttcggcagctaatttgtcaagtaacacctcagcctggggtgggcagtgtgcgtgggcggacccagcagaggccacgggtcctgctaggctgtgtctgcagggcaggcctgattgcgtgagtggcctgggcctcagccagccggacaccagccagctcgtggtgttggaatttcctgtctgattttaattcctccccccacgtttttcccccaagtgagacagaagcactttttagttgcacgttgtggagtggccattcaggatattattcttattaaatgcttcctgtggggtggtggctgggcatcaggagggcctctggaattctcctgtcctgtggcttattattgaaaatcatggtgccatttgcataaggccctggggaaggaggttttccatgattcgtgctcttttggtgcttcctacctctgatgcttaggccagtgacttcgtcctcatttgcgaacgaacacctggtcacctgggctcacgtggctgaagggctggcctttgaaagtgtcaggatctcagaacagaccaaggctccctagcaaggggagaaagtccctggcagcctctcccagccctggtgtgcactttcattcatgtaccatcgaaaagcacagacccctggatgccttccaaacctgcattcccagtggcacccagaccccttgcagctgctgctcagaagcactggtaaatggtcaccaggattcaaatgtctcccccactcccgcctctctgatcttctgtgttgagtttctccagttagtacaatgcctagtaggcgcatggacatgataaatgatttccccttccttactgtgcaactgggaactatggagccacagcaagtgtggaaatgccaaagggcctgtgagtctccctcccggggtggtccctggagcagcagcatctgcatcactgggaacctgttagacatgcccaggctcactgaggcaggagctctggcaacagggcccagcaacagcctgagaaaccccgatatcagggcttagtgggtgcttcatcatgtacctcttactatgtgtattacatcatgtgttcctctcgaggacgccagcaagagatgttcctcatcctgtatgtataggagaggccacatgctttgcaccggggcttacacttcactcggttcagtgccagggcacaattgggcatcctgggctcactgtccgcactgccctgagcctgaagagcctgccatcctcccccttccttctggctctgccaggtctggcctcttccaatgagccttcctggctgctccagacctcatggaaatcttttcctgactttgaggccacttgggcagtttgtgctgcgtgggcctcgctgaatcccgcagggtcaggctctccagctgtggcagtggcttacacagcagcgccccggggcactccctgtgggcaggaattatgcctcttgttctctgtggcctccagagcccatgagcagcgtcctcttacattgagcgagtaggggaagccttgacctgcagcagggtgtgtggttgtgacttccaactgtggatggagaactctgccctgggtggtgagcagctccgccgtggattccagagacagctgtggagccaggcttgatggggcccaaagcctgtgtatgtcaaggccatattagtgggacaatgtgtctgaactacatcgtatccctagatcagacctggatggttgaaggagggagcatccagcctcttctttgaagctggtgtcgtcgtttctggtatcttctgggaagcctttaggtacaacttccctggggattgggcctgggatctccacaggaataggagagagcagagtcttgctccatgggatttgtgacaagcccagaataaatggccagaagcgaccttagccatgcaaacagcaagctgacatccagcatcattggtgttgggagggcgctggccttctggggttcatcaccagaatgacggtgctgatcgccatccttacccatgaggttaacatttttcatttcataaggtgtcttcacattcctgtttcatataggattaagtggtttaactgatcaaattgtacattaagcgtggaatggaaagtagcaatcactctcactttctttctctctgttgagactggggagtcattgacgaccatgtagccagtggtgcatctgttcttgtttgacaactcagacctggcccagggccccgagatggcacatgtgtgcattcaggccccactctgttctcctgagcctgtgcttcctggcagagcccagaagcagcctgaagatgcagtaccctgcccagccttgccctccttgcagctttgtccaggccatccatgcgccccctttcctggagggaagtagtactgggtttggtgtaaaataattgaattgtagaggagaccccatcctctgcactgctgctgccttgcagcacacaggaggagccttcatgagatgtcataggctgggacctggtcacatcccttctgccttgggcttctcctgctgctgactttcccaagaggggagttattgctgcagccatgggatatgtggctgatgcagacaaggagagtgggagccctccttttaaacggaattcacaatagtgttcacctgaactcccagaccaccttgcaagttccctcccctgcttattttctgcgggcagcatggacacagacactagggaaagaatggtgggaaccaccagagcttgtagtagccagcctaagcctcctggggattggtcatctgggaataggggtgagtggccagcagggattaatttatagaagatctttcctgcaaagccatggctttcatcagttcctgcatcctcactctgtcaagcagtgagtttgcacagagtacacatctgtgcatggagaactctgccctgggtggtgagcagctccgccgtggattccagagacagctgcagagctgggctgggtggagcccaaaccctgtgtatgtcaaggccatatgagtggggtgatgtgtctgaactacatcgtatccctagatcagacctggatggctgaaggagggagcatcggtggatgccttatatgagtttctatctgatacatctcaatgtcccttatactgggaatggaggaaaagttctcttcattaccatagcaccgggacccttgtcacatctgctcagagatggggaagggcattatgacttattaggggtttctactctatggacaccataaatattctttttttttttttttttttggatatggagcctctctctgtctcccaggctggagtgcattggcgcaatctcagctcactgcaacctccagctcccaggttcaagttattctcctgcctcagcctctccagtaactgggattacaggcttgcaccaccacccctggctaatttttgtatttttagtagagatggggtttcgccatgttggccaggatggtgtcaaactcctgacctcaggtgatccacccacctcggcctcccaaagagttgggattacaggcgtgagccactgcgcccagcccaccataaatattcttcacagcagttgggttgatgtcattcctattttacagatgatgaaactgaagcttggaacactcattacttgctagcgaatgacagagccgtggttcacactcaggtctgtctggattcatggctcaggtgcgttctgctcctatcccaagccccttagacaacagggacaggtgatgtcctgtaggactgtcctctggctgatgtgtgacactagagcaagctggacttcactctgactgcaaaggttaccttgacttccagcctgcccctctactgcttttttctttcttctacactagcgccttcttttgccaaagatatcggtgtattttgtgcctaggtccttccattaggagaaaagcaaccagtaagccatctacactttggtgtgaatccattcccatgactcccaagttctgtttgcttctaagaaaataatactgtgctggatgttacttaatatgcaaggaattctaagttaaaggaacatgataaattagtttttaactggagaatcccaaagtcccccatagtgggaacaaaattggatgtcaaaaagcccttctccagtcatcccagagacgtgccaagtaagaaggcctccacttcagctgattggagtccactcctcacgtaagagtgcccgacccgacgcagagcaggcaccccaggagtgctttgtgtgcgagtgctggccagggtcccacacagaccaaagcctcctggcctgaaggctgggaaggtgcatgtgggcatcacagaggccacctgagtgtggcaggtggacagggcatggggacctatggtcctgacacggggcccacccggtgggtgcagcatggctgctccaaaggagtctctctccacgtggctccagcactgtcccctgggattcacacctgcagcatgggagccaatccctggaaccctccacagcaacactcagcatcaccgggcttccccatcctggccacagccaaggggctgagggccctggtgtttggaaccaaaggcctcatgcgcccttccttgatttctggtcatggatgcagctaccgcactggcctcctacatggtgaccctggagtgtcggccaattgcccaagaaggatggggatccaggccccagccatgccactgccttccttcccgggcccacaagctgcactgagatgtgtttgcgctgcctcgtcgtaacacagacctgtatggtgcaaggctgggcctcaccttccctccatcagtgctggggcaactcgatttctctctgaaaccggtttcttctctggtccaggccggcctggtgcacagcgaccacatgcttccaagctaattccctcccgcagtcttgatggaagagaccatggtaactggagacggtgctaatctctaggactggacagcccagagggctggggcatccccaacacagccactctgtcctgggaggtggctgctttcacctccctggcctctctgccgtggaacaggccctcaggcttctctgggagcccagccacggggcagtgcctctgcgttgtggcaacacatgacttcatccgaggagaattcctccggctgctgatggaggccgcctggtcatgtttccatgacccagttttcccgattctttgtctgaactctgcagacccctacctccttctctcccccaggaatccacaggatcatttctaatggggcattaacttgagccaggtttccggggaagggctgtccttgccccctcactgccctcctcactaacacaagaagaccattacacccagtacactgcccacaccaatgtctgctcgccctgggaccgccagcaagaaacatttggtgttgaaactgcagcgtagaaaagttccaggattttaaagaaaaagccgtcactccgccgccaccctcagcttctcaggctgttgggctttctgtgtaggatcaaaaacaaatgtgcattttttttttccagaggggagtgatgatccattgaaaattcccatcttagagtttcttcctcagaaacttaaaaagagagtcatttctttgaaatggcatacggggtgtgtatgttttcagggggatggtgtgtctgtccctctgccggaaggacatgattaattttggattttttcttttacttgaaaaaaaaaaaaaaaacacaaaagccaacaatgaaagctgtgtgtgtaagggtctggctcaggatgtcactcaaggcagcgcctattcttcccacgcatcttcatgctcctcgtgggcttctgcagcctctggatgcagcaatttcttgccagagttggaaagcagaatttttccctcctcagcctggccagggggctctgagcaaggcattcacctctgaatgtttccatcgggggctgtgggacaatccgtgctggtctgaaagagaccaccaatgagtcagggtcaacctttatccctcaggttacttgggaagaaaaggtggtctgtagagactgtgtgtgcacgtgtgtgcatgtgtgttggcggggggtgttggggtgctgtcctattatacctgggctcagaggattggggctggggctggggctggtgtgtcaagtgggttagaagggccgttgggtcagtcattatacatacagggccacaaagatgaaccagcatctgcacccagagccctggtctgggcctgctcaggaggtccctcctgaagccttggggtgtcactggctggaataagcgaggccctttgcctgggaagtgggcaaccatttacagatagcaggaatgtgccagtaggaagggacctcatagctcctctaatccctgttgtacaaggagtgtgagacccagagaagggacgtaatttccccaaagtcccatggccacctagcggcagggccagtctgggattcctggcggatgggcaccactgccccacagcactggaccctccttgtacagcatttccaaaagttgtatcagagcaggtgactgcctgctcaggacttcccaggggcttcccagattgctcagaaaaaaatcccaaggttcttcccatggcctggctagtgtgataggaccttctctcctgcctttccacctccatccatccttctgtgcctggcaagttagccttcatgctgaaatcactgagttctcctgacacctggcctttgaatttgctattccttctgccccaagctccttctccaaagaggctgacttacctccgtgcctcatccatgtctcctctgttccctctcccaggtggatttcctccttagcttcatccccctctgacactatgttataaatatgtttgctgacttgtccaccacctgtctcctctcactgggccatggtgtgggctgccttgtcacaacactgttcccagggcctagaacagtgcctgccacatagcaaatgcttgatacaaggtagatgcatgcatgcataaataaatgagtgaatgaatatttctagatgacagctattcatacttcacaactgctgatgtgaatagatggggtcttctctctgagggtgagcggaagggtctgggcaggtccctggtcttactccttgcaccttggccgactagctggccttatacatccctgtccatcctggggcaaacactgtgctactgtattgggatagcagtgccagaggccctactcactgaaggcctgctgcatgctgggtgctgggctgagctgtgtggggaaaagactatgagaccaccagtcacttaccacccaatggatcattgctcttatggaagtagagtcccaccaccctgagccttgatgttctttcctgaaaaatgggaataagaacaaggttaatggtaaaactaaaggtgctgtcagcaaagccccatgaggcagcagaccttgctggagatgagcccccacaacagcaaccctagtgggcacattgccactctgccctggccaacctcacacatcaccgccaggacaggaggacccactaacacgtgttcccaggctcctcctggggattccagggggtgagagaggagtgcacgggtgcagcctgcacattccacaggtgacccaggctcctggagagcagcagagctggtaagaggtgccacctgcagccctgcctacctggagaaagagaaagtgcttctcctgtgacctccacagcctccaccccaggagctgccagacaacagacggcaggccccactatagcaggactctgtgggaaccctccccaggcctctttctggaagcctcaggcccctcctccaacacacaccacatgtacgtacacacagcaatacacacatatggcacacacacacacatatacacagcaacatacacaccatatgcacatacacacagcaacacacacatatggcacacatacacacatatacacagcaacatacacacaccacctccacatacacacagcaacacttatacacatacagcacacacgtacacatatacacagcaacacacacacacaacagcacacacatacacagcaacatacatgtacaacacacacatacacagcaatgcatatgtacacatacaacacacacatgcacataaacacggcagcagacacataccacacagcatatgcatatacacacagcaacacatgcatacaacatgcatgtacatatacacagcaacacacatgtatatacacacagcaacatgcacatacaacaacacacacatacagcatacatatgcacgtatacgcagtaacacacatgcacatataacatccatgcatatgcacacagcaacacacgcatacagcacacacatacacagcaacacatacatatacaacacacagcatatccacatacagcaacacacacaccacatgcacatacacagcaacgcacatacacatacaacacacatgcgcatatagcgatacacatacatataaagacacacacgtactacaacagagacacacacgacacactacacacatacacgcactgcacatactcacacatgcacgtgcagcacacacatatacataccccacacacgctacatgtagacacataccacacacatatgcaaacacacctcacacacacgtacatacacacacacacacaccatggcttagtcttgtggggcagagaggcagcctcagtggtacctgtacttcatgtttgcctggcaaaccactgaagctcacaatgttccatagactttatagacctgggtgaagttgcctgaatcctgaatcctgagcagagcatgtcagctcatagctgggggtagggtggggtggtctgggctctgatggcattaggagaccccccctcagcctctggaggagcaagaccatgaatggtaggcacaccagggtgctgggggatggcctgtgtgaagaccaaggaatcctggactgaatgcagcttcctggggtcgctgggaagacccaggagctggtatttgccaagtgctgaaagcagagctgtggactgtgtgtgcatttgttaactaaagtacatagcaaggtggggacgtggtgggtcgatgggggtctgggatcaccctggcacttgggagctgcctccgagtgtcatttaggctgggtggagggaaaagccattcagagccttcgattctcctcttggcactgtcgttttttagtcctgtgactttgggcaaggccatgaatcattcttggcttccgtttcctcatctctttaatgggcatagtaacactagttgcatcagggggcttctggatgtgcaaggaaacatttagaaatacacacacacacacacacacacatacacacacaaccatttttattttgttggcaaaatactgaaatctggtctgccctgccatgtttttaaggcccttttctacacatttgggaaagcgaacactgtttccctgctgactccctggggatccagtggtctcttggtctgtgagcaagcagtgcttggccccccaccctccctagggtttgcaaccagtatgagccagttttcctgtgccccacattagtaaattcatagtttgatgatggactttggaggctccaaacatgagtgctacttgtcctcctcagcagtgacacttgttgagtgtgtcctatctgcacagtctccgggcgaagcgcctcctgtgtgtgggctttttacgtcttcaccgcagccatgtaggtagttactgttatccattttcagatgaacaaatggagactcagagaggcaaagaaacttacaaaagtcatgcagcaggtgagtgagctctgaccctcagggttcccagcctccggagcacctggtggtcccgtcacagccaccttagtcacagccacatgcccggctcacctgtgcagggccagggcctcagagaaaaggttgtccttccagcacttggtggctctggaagtgagagctggcccagaggcttggaccacgtgcctgcaaccaactcctctttgagtctgagttggggaaactgattgaatcagggtgagaagatttgctttttgtttttcctggtccccatggaaagtgccagtattgtgaaattatgaagatggagttgaacatgtaaaaattaaagttaaaatttcaggagaaaaatttcttcccattaagaatccattgtgttcaacccaagcatccattgacagatgagtggacaaaaaaaatgtggtctatccaatacaatagattgttattcagccttaaaaaggaaggagattctggcacaggctgtaacatggatgaaccttgaggacattatgcgaagtgaaataagccagtctcaaaaggacaaatactgtctgatctttcctgcatggaatagctagcatgggaaattcatagaggcaggaggtagaatggtgaatgtgcaggggctgggggagagtaatgggagttagtgtttcgtgggtgcagagtttcagttgtggagatggatggtggtgatgattacacaacaatgcaaaggggcttaatgccactcaactgtgcatgtaaaaaaatggtttaaatgggccgggcgtggtggctcacgcctgtaatcccagcactttgggaggccgaggcgggcggatcacaaggtcaggagattgagaccatcctggctaacacggtgaaacctcgtctctactaaaaatacaaaaaaattagccgggcgtggtgtcgggcacctgtggtcccagctactcgggaggctgaggcaggagaatggtgtgaacccaggaggcggagcttgcagtgagccgagatcgctccactgcactccagcctgggtgacagagcgagactccgtctcaaaaaaaaaaaaaaaaaaaaaaaaaaagatttaaatggtaaatttcagatgtctttactgcaagaaaaaaaaaaagaattcatagtatttatggtattgtaccagaatctgtttgcacagaaacagttagtagcattatttttctatatttttttgtttgtctgtttcttttttggttttttgaggtgaagtttcgctctttgcctgtaatcccagcactttgggaggccgaggcagatggaggtcaggagttcgagagcaacctggccaacatgatgaaaccccatctctcctaaaaatttgtctgcatttcttagcctagcagtcagctgacctgtacatacctatcacaaacccatccacatttctttaaaatattcagaaatccaaacttaaccctgcttcccactggcctgtggccttcagactgagggagagttgactaagaaatccccacttcttagcccttttcccagtataactactttgttaaaagccttcttttcctaaagcctataattatgtttgcctccagggtacccaggaattttttcttttaataaacaaagagcatcctacaattatcatgatgatttgtcgagggcaggccaagttcagacaggaggctgactcagctctggaaactgacacgcacgtgctggcgttttcgatcctgggggcacccgacagcgtttaggggtcaagaattaatattaagagctggagaactaacagatccacatagatgtccactttatactgccagcaaaacgggacagcagttgggtgggatttggccttcctgaggctggcggcaccgtctgtgggccgtgccatcacaaatggctctaggtcaacacctccagcctgcgtgcactgcagcatccggatgccgtaacctggtgctgctggagccacacgcagccagggccggcatgggcagaagccggcggagttggagcctgtcgctctgtcagccctgatttgcgggctgagcccagttttgtggccctggctgtaatctccccgagttcaaagagtgcttagctgcttgtctttgtcaagagcgcagttggggatcttttatgtgaaagatgtagaattctcgggcagactttgattatttattcatcccccttcgtgggtgtgtgatcgcgcgggcactgcggagccccttgtcctggctgctcttgctatgaaattcattgagctttaaagccctttgaaagtagctttttgagggagggggaaagtttttgaagtcttgtttctctctccccctctgcagtgccgcagcatctcttgccaccattccatgcgcccctaccgattgacatgcgacaccaggaaggaaggtaccattacgagcctcattctgtccacggtgtgcacgggtaagtcctgccctctgcctgctgctcctggcgtgcagtcacctgccatggggaggctgggccggcagcctcagccacatctcctgcctctgtctttcttttgggggttcctgatctacattgtcctgagcgggcgatcacctttgctatcatggcctgggaccctgtgtgagcatgtgcgtgggcagtgtataaacaccaaccacccccgagcccacatcaccacttataaggctctgggcttccttggtgtatctatacatggtttggagctctttcttcatccatgaagtgggaatcctctctaggtctaagatcccatataagtaaggtgatcttaggtatctgttgttccagcataataattcagagcaccctttttcacttcttcaagtgtccccctttgaatagtaaattgtatagtcaccatacttaaaaggacaagctcaaagtgatgctttggggcccttcctattcccagctttgaagtccccaggtagaaggtgtggggtcaccctgtggtctccacctgcctaaccctgtccctgtcatacccacctggggcctctaagcccattggctggtgtcatttcttggcctttagggctcaaaagtcttggtctctggctatcccatccatcctccttccaggaaagaaggcccctccttctccctacccccaaactctccactgctccccgcacctgcctccaggagagctcttgcaaaggtcagccagccccaagacccctctcgacccagcatcttcatgcccacaccctccagccccctcacctgttcatgccaaggtgctgtctgtggttctgtcccatgtctctgtgcctggggccagctgcctgcccagtgtgcctggaatctccccccaacaggccacctccaagcctcaaccgaggagtcacctcctcaggggcagtgtgatccttcacactgagcgggggctgctgccctcaatccacagcatcatcatccgtttttgcacctgcctcccagccagctctgagctctcctctcacctctgtgtctcaatgctgacatgaataggtgtacaaccagtgctcgctgagtggagagcctctccccgcctgccgccacctatgaaggcacatcctccttcctctaccatctcccatcccagtgaagtcagtcaacacttgctgggccctcactgtgctcacagcattgtgcctcagcagagtcctgtttccggacacccattgcctccccaagacggagcaaacctgggacttctactttctttttaaaaactgttttacttttaaatattttactctgaaataattaaggtcatacaaaaacagttccaaaaaccataaaggctttcttgtatatgcttcacgcagctcctcaaatgtggacatcttacataacccaagactgacagaatgctcttcactcacccacagagcttatccagatttgctcagttgcccactagtgtctttttttcccggttcaagacccaatcctggatcccacgtggcacttggttgccgagactccttcgtcatctcctgtctgggacggttccttagtctcttttgtctttcatgaccttggcagttttaaagagtactggccagttactatataagatgtctctgggtttgggtttgcctgattgatgctgtttcatgatgacattcggatcatgcgttttggggaataatactataaaagtgatgtttgtcctttgcaggcatcctgtcaggaggcctatgatcttcacgcttctcactgctggaaatgttgatcatttggttatgggcctgtctgctggcttctccgctttaaagttgtcccgttcgtaattaataagtattttgtggggtaatacttagaggatatggaaatatcctgtttcttatcatattttcatccgttaacttatacatccatcgatgcttcttgccagaaacagtcgttactagtgtttgccaaatggcgattttctgtttctatcattttgtccacatttagtggttggaattctcctgtaaggaaaagctgtcccgcctcccacatttctttgtatatttggttgtctgttgttatgcacatggatgcatggttttttgtgtgattctatgggttatactctattactaccaatatttattgtgttcttccagttgtcccagatttggccgttggggtcccttccagttgtcctctgtgtcccgttgacatgttgggaactttttgttttatttcggtgtgcatacctggttctcacttgactaggatccgctgccgcagccttatgtctgcctggtgggtgttggagtcatttccaccctctgctcacctccagggcccctccacctgcaggtggctgagaccacagctggagaaacctctggaaggtgcatgtgtttggaactagttgggccacccaaaaattgcccagtcagtggcgtctgagactcctaggagcatccagggagctcagtccctatttgggagggggttgctgttgctgatttcttgctcatgagtcatgtttggctggttccatgacacggatcctgggcatagcaggcctgcctcaaagtgctccctgcacgggatgttggtcaggagacctgggcaatgctgagagctttgtgcagagacagtccatgctggagtgcttctgcctgcaggtgaatgtcctggttcacctctccctatacacctgaagtgtgtagaggcaccaccagaagtgtaggaagaccccaacagcgatgactgccttcctcatcataactgaccttgtgaaccggccctgctgtaaatgcttttatgtgttcatgccgtttaatcttctcaacaacccaaaaaagagtcattttgtgtttttccattttacaaatgaaggaactgaagcagcacagagtgggtagatgactaaccctatggctcacccactttgcaagttagaaatcaagttccagccccctgagctcaggccctccgctgcatgctggcctttcttgtgggagcgtaagtatggaccatgggtccctctgacgagtccagccgagcccttcttgacagcacctcggcccttcgttagggcactgccccgagtccagtcgctcccagaacccctggccaagcagcagcagtgtcccctgggagtctgttgtgggtactgcagatcctcaggccacagcccagccccattgagtcagagactccacggaaggggtctgtgtctatgtgtgccacgccttgcaggtaatgcagttgcaggctccagcttgacagccctggctacaggcagagcccccactgagaagggaggccctcagtgccgtccttccctgtgtaggtgggagccctgggctgggaaggggcctgggtcttcaccaggctttgccatgctccagctctgggtagggcctgcttccttcccttgccagtgagggtggggtgtgcgcagagcacttggagaagggggccgtggatgctggcatgcagcagggaggagtggcccagccagaggcccacagaaatggccttgtccctcatggcctacacagctccttcactggttggattcctgaagagattcctaatgctgctgtaactaattaccacaaacttcatggcttaaaacaatgtagacttatcctcatatcattccggaggtcagaagtctgaaataagtcttatggtacttaaaatcaaggagttggcagggctggttccttctggaggctccaggagagactctttgacatttctaggttctggaggttgcctgcattccttggcttacagccccgtcctcacacacatcaccttttcccccttgctctgtcctcaccttgccctcttcctagtctgtgggagttttctcccctgcttctctcttctaaggacacctgctattgcctttcgggcctactgggataatccacttgtggctcccatttcaagatctttaaagtagtcatgtctcttaagtcccgtttgctgtagaaggaaacacttaacaaatgccagggattagggtgtggatgttcttgggggctgttattcaggttatttgggatcactgagccccagtgtggagtctggcatcagcctgtagaatacagtaaatcatatttataatttgcatgggtctgcagcaggccaggcacggccctgggccctggtatattgtactggtgaatcttcctgactgctctgtgagatgggggttaagcttcatcttgcagatgcagacattgaggctcagagaggcacagtgacttctgtgtgacatccctgcaaggtagttacttccgtgagggcaaggagaccaggctctggggtgcagatctcctccccagccaaggaggggctagtctggttaagccccagtgatgggcagcagcatggtgctcccagagccccccgtccctacgcggtcctgctggggtgggcttccagcggctccacactatcctcaagacagttggttcccgccagactgagtgggggacacagcaagagcctcggggctggccctgggctctggaaagcccatgccctcacctcttccgcccccagtgtcccaggtgagaaccagggcaaagcttgtgaggaaaatggccccgtggctctggcttccatgatgaatgtggttggagcccggtggagaatcccgatccatcaagcccatgttgtagctcgcttctccctgccagcaccaaatgtgtctaattacacagatgtttgcacagcaaatgaggtacggtgtcatctcatttctgtgtcagctgagcctgagcctgagcctgctgccctgagctggtgaccatttcgtgggtgtgcccgcccctcagcccttgcacctcctgctttccactgctcaagcacccagaccccctccccgttccctctcaggatcctgatagctccagggagggcgcacccagtgtgtgcaggctccagagaggtgttccctgcactctctcattctgccctgccctctgcccctccggagtaccttggtcatcacccaagagcctgccattgtcagttctcagcctgccaggctacccgcactgggacccattgccgaaccctccctagctgtgattaacatgaattaactcacctcagctttctcatctatagaagggccagatctgctgagacaacccacataacccagccaactgagttattttgagaaggagacagggtaatgtgagtaaagcgtctagaacactttggaaacattcaatggatatgagcaacaatcgtgatcattgttgttatcctcacttgctgatttgagaagggggccacggcaggctgggagactgggtggcagaggccggccacagcatgtccttgggagagttgactgtctggggactgtggcacagaaggtgggggatggggctgaaggagtgctgtggtgcggtgtggtgggggtctttctttcccccagttgaggaatttggacttcctccttttggcaaccaggagcagcggggagtggtcagatttattttcaggcagctacagcagtagttagggagtagacaggagaagggcgggaactgtggtgagaggacctgccagagctgccacagtggccctggggagaggggagcaggaccagggctgaccacccggctgtaaacaggcagctgcacgtggggaaggcagggcatggaggttggtgtgaggacagccttgcagcccagcccagctcgatggcctcctcatagacacccaagcccactcctctgcagagcacccttcccggtcacttaaggttcaaatgcacagcaggcttgcatggcttactgatgctcacgtggttccaggggaggaaagtcaccacccacccgtggactcctgctgcagtgtctttgggctgtgcaaaccacaagtgatggggagacaaatggggcaggggtgtgtgattgctggtcaagcaaggttctcttgaagcccccatggggacatccctaagtctccaagagtctgtacaagggcgagaagagaaggccggctgtgaatagggccacacacccccagcagtctctccaaccttgtgacgctaacaggaaagagaagctctttggatgccctctgggccccctgcctcccagaaataggcttgccagggtgtcatggggagcaaggctgaggtgtggcgaggaagggtccctaagttggtgctccccatttcctcagtgtatgtggtcacacaagcatgagtccggcctgccctgggccagcgttaacttgtgtcctggagaggaatgtagaagtccatgctcctggttcggggggctggggtggaccttcagctccctatgttgcttttgaggacctttccagccctgccctgccctgccctgccctgccctgccctgccctgccctggggcttcagagaagaccaatttcagctgcttcctgcccagaagggcgtacagaaactgccccatgcagaggttcccaaacctggctgcagatctgaacacacagggtgggtcttaaagatgcccattctcaggccctggccccaggagttcttgttgattttcagactagggtgaagcccggaaatctgcttatttacaggcgcccataggccagagtttggggaccactgcaggcgccgctgcttgcttgacgtccgggaaagcagccccagagctgcttgttggctttctggactcatcactgacagcgcctcgccgccaaaacacgggttgttaaaaatcccctggttcctcgtgataacccattcacagacaagtccctcctaaacctattcatatgacctaaacctattcatattctcagcttgcaaaaggcagtgagtgtatggggtgggaacagctgcagtatctcagccttcctttctcctcctgcctggcaccatctgacctctgacatccacgactccacccccgacctgaccactgctgatggcttcctgcagatctcttgatcctgagctgtagttggtttgcattgcattggcagtcacggcccaaggccacccttcctggaggagtgacgagggggctcttgctggcacagatggctcagggttgtagctatcaacccaggcccaggtatgttagggcaatagagtgaacgccagctggtgggcatgggggcctcacctccctttcatctgcatgcttggtcacgcaaaatgcatattacccagggcctccggagacagcattaagagtgtctgaagccccacttggtccccgagactgcatgttaatggggatgtttagccgggtgtcggtgtgccttcacttaagagagtagtttctttgctgccactgggccgaactcatgaactttccagtctggggggatttgaagattgctttttccaaggtcagtgtcccataaagactgcaccgttcgccatgagattaatgaacacagcagcctgctcagcctgtgactcaccagtgtcatcccgggcctttatgactctgtcctcagtcattcactgagacgggtgggttgagcagaaagatattttcttcttgattcttggcacagcacccgaggttcacgattcatagaggattggctttgtttgttttttgggaagaaccttctcctccctctgcaaacatgctcgtttcttttcagagcctagaggaaggaggagacttccgaaaggcatgtccacctgccccctgggatgagatgctgggtgggcccagcgtcacccaccaggcaacttgtccctcctttccacgtgggtccacactgcctctccatctccagggagctcttccttaaaaccggctgttgctgaccacttcttcagagcaactggacagcaggtagacagggagcccagaaaccctgggtccaggcgatgtgtcgggcagcacatccttccacggctgtctgagggtagaccgactagatgtggagccttggctcactgtgatgtaaacggccctgagaccccatcaggcaggcccctccccatctctgggctgtgggatacttgggtcagaccagcagaggagcagtagcaggagtctgtgcccagccgccggcttatgtcatgtcaccctccctgcaaggtgggattatcactccccaataatcactcccacttgataattggggaaaccgaggcatggggaggctgactgcctttccagtgacacactcctagtaagcagcatagattacttactgggcattttgaccccccaccccttgctaaaatcttccccagctctgagagcttcagattccaaagccaagaatgcactcgctgggctgcgtgggacagacagctcatttataatggaatctggcctgtaaaagtttaacgaggagcgtgtctgataagacgggctggtctttgatctttactgaacgccaaagccctcgcacaagaggagctgctggctctgggttttggagagagccgtggtggtcagccgagagcaggaggggccagggagtggagcaaatcttgatgtgcaggccgaggtgggcgtgcagtgggggaggggctgcggcaggatcgggatgaactattcggttcctctcctgtccctcggggtccccactgtcggacatttcccctccacacccccagtatgtagacagaacagggttgaggccggggctcacatcttgcctatgctgcttatactcttcacatccttgggcttgcttagccccacaagcctcagtggccccatctctaaaatggggacatagtggctccccatgtgaaactgttgtgaggactagatgggtgtctgtaaagcatgtagaagcacacctgggacataccgagtggcggagagacccctgctctcatcactgccctgctaacattagaaggaaagccaagtttcactgcagacaccctgcagggtgctgggccagtggtgtcctattcagtcctcccaacaccctgtaaggtgggggattttctcctcaattcatagaggcgagaactgggcgttcccagaatttaagaacttcccaagattgcccagcttgtgagatctcaccaagccagagctcttccctatgccgtgattgtcctcagagaggaaagagagtctcgccatggttctcagggctgcagtgtgttgtttctgtctgcagacatggaaacagaacagtaatcaacccaaaggaattaatcactaacagtaaagtttcaggcattggtggggtggattggcctttgaggtggggagtcctcttagactgcacatgttcagactgtccactcggtggaagctgacgccactgccagatgcattcatttattcagccaaactcattgttgctggatttattgtatcccaagtgctgtcacttgaggccactcctgccagcccgagtcaaggtgttgctgagggaaaatgtgagcagtgccctgcccctgaggcactgcttaaaaaggtcagaaattgctgctgccctcaagcctctgtcactgcagccagcactgatggtatgtctggtgcccgtcaaaaagtacgctggacatgtcaggagccccatccctccatcccctccttccaaggactgcacctctgaaatgtacacttggcctgtgctgcccaaacaaagtagcaagagttcagagttgcttaactcagtggggaatgttcttaatgctcgttcctctgaggacactcacccagggaccatgtgtgccagcctcatgccaggcactggggatacgggcccaaggaggcacagtcttttttaatagaatttttatttgtataaatttatggggtgcaagtccaattttgtgacatgcatagattttgtagcggtgaagtcaggacttttagagtatctatcacctgaatagtgtgcattgcacccactaatttctcaaactacatgccccttctacctccaggaggcacagtcttgctgcccacatagaccccatgatctggttggggagagggcagaaattggccaatgacagggtggtatgctggaagagggggtatgggaagcccagagcaccaggaatacaggaacagaaagcgcttatcagcggggacgcatgaaggcctccccccacgtcccagcctttccccaaccccacccactgggggccctaccaccttcttcaggttgccctgttccaatgaggggcctccacttccaggcagacaccagtgccactaaggaggggaatcttttcaaagcacatactcatgaaggcttggtaaaaatcagcagcacacccacctcgaagaagagatatatgtgagctgctcaggattctccagctagttttgacaggcatccaggaaaggaaattccacacaccactttggcaggctgggccagagtttaagaatctcactgtggaggagtttctatccagcccgccggccacccaggccctttctcatcactaaaacccaggcctccagtgaaatataatgaaatctctcccactaacgaaggccgctccccacaaaccccactcccaagactgcacatcttatctcctatttccttattcccgcccatggctttaaacccttgactttctggaagatttggttcagcagtgctcagcccatggcagcttctattacagacaaagtccccctgtactcagaggtcagtggtgcagttcacctggagagggcctaagcaggaccgactcccccagggcctcctccccggacccagacacattcctggttccactgcacagaaggagcaaacccaaggcttccaacaggccccacacctcactcctcccctccctaccctgctccaccaatgtcttcactttgctaggaaaaacgtctccctgataatccccttatcttttatgctttttgggttttctgtttgcaaaaactgataaccttcttattctgctcccaggggaaaactgataaagggtgagtgcatgaatcaacggttgtggaccatgtggctagattgcaaccaagtccatctgtattgcctcctttgtaggcacaattttataacttaatttccctaccaaaacatcagtgtttacttagtaagaaatctgctctttgtcaactgaaaacagtgatttctttattacagctctgcatagggagtgacagctgaaagctggccaggtctggtgtggtgtccgggtctgtgatgggaacggggtgagtgcaggtcgcatatatgggatgcgtgtttgctgcagacagggctagggctggcctggagggagcctggacaacagatagatgttgtggccaagagggcccatggagtgatcatgtagacgactgagcctcagatgctttccagcagtcacacacattcaccaccaccaccagccctgagttccccaccagcgccagccctgtagccatcctgctcctggaatccctatccactcagccaacttaaaccagagactacttctacccagccatccttttaaaaaaacaaattggtcttattgattattgaaaacatgcaaaagaacaacaaaagtggccaggtgtggtggcttacgcctataatcccagcactttgggaggccgaggcagggggatcacctgaggtcggaagttcgagaccagcctggccaacatggcgaaaccccgtctctactaaaaatacaaaaattagccaggcgtggtggtgggcacctgtaatcccagctactggggaggctgaggcagaagaatcacttgaacctaggaggtggaagttgcagtgagctgagatggcgccattgcactccagcctgggcaagagcgaaactccatctcagaaaaaaaaaaagaacaacaaaagcatgtttaagatatctgagtaattatgacatatacacccttatcccctgctcactctaaggactgaggacatgccagcacctttgaggtcccgtgtgctccccaatctcctgcctcaggtcctccccatcccaccattctttgggattcagagtttatcacccctcacatcttatgacggttttaccttgtgtctgactcccctaacaatgtattaattcgttttgctttgtcatgctttatatacatggaatcattgcggaggtattctttgggaacttgctttcacactctacgttcttccgaagattttcctgctaatgtgtagggctcttcattcatttgggctgctctgaagcagtctatgttgactggcatttgggatgtgtctgtttttgctaatttgaacatgactgcagaaacacttttataccatcctctgggccccaagtgcggggttatttaaagtaaatgcatgtctgggaatggaaatgctgagtcacaggggattcatgttctcaccctcctagacattgccagacttcgcccgctggttttgctaacactcactcccaccagcagagtttgagagctggccttgccctgtatccttgtgatatccttgcctcatcactttggaggtgatggcctctacattttaatttttgccaaaatggctcttttctgtgattctaattttctgtttcccttattactaatgaaccttgagtgttctttcacatgcttatgggccactaatgtttccttcttgggaaatgtctgttgggctattttgcccatttttctatgaggtcgtctttttcccattatttgaataagtattttgcacactaaggttactcattatgtggttagcaacatgtgttgtgaatatcctctcccagttcgtgcctggtctcttcactgccttgatggcaggtttgggtgaagagaagttcccattgtaaaatagctcaggtaggttaccgacatttctactatgtttttccctgcatgttctcctcccacccagatgtctggtcagaccttcagcctctggactatagtggttgttccccaatacaacatgtccttattcagctattctcccatctcagaacaccaggcctatactactcaccacctccattccattctcttataagagtctgggcacagttcagatgccacctcctgcaggaagccctctcagattgcaccaacagagtgggtgaattattttcctcccacccctcttcctgctccagcaccttgtatactgttagaaggctatagtcagtgtccattctctctctgtgaccccagaggtcctggcatggtgattcggccaaagcaccagtgtgaactatgggattgagggcctgtgatttcctgagctcgtaactggtcttgggaatgcctgccaagcagcagcaccctgtcttaccatcaccatggcttcatgggcactcagggggtctgctgagatctgtgcacttgtggattcagagtagaccttgggaatgtggggcacagcacttgtcagtcaggtttgcagccacctgccccctcactacctgggtgcatgcggggccctggccgggtctgtctcagaaccccagctccccacacctgctccctcactacctgggtgcatgtggggccctggccaagtcggcctcagacccccagctccccaccatcagtgccatcagaggcccatgctcagtaaacatcagctgatccgggggagtgacgtgtggacgcagacacagatcagcaatgaatgtctgcaaactgcggcctcagctcccgtacacagagcctccccatgaggacagactgccaccagacacacaggagagtgcagattgataaaagacatggactgcgcttcagtttgaggaagggacagttctccattgttttccaaaagaatttgctgtacggctcttaaaaaatgcaaatccccttagtacattttggaaaggacttgatttctagaactttttaaaacaaatgtatgggaaacatggtaagcaagcttgccagtgtacagtttcacctacaaaaccaaacaacaaaactcaaaccaacaaacgaaaaccctggggaggagattgaattccatccagaggagcgttctggagctctgtttctatttgtcggtagagccgagggtggcaggagctggccttgctctccagggaggccctgggagagcagacacatgcacgccctgtcctggcagtaagaagttccagtttggggaggaagagatgcagggcaagctttggggactccagcttcctttccagcaggtcagtgggcccagaggacgcctgcccagcatttctgaggaagtgggcacctggtcctgagcagctccgcaacaggaaaaaggtcccagtgtctccactctggagctccgtggacccacccatggccctgtgatcctggtgggtggtaggcatcttggcccaaaggcagggctggtgtacacaagccagcggttccgaggcaggaggaaatggcatgctggggctgtgtgctgggtggattctggctatggggagtcagtgaccatgaaatccaggcggcgggggggaaagcccgctccacagccctgtgcacatggggatgggaacgcaggactcagacaccttcctccacccagcacaggagttcccctaccctgccagcctgcctcaaagggagcatctactggaacctggttattccgagcaataaataggagccctgctaagagtttagtctcagaagaacgatggcactagtgacggtgatgtctgccacctccctagggccaactctaggccaatgcaacatgctttccatgacgagttcatttcctggggctgctgtaacacggtaccacgaactcagtggcttcaaacaatagaaatatgttctctcggtttcagaggtcagaagtccaaaatcagtatcactggaacaagatcgaggtgtcaccagggctgtgcaccctcagagacccccaggggagactctgtccttgcctttcccagcttctggtgctgccaactttccttggctcctggccatttccctgtagtctctgtctccctgtcgcatggccatctcatcttctgtgtctcagatcttactctgctgtctaaagaccccatgatggcatgtagggcccactcaggtaacccataatctcctcatctccaaatccttgtcttaatcacatctgtcaaatcccttttcccagtaagttcttgttcacaggttccggggatagaacatggacatatctctgggagatctcatgagccccccacgtgccttccctctgctcctcacaacagatttgtaagatcactgtcgtaactgttcagagacggcacatacgtgctcccaggcaggagtgagctgaggtgagccgggacccatgtcttctgcagtagtgtctgtgctcttccctggacacgctccctgctttattcattcattcattcactcattcgttcacgccctcactcattcattcattcattcgttcacgccctcattcattcattcattcattcactcattcgttcacaccctcactcactcattcattcattcgttcacaccctcactcactcattcattcattcgttcacgccctcactcactcattcattcattcattcattcagcacacacgtatttgagcatgctgtatgtccctggcatgtgcggagccaggtgcagggccagcgtatgaacagaaacggatacaggagacaggaggcctgtgagctcacagctgaggatatctggtcatcagctgagatggacgtgctcaggtcagaggaaggagccacctaacacagaagcaccgtaggaggatcctgaccttgacctggggctagggggcaccttgggtgagaggtccctgagctggcacctctgggaggagaacaggagttaactgggggaagggatgaagaggggaagggcatgactggaggtgcagacatcaaagggcaaagctgtgagaggcaagcatggccaaggaccagagagtggcatacaggacacagaggggagaggcaggccctggccacatgggattgtggcccctcgcctgctgccactgaggtcataagtcaccctgagaagcaggcaggtggtgagatttgtaggctcatatccccaagtgactgggcctccttttctcttcatcagcaacagctgttggaccagtctgggggcatccgggtgcctgtgttcccacccgctgctgccgctggcctcactgtggccatgcccctggtgctttgggactcagcagtgctgtctgttaaatgggacatgaaggagctgttcctgcctgtgtctggccccagcgaccagcacagatctcggagcaaagccatctctggcatgccaagggtgggcttctcctctgactccaacccccgagtgggacagcccgccctgatggctggtgctgagtctgggtgagtcagcagccctcagctccacattgttcagcttctccaagcaggcaccgaggctggggtgtgggggccccaatccctgcacttccttccctttctctcacaccttaaggaacatgccggttcttgcccccacaccttggctcaggcggtgctcaggccagatgccctcctttctcctccccagccctcaaagtcttacttgtttctcaggcagaagctacacaccgtccaggtacacatcccccatcattctcactcccagggacagcacccactccgagggtctggcatgctcgcttaggcccagccagctgcatgctgagttacacatggctgtgcagagtgctcattaccttgaccttttatctcccaccaaaaatctcatgtcagcagatggggaagggtcctgggatttgatgccgaaaggtgtggcctgggtctgctgcactctctgagctgctttcgtttgctcatctgctagatgagcggggtgagcactaattgagcacctactaagtgcctggtgctacactgcatgctttccatgcttggctcatcctacctcacagctgccccacctgcgggcaagggatcctgaggctcagggcacatagcactgaggctgcaacagcaccaaagccatgattcagacctagatctgtgacttcagagtccagattctgcttatcagtgggggtggccccctcagcctgcactgccccagagtcaccttggggaccagctgaaattaggcctgccaggggaccaccaagccaaccttctcgagaactgagacagcgagggtggagccagcacgagcctgcatctgggtggaccattagacatgtcagtgcccaatccaacttcacaggggcagagaggctggccttctactcccactcggccacctccagctctgcaaccgtgggcaagtcacatgacttccttgagtctcagtttcctggtctgtaaaatggagctaatgaaatctgccttgcaggcttgctggatgtattgcacgtagtaggcgttctgcaaatgctgacgactttgtcagcagcagcagcatccctgtggcagcagccacagagttaacacagcagccatgcagtgacacctcagtttactttatccattctcccttttcccctcttccttacttccattctttcttacttcccctaaccaccatgctgacccttgggcctggtcctgaaatcccatccaagggctttgccagggatctcccactagggagggagggaaagagggaagaggaaggatcctgctaaggagaggcctttcctggcactgcctgcagcctcctggggcaaggacccaatcacagtcagcaggccagaaccaacatcgggaagaagcataggcatcctccactgcagcggagtcagccgtgaggccgggctcctgctccttgttgctgctgccgctggtcgctaacacgtgcacagcacacacacacacaaacacacacacacgaggaaaaggggctttggttggttgtcctacttgcccagagtcccctgcttgtgcctcatgcccagacacagaaggacatgcccagctgcaccctccagcctcggccactgtgggcaggatgtccagggaccctctcctgttctgcaggtgggtggatggacaggcccgagcacttatggctggggtctgccttgcagggtgccaggcccaggatcattctgggcaatgggaagctgtgtgggtcaacaaatgtcttagctcacataactgagaaggccaaggatactagctttagacagagggactcaagtcaagaaactggctcatcctctctcagctctgatgttctctgtatcatcttccttcttgggctctcccctgcatggcctccagcagccccacgcttgcaccctacgagctcagcaacccttgcggacagagagaaccaaagactctagccaaagctgctgtcttgggcacatgcctatctttgaaccgatcacagtactagcaatatggaatacattgatcacctgggctcaggtcatgtgtcccctgcccagagcagcagaaaggaagtgggttcaatatagacccagcccaaagcactctgtgggctgtgccctgcccctcaggcataaccttctcacacacacacacacacacacacacacacacacacacacacacacacagctttgtgctccagcctttctttgcacacactgcttcctttgttggtaatgcactgcctcgtgaactcctattcatccctcaagacccagccctaatgtcaccttctctgagaagccttcctgcacacttccaggcagagttagagaatcactcctctgctggagcccttatcatactgcctggtaattacctgatttcatgggtctgcctctttccccctgggctctgagctgcctacaggtccctaggcacagccctgttgggagcgtgaagaaatgtaagaaggaacaactggtcagatcaggctcagacgagctctgagctggactgaggggagaaggcaatgcataggggcagtgtcctgagctgagcggcctgcagaagggctggctgtgccactggttgattgtgccatgggagtgtgtgagggtgtgcacatgtgtatctgtgatgtaggagactgtgaccatcttttaaattgagctcatgcagccagctcctcctcccatcctgaagggcgtctctttgagtctctgcctagctgtcggaattcaaggactggatggccgtggctcacaccaaggccgggcccctgcagtacagcagtgtggaaatggaagaagaaagggaggttgctgctggggtcagcctgaagtggtggttcagacttcaccagtagtcgcctttcctggtgaagtctccatggctcaatcgtctgctcactggcgctggcaacactgaggtatcatgagaccctcagctggggcctgggatgggggcaagtgtccaagaaagaggggcactggaccctgaaggacctgctgtgtggtttggcaatgctggcgtgtttcagggctgctgggaagcgccctcaggccccacatgcctgtgtgatgctggcagttctgccagctctggcccattcctctggctgtgtttagtctgtcaaaatgaccatctctgggaacatgtgtgcccctggatccttagcggtcatcacaacatagtggggttggggggttccagctccctacccagagtagggtgggattgtatgtgatgacctggtaggggtggggtggggaccagagacagagaagaagctgaaacggtggggagaaagctctcctgccctcaggtactgccccctcccttatcctgtccacaccctgagccctgcttaccaccaaccagtgtcatcaagaacgcccacttccctgccagggcacaggcaggggctccagcccagccccacctgggttggttgtggttctaccacctgctatctgggcacccttggccaagggacctagcctatctggggatgttcccatccacaagatgggcataaagtgcctgtgttgtgaatgttttatttgaattcacaaagaaaatatgtgcatgtgccccaccgatggctggcacacagtcagccctaccctggggagataccaggtaagagcacggctgtgatctcactggccctgtgcaaaagagacatctcggaaggcttcctggaggaagtgtctagacagtcattgatggctacgatggccagtgggcctgtctctggtattgtgtgccctgggtttccaggccagcagacactctatattccaaattggcttgttgctgaggagagaaggaaagggagttaatgcatataaaccccctaccaggtgcccggccctggtcatttcacaccaccctggtgaggcaccagagaggagcagcattctggctgaggctacacagccaagcgggaaggattaggaagccagtgcccttgaagggacaggcagtgccaggtgcagcatcctgccccaccttgctgcatcccgagagcatttgtatctgcctccgggggatggctctgtggctcacatccccctcttcaggcccggcactgcagccttccctggcacaggggaagagcaagggttgctccgtacccttgagttggacctgttgtggaggctggcctgtctctccactgcccctgatagaatctgttctggggtaggatagtggcatcttccagctttctgtctggtcacaccaagggaacagtcagtcctggacagcagtgctgtgatggggcgggtagtgcctcgatgagggagtcccagcctgggagtgaggcccgctggagggagctcctgcttgcctctcactggccgcacagcatggagaatgactcccctgtctggatgcagtgtgctcgtggtcaagtgcagtggttggttccatttttccataccctcctgaggggcacacagccggtgcttacttcatgggggctgccatgaggatatagtccaggcatccctgcagagacccctggatgtccctacagagcccagggcctgagagaggaaaaggctgccctgggctacccctgggctcctgactcccttggtgatgcttgcggtgggaagggggaggtggagtctaccttccccaaatggtggcaactgcaccgtggaggcggaagtcccagctcctccatgtgtgacccaggccccacctgccatctccaggcccagctgcctccatggcagccccagacagtggtgtgcatgtggctgtgacaacacctcactccgggcctctcaggggaggctcacctggccagtgggacctgggtcaccttggacagactgggcctgctgtgtggcctcaccatgtagcttgaaatccccacgtgatcaatggctatcgcagggggcctcagctgtggttggcacaccccacagggcaaccctggtgccagggaggctggcattcccgggacctgaacaagccacgtagggccaccggcatctgattacaggctactgtgacctcaaaccctggccggcatcctgcaggctctgggaacctgccgtgcctggagtgtctggggaggaccgagaagtcaggacagaaggcaccttagctattctctcagcctgtagacaccctgcattttgctgagccacactcagccttccagaacttgtatccttcagcccaggtctgcccccaggagccatagaggcgtgatgttgtctcagagccttctcttcacaacccacccatcccgtggcaggatgtgagtgtcatcctgctgcagtcacaggctggagcccacaggacctgcccttgtccaggggtgcattagtctggtcccacttctcctctcccgggcacacatagcagcccccgcctaggctaaagctatctgttaagccctccgcatttcatgcagttcccatgcagaggcacccacctctacaggcaggctgtgagtgagaacgtcttgaggttgtgacttgtgacttattccacagtctccctcccattgagctcagtggctggcacacagacatgtggctgtcactgattctgaaggtacctctgagcacctgcatgacgccagttccatgccaagtgctgagcatgcagaagagcctcggacatgccctgctcccaggcagagcctgggaacctggcagatgcacctgtcagcttgagcctggaacagtgcacccttggggagcagagagaagggatcctgagccaagagaaggggcttcagggagggtgccacctgctgggctgacagggatgagaaggagtttgccaccacagtatagggtgcaggaaggcattggaggccaaggattggtgtaggcaaaaaggcagaagcaggttcgtgggatctacatgagcagggcagtcacgtctgctgaagctagacaaccaaactgcggaagactccctccaggcctggcacagcggcctcccaggggggtgtttgtgaaacccagatgtgaggatatctggatgtcacctgtttgggtcctggtttgtactgtactgtaagcccagttttcatgcactattgagcatgatcagtaattatctctggtttgctcagccaacagacaaatcatttcctccctgaaataaccagttccagcagtggcctttcacacgtccagcatcaatccagtgtgaagattgggagggcctcccgggcaatgctaggttagccctcaaagtgtggttctaaccctctaacagcagttctcctttcatgactgcctgccatgtctctggcacagttttggggactttcatcctcacgacaaccctatgaaacagacactattatgatccccattccacagatgaggaaactgaggctcggagaggttacagtgtgatgtggctgggattctaacccaggtttgtctgattctaacacactctcttttctttgcacaatgtcaaattatagactaaagaataaaaatgaaatcttggtaaatgtggttcctggtgacttagctgtggttttgcagctgcttcaccataaagtctgattcatctttaatgagtgagttttggagtagattacctcaaaatacacctgcagctgcatagaggccccaggtcagcaggcctgacataagggcctgaggtcacatcgaatggattccatgactcttggtgggcggacttggggacatgggggtgggccctggccatgccagcccaagccagcggcaccaagcccaatgcacacctgactattggggcatcggagaagggtggttctgttagcgctaggaggaattccatggaaggagaacgaggagatattccaagattttagttagggctcatcaatttcaaaacttgccttgaatcctgaccctgcggccgagctggtcacaccagcaaccaaccatccaactgaagccagaaactctccacttgcaggacatctcctgatccctctctttttcacatatcctgttagcagtatgagctctttgcgttttacccgtggtattcgtattttcatattcgttttcatacatgtttctagcatgcaagcctgtgcctagccccgaggaggcactggggaagccacagtgcaactgtgacgtgtgggcggcctgctgtgcgtgtgctccagcaagtccagtcgcgggtgcgaggtccattctccagcgtggaactggtcggcgggtgcacgcaccagcgtggagctttcactctgcattcactgactaatgcttgagagttcagactgtaattcacggatgaccaggggaatgtcggtgtagcaaataataagtgcaggttgttctggaaagtctttccaggagagacaaggactgtccatgttggttttggggtcttggtggggttccctctgtgtcctccttcttagacggctgcccattgtctctgcaggccccctgccctcagcggcagccctgtcatctctgacatctccttgatccggctttccccgcacccggctggccctggggagtcccccttcaacgccccccacccgtacgtgaacccccacatggagcactacctccgttctgtgcacagcagccccacgctctccatgatctctgcagccaggggcctcagccccgctgatggtgagtagggtgtggggatggggaggggcagctagggcactggggcagggcgcagccagcctctctcacactaacactgtcaactcctcagccttggtccccttgaatggtgaccaggctggctggcgttccttcacactacttccaaacaacaagtttttgggttttatgctcattaaagagcctttggtaagcactcttttgcatgcaaaccatatatgatctattgtaataataacagtaagggtctatccaggtaggtcctgtgtagctgagaaccactggttgtaaccaaccaaagcctgcagaagctggtgttaggaaaggggatgttgtgttggagtgtctcatgcagaaggaaggcggagtgggctggctgctgcctgcgtctctgttggatctgccccttgcaggttaacgcaggaggcctccaagtggcagcccaggccctggggctccggggatgaagctgtggcattgtgttcagatgcctgagagagaacattgattggcctggctcagagatcagatggccaccccggtgtgactaatttcagccagaaaagggcagggtcacatggtacaaatatgtctttatatgtataaagcagatctaaagttttacacttctagtccccacccaccccaccaacagacacatgcaaacacatattagtaacccggacatttaggggccagtcccaccatgccgtctccctgggaagtgcacccccatccatagcatggcatggccccgtgccgcctctgagagcgctgttagccactcattgtccccatccttgaaagcagccaagtgcaacttctcagaattcacgaagctaagacttgacctctcaggctagaggacatctgcaacttgaacttcagagccccatgggcagaggctctaggaaatggggtcccagcgagtctcttatcactaccagcattctccccgagaggaatgcatcctcttccaactggtgggtgtgaccacgagttgaagcggaggcctggctctgagaatgtgcaggctgggattgcacgatgaaaaggaggcatccagttttcaaatgtgcagaagggctccctgaatcgttgactcatcttcctggcacggaggtttgcactttgcctggtcctcacaaaagagaaaccaaacaaggcaaatagttgtagccagggggcttgaaaatggctagctggaatgtgacaccattctgaaatggcccctcaagtcagaactcagccctgaactctgcgtgcgtcccctgtgtggccttgaccaagctggggtgccctgaggcctgtgctgcctctatgcccagctgctgtcttgttggacagtgggcccagccctatccacatcactcctgaggtcccagtgctgggattataggtgtgagccaccatgcccagcccatgatgggctgaccaagagtgagaggacacaggtcaggttccagagtctgcctggctcacactaacactgtcaactccccagccttggttccctcggacagtgaccaggctggcgttccttcctactactcctgaacaacgggttgatggtcacacctagtatggcagctgaggggtgccccccaaaacacaggtccatatcctaatccccaaacctgtgggtattccctcatttggaaaagcagtctttgcagatgtcattaagttaggtctcttaagctgaagagatcatcccagattatccacacaggccctaaatccaataacaggtgtccttacaagagacacactgagaaggcagacacattcatgcccgcccagagacacacacagagtcacagaggagaaggcgatgtgaagtcagaggcacagatgggagtaatatggccacaagcaggaagctggcagccaacagaaactggaagaggcgggaaaccatcttccccttgagcctctggagggagtgcggccctgccagcaccttaatttcagatttctggcctccagaactgtgagagaataaagttctgttgttttaacaacagttaacacaaagtttatgctgatctgttacagcatttgccctgggaaactaatacacatggtaacagggcttccagtgaagaggtggaaggaacctggctgctctcccagggccagggccagagggccagtaaagacgtctacgggaggaaggaacagagcaccctcctggagatgctcaggaagcagagacgctgtattccactgattgcagtgtagcccatgaagagctgggtgggctgggcacagtggctcatgcctgtaattggattttcggaggccaggtgggaggatcgcttgagcccaggacttcaagcctgcagtgagctaggatcgcaccactgcacttcagcctgggcaacagagtgagatcctgtctctaaaaaaaaattttaaaaaggagctgggggtggtgagacagagctgcccctggaggagaggccttcgacggatggagtgccatgctatgcatgagttcaagataaacactgaggtagctcctggaacacccacgtacccgcttacagccccacgacatagcagggacctggctaatttgcatggccctgactcccacaggaagtagaccagatacgccaaggcctcatcagcccttgggctactaagtgaccaaggatggcagattaggctcaagagcagctggcaggaggtctgaattcgagtcctgtgtgccctgctcggtatcagccccagagcctgccatgtgaggttaggaagctcatcagcgatccgaggcagtgttggccagaccatgtgtgactggggacaaatgggatctccacggaaggttttaagggaaggtgggtaggcaggaaggagtaggggagggaacttgaggcatggacaggggaggcagaggctgtgggcgatcagcctggctggaggcccggactcttgggagatgcagcaggagatggcaagaaggaggcagaggaggacggcagcttccatggcctggtctcctctctctgccaagtgcataagagagctcttttggaatttgtcgagactgctaacagagaggccgtagtgcacagtggctaggagcttgcttcctagattcagactgccctctttgcacacctgtggactcttgatgggggtgctaggtttccaagctcccatttgtttcctgacaccaccctgctgagggccagcctccctcagatgctctgaatttcatcctcgctgcctctttcctaagacctgggcagggctgacctcagggttgaagcagacagccccgaggctctgcgctgcagggataaggatgtgtgcaggccaggagctttacctggccaggcctggcgccctggcagcgatctcaccctgaatgttcaggcacagactaacctggcccagccgcgtgccgccgaagtgcctctgtttgcaccttcttttaactttgaagactctgctggactatggatcctgttggcctggggctccgggattctgaggggcatggaggcagagtagggagagattgtttatgagtctaatgaagtggtggagtacagaggtcggggtctggcctccttcagcagcaacaccgcagctcgtgctggccaagcccaggcccagcacagtgcaaacagtggggcagtgggggaaaatgccgaggagagaaaccccgacaccaggtgtgcatttctctctgctttttttttttttttttttttttttttggcaggagaaggcacagccagtgccaggttctgacggcttctttctctcccctctgcccacagtggcccaggagcaccttaaggagaggggactgtttggccttcctgctccaggcaccaccccctcagactattaccaccagatgaccctcgtggcaggccaccccgcgccctacggggacctgctgatgcagagcgggggcgctgccagcgcaccccatctccacgactacctcaaccccgtggacggtgagtgctggccccgaggggctaaggatggggccagcagatctcctcttgaggctgagaaggtcactcgctgtttcttttggggacaaggacccttaaggagaggtcgggctgtaccccaatgccttccaggatggctgtccacaggcactgaatctttggacaacacttactgagtcaccacaggccaggaggcattgtaagcatcgcagacaccacagcaaacaaagctggaacttacagtgcaatggggagaaacagatgccaagtagctctaggaattacgtatgaaagtagccaattataaatggaccagggaaacaaagcaggggcggggggagcgagcactgggtgagtggggtgcagtttggaatggggaagtcagaggaagcctcactgggaagttgaaatctggggggcgagtgctccaggcagaggaaactgcagtgcaaagggcctgaggcagcagtgggcctgccaagctcaagaaatagccaggagccagtgctggcagtgaggggtgggagtgggggtgaggccagagtttccaggtggggtcttgccagccagtgcacctcagaagagactggctttcactggagatgaggctgggcagaggagaaaagagagctgactgactcacagaaggaatctccttccgtgctgatgtgagaattgatttgggggcaagacggaggcaggaggtccagttggtagaggtggggagaaggggccaggtcttgggaagaccttgaaggtagaaccacaggatgtgctcccagctggaatatagagttgaaagaaagaagggagttgaagttgacctcagggtctcgggcctgagcatttgaaggatggagtagtaactgagctgggaggctataggtggggccctcatggaagggagggaagtcaggtatcctgggtagatgaagcttttggtgcctgttagacacgaagtccttcccaccctccaaatgccatcctcacagctgctttcacagggacacctgtgaccctctgaccatgagcctgcgtcagcaaggagcccgtctcaaggaatagtggagggagtggaaggctcagcaccccctcccatcccccagtcagcgccactccgcctgcaggtcctggagccctggccagcggcacacagggaggcagggcagccagtaaagctggaagccaccacagggaacaggcaggcacctcctgcagagccagcctcccggagccctgcctggggtggcgttttcactccctgatagcccacggcagggagacaggagcctgcagggagaccgtcctgcaggggcagccctggtgcctgcagggccgtgcagcctgtagcaggttggggtgggctggtgggaaatcatgtgggaccaggcggggccatgagactcagggtgggctgctgccttgctcaccccgacccgcccccagggctctgttccaggggagcccttcacttccctaaggcctggctgacatctcgcctcctccaggaagtctctctggaagcctcctccttccctttcccctgcccccctcagtcactgggacagctccctcctctggctgctccttcactctttgcctggcccacctcatacttacagcaaccacctcacattgctcctcagctatcttgaacatctcctgcttcccaggaaaagttttgctgagaagagggcggccgacctccgaggctggcccctcatggatatggtcctcgccaggccctggtgggaggccataacatgcctcagtgatgccaccagaatttggtccctgtgtctgtcccgttcttccttgcctttcccagcatggtgtttagtccagaattaagcacaccatccagatgttcaacaacacctgtcagctctgtaggacattgacgtccctctgagtacacacacatccatgtgctctgttcccctctcctctcagcagccctacacggtgctcccacaagccacagtgaggtgtcagagatactgagagaaagttgtgtgctagacacgctccttgccaatattagaaaccaaacagcagcaaccgagtgcatgaaggatcatgtgcaaattgccacacccgaatgtcagcttcctgcaagcaggacccttcttccaagggcctgagggtggcaccaggccaataggaaagtggacgaggcagagaaaccacggccaagagaggtgagatgaggcaggtgtccccacagggcaggaaaggctaagccaggcagccgggagtcatccagtgattttcagcatgagcgtctgtgtgtgcacgtgtgtgtacgtgcacacgtgagagacagtgaattggaatgcagactgcctctgttctgtgcttttaaacacattcttccatgtaattcccttagccaccttctgaggctagaaatatgctccttactttaagatgagcaaatgggctcccagcatctagcggcttgacccaggccttgctctgtttgttaccagcaccatctgcccttccctgggctgcagttttcagcagcacatgcacctgaccaaccatgagccctggcccaagggagggccagccgggccaggtggacttgagctcagcccagagcagctgggccggagccagaggggagaagtagtacagcgagctccagggcaggcctgggtcaggcctggctgcacggtgtcctccctgtggtagctgggctcagaggtggtgacaggactgaaggggtgtggagtggcaatcccaagccctgcgagctgtgtggattaaacacattgactgagatggcacatgtgagcctggcccagtgcctggcatctagcaggtgctggaataatgctggtgcaggtctctttccaccagtatatctttccctctttaaatccactcactcttgcaggattctgtatcttcattgtaggcagctctgtccacctgctgcctaagcccaggccccaggttctcccagaccttttccttgccatctcccatccatcccatcctgtccctcaggcctccaagagtggcgtgtcacccctcccgggccagacagtgacatatcgccctcgtagcactgctccatggctgctgctcatccagcatccccatctttatcctctccgccatcctgcgctcagcccctgccacttctagccccctcaggataaaatccagactttagaacccccgtccagaggccttcctctccagctcatctctctccactgcacactggtcttgccatgcactgccccacatgcaggtccccagatacctccctgagctcattcctgcacagagtcctgtgcacggtgcgctaggccttctcctgagaccccacaagaatccagccccaggcctttcaagccaccaactagctccactgcactagcgggacccaaggcgcccccaactggaactggctgggacttctccttacgtatggccgatggcccgccctgtcaggtctgggagcacatctggcaaggagcaggtcctctgtgtttgttgggtgagtgagtgaatgagtgaatggcacttagaaaagaccctggaatggaaagatgcgctccagctaaggaaagaagcactggaggaatgtagctgttggctcacaggggactggaaggggctggggagcaactttgccttccgggcactcagcatttggcagccccgggggctgagcatctctgggaagcagcagaggagtgcagaggtgagctcagcagtgggcgcgagagctcccagccctccagcagctgctggttaactcatcacaccccacccgctgtgccttctccacctccgccttgggaacacatctggcttcaggacatggaggtaacggggaagcatcaccagattccagagtccacctgaggagggatatcagtttctccagctccagtatggggtgggggtgggagcatttttcttatccatggatttcaggagcagatgccttctttccctttgttcccagtcagttacaatccaagaaaatcagagtagtccaggattatctcctatttttattgctacttaatacattttttccaaaaccagtttcaactagaaccagaaccttcgcttcaccttttaaaaatgctttccgcacttccacttagctccgaggcctgtgtggacggttactcacgtatgtctctaagagacgctgaacacaacacctgggctctcagccaggcggctcgggctggacctgtctgtggggtgtcccccggcccctcccctcccgtgaaccatgggagctggggaggtgttttcggtgggtgcctgctccatgggtctgtgccagtccctcccggaaagctccagaccacacagcagagaatgtgaatgagcgtttccactaggtttctttttgctcaaatcctcactgagaaaattgtgtgggccatccctggcgccagcagtgcagctcaggagacctgtggaaggggcctggctctctctgaggaatgtgtgttcacaccaggaagcccccatacacatcatcttgagcatgtgagctctgtgcaggcgcagggggcctggagagctcatggacagccaaggagaacaggccttctctctctgcctttctctgtcgttgtgtctcatgcacacacgctggttgattcggcaggtgtttattgggcaccttctatttaccaggctcggttctaggtctagggacgcaacgcatcatgagcagcacacaagccctgccttcctggtgcctgagctccagcgcagccctgtgtgagttcctgggcgggaccaagaatgcctgtcccgacctgacgcccctcataccccagcctcctttctcagcaccttcattcatggtcccagaggagggagcactgtaggggagagaactttccagaggttttgaatgtccagccaaggcatggagagggctctgccaggcaagagggcgagcagggagaggtgggtgggaactccatgtgggtcctcatcctgcagggccttgtccccagtacaccggtttgcaaaccaccagcccagtttttaccttagctgagtgccacctgcacaattgtgtatttagtaatattttttaacagactcaccttttggggttaaataaatggttcttcaaatggaactttgtattttttctgaaatggaaaacctaatccctgtctgaagaggatgttcctgtctctgtctccatcaaacctaaagtaacctcatctgggccatgtgtggccctacatttgggaacacactgcagtggtggaagaaaggccagaagctagagaggcctctacggggctcttgtgggattggaaagccaagccctgcgttcctcccagggcactgaggccagggtgccggcaggacagagggatttcccaggctctgatgaaaacccaccctccctggtctcccagtggtgggtgaaggcccatttcctcttgtttttaaaggggtcctgatttacagcaggaagacaggagcgctgctgtgtgggaaggtgatagagaaccagtcagggaaccgaggtcatcattctgctgagcggctccctggagagcggagaattcactggttgtcacccgggccctaaaatggaattttctcatgttatgctgttgaatattggtgatttaacgacagaacagccaccccctccccctccaccacattgagaagattgagatgtttccgactgaaatgttgtctgtttactgctcatactgcctccaagccatgcattttattgtcatattgacactaatttggctcggatgtcacctccattctgacgcctgttctttatgctgcctgtggatccggggggttttcagaaaccaattacattgatcaaacccagagaggcaggaagagctggtagaggggctgccagaggcccaagtcaggcagggatccctttccgagacaggaaggggaaccgaggcaaaggaagccacactgcaggtccctgcgtgagatggtggagctgctgtgtacaggcacgggctaagcggtgtctatgggccatctggtaaagccacacagactgtcccgccacaccagcttcacaaagccgcttcacaggagcctgcagcacagcctgtttctctgtgttcatcacttagctaggccgtggtcctggcaactctgaacctcgctgctccacggcccaggcacttgctactcccccatcagaggggtgagagggctgtggatggctaggtgtggggggcattaaggtcctcaggtcagatttccttagagcatctcctcggcaagccagaaaatatctgggtgagggagttgggctatgcagggaacacatcttagccagtgaggattcagggtacccgagccccaccaccaggctgcatcctgctggccttgtattttttcctgaaatggaaaacctaatccctgtctgaggaggatgttcctgtctctgtctccatcaaacctaaaataacccagccccgggctgaggatggcatctggcacagagaaggctcctgggaccaggtgccaggatgatgctctttcctcctgcccctcagcccaggctcctgggcacacaggccgtggggggatccccagccccgattccatgcaagtccacccacaggtatagatgatatgttggttgtcagcccatagcatccctggggtgggtgctggtagcccatcttctgcatgagacaaccagtgattggctcaaagctacccagttcagagtgtgcaagcagggttggaacctgggtctgcctgagtccagggcctgttcttgcatctcctgcccttcctactgcctcagggaaaacaatgatctccctcctgagcaccttgggattctctagaataattctgcttagatggcaccttgcaaatcctgcctggtgcctcggagtactgtcttcatctctctcctacacggtgagctccatgaggacagggtcagaggcttccctgcccagagtccccatgatgtccaatcaatgcctggtgtgctctcagcactacacgaggggctgatggatcaatgaataaacatgtgaatgagcaacagaaagcgctagtgggtgaagcaaggtccagaggcaggtggtgtcagcgtccgcccaggtgagggtgggcaggtggccagtcacccgtggccgaccggcattaaaacaggtgcctccacagatgaatactccatgttcccggtcataaatcacaggagaaaccacgggaaatgagtgccaggcttttctttctatttagtaatttatcaagggaagaggtgcattaataaacatatttcccatgagaggcggggataacagagatgaatatcactgtcagatttggcctgtttcctcttgttaggggcacacgagagggtgggaatccaaatattagcggcagattctttttttaaaaatgtgttacgaagatgtgtgtgtttcttactttatatcatgttagatggtttttcccctcacattaccgtatttgccactcagtttgtaagtaataggagcctttcagagaattcactcctgcatctttctttgagtttcctttgaagcgaggattgacaaggagtggactcagtaaataagaacccagaagctgagagggcgccgaatgcaagccgatgagtgaatgtctaatgacagctgtgttgctgagtggcccaatcatctttcctagacttgctgcccttcactccattattgactggaggctcaccctgccccttggaacagtcctcctggcccttgaagaagccacattcattagcaatttcattttggaatgcccgctgggttttaggcactattcttggcattctatgtgtgtcttcacaacagccctgcaaagcaagccacactgccctgattgtacagatggggaaagagaggctcaggaaagctaagtaaatgtgctccaaggaagccacaaagtgacaggcttgacagggacagtggcagaggctgtgtgcctctgcatcttgtgtgtgtgtgtgtgtgcgcgcacgcgcatccacctggggtatgtgtctccacctggggtgtgtgtctccacctggggtgtgtgtgtatgtgtccacctggggtgtttgtgtgtgtgtccacctggggtgtgtgtgtatgtgtccacctgggtgtgtgtgtgtccacctggggtgtgtgtgtgtgtctccacctggggcccccctcccatgcagggggccctccctgtgccttcctgccgtcatactccctgccccctgagacacctctcctcctctgcaccctgggcataggccctgtggcaggtggttttggtgtccctgtaccttgggcaagttacttagtgtcctgttttgtcttctgtaaaatgagcataacagccccttctttatgggacagtcgtgaagattaaattacttaacactttaaagtttgaaggagtcctagcgcatgtgatgatagcattgagtaagtgctgtgtttaggtgactgtgaatctgttctttctcaacacatcctgtctgtgccatgggtcagcccttggcacctcccactgggctcatggctgtgccacctgtattcgagtgttggggatggtcaggtgggaaaaaggatttgggctcctaatgcatggtgagaaagacaggagcaagcagataaccacacagtggatgaaagctcacccccacccttgtttggagagagaggcctgagcatagggaagatctgcccaactccaggaggtcagggaaggcatcccaagggaggtgatgactcggctgaggtctgagcaggcagaggaagctgcacgtgcaagtccctgagcaggtgatatggaggaggggctggaaggagacctggtggctggagtgaggagattccacagggccaccgcctaggccttctttgtaacagcagtggggatttttggaaagttttggggagagggcagggacatgatcttatttccaagttgaaaatctgtctttgcagtgagcactgtggattggacagctgttagctgagggccccagaatgatccaagcaagtggtgggctgtgctaggggtggagtttgaaaggagagattttgagaggcgttcacgagcccacacgtaagtgggctccattgtggtggaggggaggagggaaggccgactcccgggtctcccgctttgccactgcgcaagtagcaggcacgtgctgtaggaagagctggtccaggcacagggcaggagtgtggggctggctgtgccaaactggagctgccttgcagacaggaggagaggacgaggaggcagctggctctgagaaggctcactcttcagagccactgaaagtgggaggtcgaaaagtgtttgtgggacgggacgtccgcctggccctgggcctctgctgacctctctgaagatggacagagaagacacagagtcattagaaagtccagacatcagggcttctttggacctgggttcaaatcctgcctctgtagctctgtgaccttgagcaagtcactgacctctcaagcatagttgctttgctgcttatctggtttgcttggaggatggtggtagctgttaaatgagtcagtggatctaagcgtcactaaatggtggttgtcactgggtcattatttgcataagaattcagaagcaggcatttatccagatactgcatcagaggagcacgctccagccaggatgcagatgctgcagcagaggggcacactccagccaggatgcagatgctgcaacagaggggcacactccagccaggatgcagatgctgcagcagaggggcacactccagccaggatgcagatgctgcaacagaggggcacactccagccgggatgcagatgctgtaacagaggggcatacaccagccaggatgcagatgctgcagcaaaggggcacactccagccgggatgcagatgctgcagcagaggggcacactccagccaggatgcaggtgctgcagcagaggggcacactccagccgggatgcaggtggtgcagcagaggggcacactccagccgggatgcagatgctgcggcagaggggcacactccagccgggatgcagatgctgcggcagaggggcacactccagccgggatgcagatgctgcggcagaggggcacgctccagccgggatgcagatgctgcggcagaggggcacactccagccgggatgcagatgctgcggcagaggggcacactccagccgggatgcaggtgctgcggcagaggggcacactccacccaggatgcccctgtttgccgtccaggatccctatttagagtgggtgatcacatttgcagtgcagcctcacagctggctgggaggtagcctgctccatgggcctccctgcttctttctgtcctcaggcaggtgacctaggatccttcctgctgtaagagaaagaaggagttgtctgagtgagttacctgctctgccctggcccctctgtggggtcagagcaagtgggcatccccagaagcaactatggaccgtcttctgtgtacccactgtagctctgcttactaaaatatctgtaagccccagtcttcatagcccaatagaataaacagcgaaagcagaaagtttagctgacaaggatgtcaaaagaaaagaatgttctgattaactccactttttttttcaactgggagctttcctaacatcacttaactcttctcgttgaaaataaagtataccaagtactgggtcacatgaccatctcaactgtagccactctggagtgcccaggccacttccccatccatcatcccactgggtcacagcaaccccagagctggcagggacttgttttatgctggtgtcattgatgaagaccccaagtctgtgacaggtaaaacaatttgccccaagtcatgcagctgacttatggctccagcccagggtacccggtgtgcagcccccacttcaccccactgcaggccactgttccagtccaggtctccatccctctacccagagtcccttcatcccaggctgctggctgtctactcccctctgtggcctcagactcccctcatcccatgaaagaggctgttaggagagaaaaccctggaagcccctttcggcccaatggtcctggatgtcctctgtcctctctatgccttggagaggtgcttctcctggtggcctggcaggaaagagcctccccagggatccctaggtctcctcagggttgcagccaagcttggggctgggccgggcatggttgcctcgaggggccaacatggatcccagggcttgcggcttgttcagtaggtgggtgcgggctctgccctcacacagccttcttggggactggtaggtgtggagtggggggctcagaggctcgtaggccatcaccccctgccctcggtgctcctgcagctgtggagacataaggaactgccacgtgcatgattcagagtggccctaaggtcagtggtcaaagccatcaggaaagcttcgggagcacccgccaagaggctgtgtgtactgtgagcaggaggcccatggagccagaccctgcagtcagggcagcctgcctggaggagggggcacccaggaggggtctcagcaggtctgagcaggcagaagggaggaacgcagttatcataagcctgggaacagccaagcacagacatgagtgtgcttgagcaacccccagcatcatttatgggcaacaccaccagcccatggggaacccggaggcctggaaaggatgggtgggcaggggccagcgggacatgagaagaggctgctccatgcaggtgtccagaaagtcaaggacaggcccaagcatttactgtgccctaccatgggccaggtgcttctcacgcttcgcctaatttacacctcatgccagccctggtggtcagcactattagagccctttaaaaagaggagactggctctgagggatctggacagggcaggaagcttggcttgtggagagtcatccagcagtgttgtcagaccatttctaggccaccgtttgttcagggcagagacctagaatcctgatgggggcaccgtgatggggagcagtctggaaccacagtggaagagcctttggtcctagggtgcagggtactcttgtctggggcaagccctcttcccttccacagttatgtaggtgtgcgacagcagctggtgagggctgagggcatagccatgtgtccacacatatgtgtgcatatgcatgtgtacacatgtctgcgtgtgggtgcacacaagtgtttgcatgcatgggtgatgtgtgcacctgcgtacatgtgtgcctgcatgcatgtggtgtgcacattcaaagcaacagcttcccagagcctcgggcgactttagaactgaggacctcagtacgcagaagcacctgcctgtgtcaggttgcctctcgctgccatgtcctcgtgtcctccctaccctgttacagcaggctgcccagtaggctctggagagacagccaaaggcccagacattgcgaagagtctgggggccgccattcaggcctctgcttggcaaatgccctatcagggggcactttagtggtgattccaggtacaacgtgacctgtgaccttggagcacttacttccattccctctcttccccatggaattctccatagcagtgggaacaggcaagcttctgccacacacaatagcatggagaaatcttacaaactgaccatgtggatgaaggaggccagatatgaaagagtatttaaaaattccatttacacaaagctcaaaagtaggcaacaagaagctgtgtgttagaagccaggatagcagctgcccttgggctggaagatggagggggcctgtggacaatggccaagcactgtttcttgacctggggctggcttcccaggtgggctaacttggtgagaggccaccgaactgctcacttatgattcgtgcacactcctgtcatgaggtaagcattgctggattccagccctggtctctgcacccagtggtaaatacactatgctcagtgctcatattcactcgcccaaacaccttacatgcacttctccagtcctcaccacaccctgcgctgctcagtccattttacagatcaacaaactgaggccgagaggtgacatccttcgcccaagagcccacagctggaaagtcggcaaagctaggattcccattagaccatccttgcaggctcttcctatcccccacccacatgtcaccccctcccccatccccagtgatgctgacctgtcttgtgttgactatcccacagtgtcccgtttctccagcccgcgggtgacgccccgcctgagccgcaagcgggcgctgtccatctccccactctcagacgccagcctggacctgcagcggatgatccgcacctcacccaactcgctagtggcctacatcaacaactcccgaagcagctcagcggccagcggttcctacgggcatctgtcagcgggtgccctcaggtgagccccgcctgcaagcagagagctgaggaccagagctgggctgagggcccggtggggaggcgctggcttttcagtgggcgcttttgacccgaggagaaagacaggacctgtggcatttgtgaatccacatacttgcaccttttttatgaattcaaaaccaataatgatcaaattgaaatgagcccatatctgagtacatcttcatggaccaggcctgtcatgaatgactcaaatgtgaaatcaaaggtgtttgaggtcaaagatggttttcctagtatttcactgaatttggtggagcagccaagtattggccaaccttggagaccacacaaaatgtgacattgacatggcccatgctctcagcaagcctctgggctggcagcaggcctccctctgtagccgcatggtggcacacccaagcctcactgacactagccacccttctcccttctgtgcggctctagtctgtctgaggactcagaccccagccagcttgactgaaactcacatgcctctccagcacctccggaagaggccaggaggagttaggaatgtcaggagagtttgtcccaacgacctggagatggaaggaataacaagtgtatttgttatcttttgctgcctaacaaattgctccaacgcatagcagtttaaaaccacaagcaattgttctctccccccatttctgagggtcaggaatttgagacaggctgagctccggctctctcaggtggccacagtcaagctgtcagccagtgcttcatcccgccgaaggcttgactgggccagaatgccccctcacagcgctctcagcagtgtcctttgttcctcatctgtgagcctctgcttagggctgcttgagtgtcctcacaacatggcagacgggtcccagcccaccttgcagcctatgatgtgagaggaagctggaggaagccacgatgtcttttacggcccaaccacaggggtcaccaatctttccttggtatcctgctgtgtgaaggttggctcttatgcaagtggtgtgacagagcctagaagtgcagtaagaagaggagaataatgcaagctggagggctcagggcaagattcctggatgagggggcattggaacaggattcggaggcctcatgggtttcacgtagtcagggagcagcgatacagacatgcgtctaggtatcacagcagtggagaggccagggtgtggggatgagctggagcctggtccctgctgggagccagcctgccaggggtgaagtctgcatcctggggcagaacctgggagctgatcgcagaaggtgagtggcagacagtaggaagccacagctggttcttgagtgaggaagccacagtgatggtggggctagcaacatgctcatccctatcccctgggcaaggttctctctgtccaggaagtgtcagcctaagagagctcccgatcccccacccccacttccttgtctgctctctgttgcagcccagccttcaccttcccccaccccatcaaccccgtggcctaccagcagattctgagccagcagaggggtctggggtcagcctttggacacacaccacccctgatccagccctcacccaccttcctggcccagcagcccatggccctcacctccatcaatgccacgcccacccagctcagcagcagcagcaactgtctgagtgacaccaaccaggtaggtgggtgcaggggccaggatggccactgggtactcatctggacacatgagggttgttcactgccagctcatgctaagaacttgtggagggcctctggatttacgtctggccgctagggtgccttctgggcagaggccacgttacagaaagggtgagacctgggctcagtccatgggaagctcccagcttcttgattctgccgtctcctgtccaagaagcataataagtagatggagaaagcctcgattcccagggcctggcaccatggaggcactccatgcacagcacatagcatgggtgggtgagtgaatcattataagactgtgcagtttcgtcgtagaacgtgcatttgcagcaggctttcacacactgcctcattcgacccttccaacgggccttgagcatgcctgggcatcctagtacagtgcctggcacatcctaggtgccattattatttggcaaatgaagtgttcttttacaataaggacatggaagggcacaggccttagcatcagtcagaccatctttgggatcccaacttgcctgaaagcagcacatctctttccctctcgcagcctgagctaacttatctgcagagtgggattcctgatgcctaggtggggtcactgtgcatacaaacaagctcatgtgtgcagagcccccataggctctgatcctgggagcactgacaacgacaatgccagaggtgaagggaccaccccaggccacccaccagcaaatggcaaagcctggatgtggctacacccttggaaggaagacaggacaccatgtcctctagaagtgtcctctgttccagaatgtcctccctctccaccccagggctcctggtggctccccagagcctccccacgacagtggctgtcagctctggaaacatcacctgatactttagctctagccccttctcctgaggaactgggctctggccccctatgccctgggctggccaggccctgttctcagatccagagtgtcccctgctctggagggctgagaagttgagcctggtcagaacaggagcaagggcaccctgcattttccaaagagaaggtctctttcccatttcccagaagtcttggggaggcggtgatggagagatgggggttggcatgcccgggtctgggtgctctcctgtagcaggacatgtgcccccggcaggactgagctggggactctatttctgatactttaaacacagggttagcccagatggtctgtgcggagagatcctagagttaaagtccaaaaaaatttgggatatccctgccctgcccctgagtaatagactgtcctctgcacccttcctcagaacaagcagagcagtgagtcggccgtcagcagcaccgtcaaccctgtcgccattcacaagcgcagcaaggtcaagaccgagcctgagggcctgcggccggcctcccctctggcgctgacgcaggtaacctgctgccagccgcaccaccttcctccagctaggaccaggcctgtgggctgccttggggctgtacccttggtggtgaacggatggctggctggctgcctgcatggatgaatgagtgacccagggaggactgggtgggaatgctgagctgtgactttctcaccactgtgttcccagcaccctggacatactacattcccatcacacgtggtgaatgaatgaatgagtgaatgaatgaacttctgcctagccatccctcttgtctcaggctgcatctgtctctctctccccacacctgacctgtgtacagcaccagccacagcctagctgagttgctcacgtccccggaatggcccaggcccttctaggctgctgtcgctcttggaactctaccccaccctggctccttcgctgccacttcagcccttcctgattctcctgggtgataggactgagctccaggcccacacacccagcctagctcaggggtcacttgagggcatgtgctgtgtgcacacctgtctccctgtctgcactctaagctttggagaggtggcgctatgggagaagtgcctgactgggttccatgccaccagggtttgtgcaagtgtgcagtcactgacacagtattttccaatgattcaatgcacatttgagtcagtgagtggcgtggtgaggggggaagacaggacaagttcaagcggggagagaagagcggagcagcccacagcccagtgcaggcctaccacgtggcccagaccctgtgctgatccttttggaaactttgccacttatttcttctgctccaagacagcatgcgggcagcccccactcttggagcaggggcctgtcttgtaaagggcatgccgtgcctgttgacctggtaagtaagcccctggtcccccaagccctctcatggtggcccagtcttcattcattaccacagaagccgcatcttggacaccaaggatgctcagggcctcctatccctgtctcccctgcatctgccgagcatcctttatcaaaactgtgaaccatcaggcatgctctgggcacttaattttcatgaaatattggcttctgttatcgtcaagcaagcagagaggttgatgacaaattcttctccccttgctgacaccaaagccggtctcagcacgatgcatggtttccacggggccgaccatcatcgggagccaatgaaattgatgaggacggcacatatccagggaagataaacacgccagaaaggcaaggacagggccggcaggcaggcactgagcacctgggagccccatggccacacgccggtagggccctatgcccgccctccaaccctggccggccatacagggcctcctgcctgcccagcctggctctgcgcacgtgtcagtgcaaggaaagctgtttatcatgaggaggttgtccccccgtcgctcagtgtcccgattcactgaccaaggactccctgactcatttgtaaggtggatggctgacttccaggtcttctcaaagagtggagagggtgatgggaggccctctggtccactctccccatggtctcaccccaacagcccccagacgatcccattgctaaagatctggaaaggaaatgctcccacaccttcctttgacttgctcccaatgtagcccctggagctattgtacgacatgttgttgctttcctgttgggaacaagtggattcgttgaaaggtcctttgagaaacaatcaggaacccttctcggaagaggtctttgcagctcttatggaaagtcaggtggagtttgagtctccattgacagcagggcgtcctgaggctaatttcttccattcccagaaagggactcagcattaggactgaaattgtgacctgggcagctatggtaccactcattgagtccccggagccagtgggggttaggccttttgagtatggggcgaggtccttcatccccctgagcctgactatacatgttttccccagagactattctgaaagacaacattttcctgctggttttggagagagtttgaagtgcgaagcaatcttggtaacatctgcctctttgcttggctttgctcccagccttcctagcagaccagtggaatactggggagtccttgacagcccttgtaggccctccgtggactttccgtccctacctggagtatgagcctctccctgtgccccgaccccaggcaggtacctcctacctgtcctcatgttctctgctcagagggtgcccctggttagcatcagtgagggtagggatggtcttgtgggttaattctcagtctgttgccagtttgagagaaaaagactttgtcctttttgacgggaatttcagggacctgtgatcaggtgaaggaatttcaggtacctgtgatcaggtgaaggaatgtctcaggggtctttccttcgcctcattaaaatggccacatgggccctaatgtggtcaggggactcaagtccagacctaggctgcctcgagctcactgtgtattcatggggagggcctcggatcctccctatcgtacaagaatgcagatgcccatgcgttagggctgtggcagggaaaactggttccccacagcacttcgatgaagacaagtgtgcactggagaggaaggaggaagggccccaggacaggccatctgacaaggagagctgtgggcggggctgagttgaggaaaggagctaaaaaggctgatgagtgtgtgtgtgtgtgtgtgtgtctgcatgcatgtgttgtgtgtgtgcacacacacctgtaacacacacacttgcatccacacctgtaacagcccagggtccttggcacagaatgcatgggactaacagcgacctcttttcagggccaggtgtctggacacggctcatgtgggtgtgcccttcccctctcccaggagcagctggctgacctcaaggaagatctggacagggatgactgtaagcaggaggctgaggtggtcatctatgagaccaactgccactgggaagactgcaccaaggagtacgacacccaggagcagctggtgcatgtaagcttttgaaccccagcagcccgccaaccggggcacggcccaggccatgcaggatgctgagccttccagggcctctactagacagaaggggctggaggaagagacccccagagatgcctgggccacatcccctgcaagtgggaggcataattacttatgtgtgtcctgcctgtttttaagatggcttccaatacatatgtaatacaaacaattaaaagaaaaaataagtaaatgagactgtcagggaaaagagaacaataaagtgaaaccaggaatagagttagtattaaaaaccgagtgctttgagctatattctatatacacattttttttttctgagattcctaatagccagtgcaaagagggaaatacgattagttaaaccagccagtatctacacaataataagtgaaagaagcttctcccatgaaggaaggagttgatcctttccttttggggactattcacagatacccagtggatatgggtgcaggtgggcgtctacacccagatcagagaggaggttgcttaacagtgcctgagtactgacagctcaggtgattagagatgaccatgggagccggcgagaccttcaggatatgcctcttggtcctcattccaaactctcatactgcagcgtcccttatatggcagttaggggtgatgtgtgcaatgtgcagagcagaggcttggcacgggagacacctggctccaaacctgtccccaccacaaccagctgagtggttctgagcaagtgactccacctctgtgagcttcatttgtttcccataaagggggttgatgctaccccacaggagggtcaatcatgtttgtcagcacttagtgccttgcagacattccgcacctagcagctccctccttcctcctcctgcctgttccccacaccagccctgagtggttctctcttctccatccagagaagaacttaaattcaagaaagccacctcccaactccccagcacatgctccttggtgagtgagtgtctataaagatgaacccactaaattagtagctcgattgctgggaagagcagacacacacgcacgtgcacacacatgcacacacacacatgcacgcgtctccgattcatattcagaagctgtccagaggcgcttgcttctccccagctctgtgaacttagcatttaggacacgccgactccctctgcttcttccacttatgcaacttgctcacaaataccgtaggtttcttttgtgttggagtttgtcctcccaaacacagttctcacccagaaggccagaatttcccagcaaacgaatgcagctggtgaagcagggtcttatctaaccccttctggatctcaaacttaatttttcaacttgtaccacctctttggggtaaacaagccctagatggagcagggaccgtggagctgtgagttgcagaacaaatcagttagatgaaaggaggagagagggacagtctctcaggccaggggaaggccaaagccagagcatgcagatgaggatgtcaaagacgtgctctgtgataagtgggtcagccccaaagagcaggcacggaattcctcagatgaatgcggagggtccccaaactgggaggagggctttagccaggggcttctgcctgtgccctggactgtcctggagctataggtggccacctccaccaggccctggaaaaagcagaccccttcacccagctctgtctgtctgtctctctctgtttctctctgctccctggaaagatggatggagcaggcgcacaggcgagctggagcccctggtcgattattaacaatttgttgctaagtaaaccaataagaaaaaaatgaaagccattgtcaggaagcatttttatcatttgaaaggctttaaaaatggaaagtgaggctaatatgataagatttccctggaagttcaaagcgctggagatttcacatgctccagcaggggcatctgtacgcgtgacagttgggcgagtcgcacagggcatgagggcctggcagttttctgtcttctggggcaaggtgctgccagtgcctgatgcttggctcttgggacagcctcttttggtggcagagttccacagcagaatgtccagcagaacaatattacaggccacaaatgccagctatccatgtaatttacatttcctaggagtgcatttaaaagtaaaaagaaacaggtgaagttaattttaatattttttatccagcccaatatatctgaaatatcatttagcaggtagtcaatagaaaagaaagttattgagatattgtatattcttttttttccattctaagtctttgaaactggtgtgtagtttgcacttctagcccatcccagctcaggccagccacatttcaagtgtgcaagagccccacatggggcaagtggtcactgcattggacagtgtgggtctagaggttgtgggaggggggctgggaggaagtgaagacgggggaggaaactgagaacagaggaggaaggggaggcctctaagacctgagtgtcctggcctcgccaccaggctggggaagtaaacccagccttacccgagatacgcggcagggttagtcgtgctgcgctggctgtcccaactcacttgcctggggccgttttctcccaggataagcttcacacagtgcccagagcccaccattaaggtcagttctggctccaccacgccgactgccagggccctgtgcaggccactgaactctctgtgcctttgtggaaaggggacaaagccattatctcatgggtcaatgccaaaaatagagataagcatgtgttatttttctactgaaacaaaatatgttatttacaaacctctgaaacaataggggcaagcttaggagaggcttctcatgcacccactacgggcacgtttgcctcgctgcggttagtgcctactgtttgcagcctgggagcgtcatcacaccagagcccaggctgcggtgcacaggatggctttgcccaatatagacggtcactttgaggactgattggaaaatgcagggcagataagcggcacgcagtaggccttcatttaagggcagctagtgatgattcatgaggaggcgtggcccggctcgtaggggtggtcttgttgggtcagtggtctgcgtatagtaggtgggatgggcaatgaggagcacggtctgaacataataggtgtggtcagcagggtggatggtctgcacacaggtcggggagggctgggggggtgccggtgcaggtggtcagctgacagcagggggtggtctgtgggcctctggccctgcttaccctcttctgggcatgtccctccggcagcacatcaacaacgagcacatccacggggagaagaaggagtttgtgtgccgctggcaggcctgcacgcgggagcagaagcccttcaaggcgcagtacatgctggtggtgcacatgcggcgacacacgggcgagaagccccacaagtgcacggtgagtggccttctccccacccccgccgcagcatcaagactggcctgtcagccaggccggggggatcatgtttggaggtggctggccacaggcacacctgggtggggcagaccacagcaggggctctgggacaggagcctgttcccaccctgcctgtttgggtcctggaggcccctcgcctcgtgccgtcccagaccttgatggacttgctctctgggtgtgagcatctcggtaagcatggcaaaaatgtgtgggtgtgtctgtgattgtgagtccaaaggcatatctgcaccctgcagtttgcttggctgggtgacgctgggaagagggacagctccatagtgctctgcagagaaaaaaacatcattggtgattcagagcttgagcaatgatgggttaaaatggttgagggtttttttgtttgtttgttttttgagacagagtctcactttgctacccaggcagctcattgcagcctccacctcctgggctcaggcaatcctcccacctcagcctcctgagtagctgggactacaggtacatgccaccaacccagctaatttttgtattcttttgtagagatggggttttgccatgttgctcttgaactcctgggctcaagcagtctgcctgcatcagcctcccaaagtgctgggattcgtcttgagccacagctcccagctgagttattttttttttaagtgagctcaatgataagaccttttctatggtctcctttagaaggtcaacaggatttatgactatagttggagagacttatttttttaacacacagaaactgctgccccacaaatgcacacgtggtttcagctgtagctgaaacatctgggaactcctttttgtgaattcttgtttcatagattctgagacatacattttgttttcaccttaatatctctgaagtcagactgtcttaaaatcagtggtgtccaggatccaatgaaatatgctacctttgctggcaagtcagtttttttattgagaaatagctgacataccataaagttcacccttttcagaaaatgtgcaatttagttgtttttagtacattcacagatttgtacaacaatcactactagttaatttcagaacattttcatcaccccagaaagataccctgtactcattagcagccactcctaattctgtccttcccacagcccctcctaattctgtccttcccacagcccctcctaattctgtccttcccacagccctggacaattactaatctgctttctgtctgtatggatttgcctgttctggaaatttcataaaaactgaaatcatacaatatgtgcatttgtgtcttgcttctttcagttaacacgtttgcaaggttcacctgcgttgtagcatgcacgcgtactttctttctttttgtggctgcataatactccattgtatggatagaccatgttttgtttatgcattcatcagttgatggatatttgcattgtattcactttgaggctattatgaataatgctgctatgaacatgtgcgttcatgtttttatatggacagaacgttttcacttctcttgggtatgtgtaactaggagtggaattggtgagtcgtatggcagttgaggaactgctagtctgttttccaaaaacgctgctccattttacctttccacccacaatgaatgagggttctgatttctccaaatcctcaccaacactggttgttacctgtcttttttattctagccatatcctagtgggtataaagtagtattttattgtgtttttgattagcacttccctaattagtgattaataatgttaaacatcttttcaggtgcttattggccatttgcgtatcttctctggagaactgtctacccaaatattgcccattttgaaacctggttgtctttttgctgttaaattgtaagaatttttcatatatctggttactagacccttgtcagatatatgatttgcaaataattctcccattctctggattttcttttcatttccttgatactttcttttagagcacaaagttcttaattttgaggctgtacaattttttaattgcttgtgcttttagcgtcatagctaaggaaccattgcctaatccaaggtcacaaaaatttacctctatgttttcttctaagagttttatagtttatatagacttttatttatagaaatattgaatactggcactctgaaaaatttaaaaattaaaaaaagaatatatgtgtgtatagagagttttataatatagctcttccattgaggtctttgatccatttggagttaattttttttttttttgagacggagtctccctctgtcacccaggctagagtgcaatagtgccatcttggctcactgcaacatccgcatcccaggttcaagcgactctcctgcctcagcctccggagtagctgggattacaggcacgcaccacacgcctggctaattttttgtatttttagtagagacggggtttcaccatgatggccaggctggtcttgaactcctaacctcaggtgatccccctgcctcagcctcccaaagtgctaggattacaggcgtgagccaccacgcccaggctggagttaatctttgtacatggtatgaggtagggatccaaacttactcttttgcatgtgattatgcagttgtctgagtccatttgctgaaaaattgttctttccatttgaatggtcttggtatccttgtcaaaaatcaattgaccttaagtgtctgggtttctttctgaactgccagttatattgcctggatctctatgtctctctttatgtcagtaccacatgcagtctttattactgtcaatttgtaggaagtaaattggggcatatgagttctccaaatttgtcctccttttgcaagatggttctggctcttcagggttcattgcaacaagttattttcttaacatcctcagtagtggcaaaccatagccctttgatgatatgagctgtgagttgtggaaacagataaaaggcgtttggagccaagcatgctcaatcagactggtcaggaataaaggggaggatgggaggaatgagacagctcctgccgggtgtacgtgtcctcctgagggcggttttcatacatccattcaatgcaaccacagtatctttggaatagctgcagagcttcctgcaatgatctcttctttctccccttcctcccttcttccctctctccccacctcctttccttccttcctctctcccttgctccctcctttcctccttccgtcctttccaaaaatgtttcttgagtgcctagatgctaaatattaggaagacagcaatgaacaagacagaagattcctgctctatggagctggtattctagtaagaaggctgggtaacaaaatgattaagatcattataaatcgagccaaggggtataaaggagagaggatagagtgttgtgattgagaatatcagaaaaatgccctcagaggagatgacctaaaagattgagagggagggacctgggccaggaaccggattgggtgggggctgcagaagtttccagccagaggggtcggtagtatgcagaggccccaagccagaaagaacttagtggagtcaaagaactgaaaggagaccagcatgtccaaagtgaagatgagggtggccgactcactcaaggacttgaaggactgaattttattctcagcatgttttagagcacaggacaattctaaccgagagtggtactgggaaacagttcaaagtcatagtttagagtttaatgatatgggaatatgctgctgatttaaaaaaatagagtatgtaactgaatacttgacatgttcccaattttggttttaaagacatgtggagatgaattgcagactcaccagaatgaaacttacctgcgtgtcagcagtagcagcccctgggcgaccggtggttttcatttttctctttgtacctttcagccctttccatgttttcaggaaaggaaagtaatatccttaaaatgcatgcttctgagtgcgctgatggggtggagcagagcagagaagggggtggggaggaagcagcagccggcctcaaggttgggccccctggggtgccttgactgactgaaccgcctccttctagttcgagggctgctcgaaggcctactcccgcctggagaacctgaagacacacctgcggtcccacaccggggagaagccatatgtgtgtgagcacgagggctgcaacaaagccttctccaacgcctcggaccgcgccaagcaccagaatcgcacccactccaacgaggtacctctgcggggcatgcactgggcatgcacactggggccccactgatgccccatggcttccaggcatctgtagtccagtagatagccaggtgccccatgtcccgcccccgccactgaccagctatacatcctcagatacagaccaggactctttgagacctagacagaccggtctctttctctatgccacatcctttcctctaaaagatgccccgtgaggtcccatggcatactgaccctctctgtgcctcaatttccttatctccataataaatataatagtgccctccccaaaggccatcatgaggtcctcgagagttgaagttgaagcagggaagtggcccttctgatctcggagtgtttaacatgcatctgctccctattacttggggctgctgggtgggctctgcctccccatcctctagatgaggaaacgaagactcagagatgaagtgactttccccagtgccagagcagtgatgatccctctgcagctgtgaaaacatcctgggtcactgctccccacccccaaattccctttccaccacaagcaggtgttccactggggagcagctgccccactgcctgagggaagcagagcagtgctgtctgagcttggcgtttgttgacagccccctggcctgttggcttgggcagccagcagtgacatgctccagctgttagcgctgcctgggcctgccgtggctgtcagccccagcagacggggcacagagcagcctctgtctccctgggtaggcagagcccctatctgggctgagagaaccagggagaaagcagggcaagagccggtggcatcctggcccagccacacaattactgtcgctcaggcttactcggaaatgtatgtttttaaaagcttagacatatcctggaccccaaagggactttgctccaatgcttgtaagaagttagaggaattttcaaaggcatctgaacccctcagagtctctatggacaagagccagccttagaggggagtgtgtgtgcacatgtgtatatgtgtgtttgtaagtgtatgtttttctgtagacgtggtgtgtgtgggtgtgtgtgtgtgtgtgtgtgtgtgtgtgtgtgcatgtttatgagtccaggactgaggttcggaaatcctgggttttttcaccccattactggatgacttggaacctgttcctttgcctccctgatcctgcctttcttcatcagagaaatcaggggtgctagtgctgtcagagggtacactgagctcgtacacttgctactagtactaaaaaccccactgccctgttcattgagaggcagcattgtgattacacgaggcacatgtgtccccagcttcttgtggcaggaccccccgtggccgtgtgcttaactgcatgaacaggtgcagacaagccaggctatggccaggctcctgcatggtgccatccacagagcactggctgcaaatttgacacagcacctactgacgttgccagctgggctctgctgaggggcgtgggtagcttcaggagaacagggagagcgccccttcagagttgatcctcgtacccctatccatgacacaggcctgcttctctccccagaaaccctacatctgcaagatcccaggctgcaccaagagatacacagaccccagctctctccggaagcatgtgaaaacggtccacggcccagatgcccacgtcaccaagaagcagcgcaatgacgtgcacctccgcacaccgctgctcaaagagaatggggacagtgaggccggcacggagcctggcggcccagagagcaccgaggccagcagcaccagccaggccgtggaggactgcctgcacgtcagagccatcaagactgagagctccggggtaagcggagctgggcagcccagccacgcaaggcgactccatagccgtgcccagggccaccccttgccacggttgcgggctctgccctaaggcccccctctaggggcacagcgatatccctcctctctccaacttggctttcccccttcaccaccttgggcctcacatggaacctatcttgtccaggtcccattctgctctgaccaggctcctgctgggtgtgtggcagcacgctgggtgacagggatgccgccctgtacggtgggcctgcacagggcgggggtggcccctgcaagtctgcctttccagccagcacccaagtgccactgccagcccccactcctctgtcctgtctctgcatccccacccctctggcgtccactccttttgttctaaccacctgttctttgtctccatctctttttcctgactgtacctcccctaaggatagacggtactgaggtgagccaaggagctgggcatgtgtgggtgggctgggggagtgagggtggctggggagccggtccatgctgctgcctggcagagactcacctgtcagtctaggcctcctaggcccaggcaggtgggcccggacaggcacacggcagggcactgcaggtggggccattggccttggcagccggagtggaactggcaggtgtggggagcaggggcgccaggctgtatcagggacagagtgacagggaggcatgcgtctaggctacagaaggtcctgagggtcaaacagaaaaatgtgggtggcgccatggacaacacctagaaggtccctgctcccattaagcctgtgtcctcatgggaaggaagatcatgccttcccaagaaagctggaatttggggccatttggcctaacaatgagcccagaggtggtggtgcatctggtgcaagcctcatctgggcccagatccgagttctgtggatgtcgtccgagtggatgttgtccgagttctgtggcattctgcactgtgtacatgtgccatgagctccctgccccactctacctaacccagagggaagactgttttggggtggccctttacacaagggctgcatcccacaggtccccctcctggtcatcctttccctttcccacaacctgcccctggccttttgagatcatcctgtctggttgaagccaccaagtcagcaggcttcattcctcacctcatcagggtacatggctgttggtgggagtgtttaagtgccttcctttgtgccatactgggtgccttctgcacgctgcgtgctgtccacccacccactaactctgcaccggaatcagttcaggtccatctcatagttggggaagccaaggttaagagaagtgaagtgacttgaccgttttaagcaaacagactcatgacgctttacgtgctcctccgcaaggcagcttccttccctcaccctcagcccctcagggtgggcgagggtgtggtgcctgtgcaggcctagaggcaggaccaggtggaatctgataccctctgagtctgagccttcttgcctcgtcccctgcagctgtgtcagtccagccccggggcccagtcgtcctgcagcagcgagccctctcctctgggcagtgcccccaacaatgacagtggcgtggagatgccggggacggggcccgggagcctgggagacctgacggcactggatgacacacccccaggggccgacacctcagccctggctgccccctccgctggtggcctccagctgcgcaaacacatgaccaccatgcaccggttcgagcagctcaagaaggagaagctcaagtcactcaaggattcctgctcatgggccgggccgactccacacacgcggaacaccaagctgcctcccctcccgggaagtggtgagtaaaggcctggggtttgcagatggggcagaagagagtctggggcagcaccaactaggctggcacccaccaagcaccagtgctatctcaccggattcctacaggatcttaccagcccagtacagaaaaggaaactgaggctcagagaggtgaaatgccttacccaaatcaatggcaggggtgagattagccaaaggccatgctctttcaactgcaccattctgagtccttataaccccccaaaacaagcagaccctgcgcacatcatcctcttcctcacccattcattccttcactgatgaggcacttgctgtgggcaccatggcaaaggccctaggcaggagagccatttaattccagtcccaaaggagcgtatggttagaaggctgtgccaccagattcacactctactgcagaacgagccaggtaccaccaaagccagagcttagggtagagctgtgcagaggaaggagaaagcacattgagctggggatgagcagggaggacttcatggcggaggcagcactgtgctcagtctcaagaggtgttggccaggctctgagatggaaggcgtctttaacgagcatgtcttgggtactgactctgtgcctaggattgtgccgggctgcccactgtggtcaacactgatgtaccacctgctctcacttgaagggaggatttgttgtcccaacttgtggggactactggcaaatggccttgaactctcagccccctacagggatgtcctgggttgcagacagatgccccacccaaggtcaccccttcccagcagctccgcatgcaatgactggtcactgcaggagtgtaaaggcccagccatcaagatgaggctcagagaggtgcccaactcagggcagcactgaagagccattgggggtcctgggctccctgtgagatcatcctgggctcacgtctcctctgcccactcttgcagcctgtctttccttccatgggtatggacctcagggtactccctgtaataacctgctccttaaactccatctcagggacgcctaggtggcaccacctccacagactgtgagggtactgtgccaggagaccaacctgggccttcctgagctgctcatcccctcctctgcgtaactcagtcctacggagaggcacatttatctacagctagagaaactgagggccagagaaaggagaattcaaggccagacagataatggtaaagtgaagatagggacttaggcctcctggcttcccctcgcccacccttagcaataagtgccaccatttgtttacatattgctttttccttcccctttttaattgaaaaaccatctgctcactgggcacggtggcccacgtatgccctagctactccagagtctgaggagggaggatcccttgagcccaggagttcaaggccagcctgggaaatcctgtctctaaaaagagaaagagagaaagaaagcatgcatctcctgagtgcgctgtgttgcaagccctcttctcgggctccaggcccagtgcgatgactgagcacggtcaaagcaagcagccacccacccttgtcccggtgctgacccctctgctctcccgcaggctccatcctggaaaacttcagtggcagtgggggcggcgggcccgcggggctgctgccgaacccgcggctgtcggagctgtccgcgagcgaggtgaccatgctgagccagctgcaggagcgccgcgacagctccaccagcacggtcagctcggcctacaccgtgagccgccgctcctccggcatctccccctacttctccagccgccgctccagcgaggcctcgcccctgggccgccggccgcccgcgacaacgcgagctccgctgactcctacgaccccatctccacggacgcgtcgcggcgctcgagcgaggccagccagtgcagcggcggctccgggctgctcaacctcacgccggcgcacgagtacagcctgcgtgccaagtacgcggcagcactggcgtgcccctcgccactccgctgccgggcctggagcgcatgagactgcgaaccaggctggcgctgctggacgcgctcgagcaacgctgcccgccggctgcccacgcccactgggccgcggcgtggcagcgacgggccgacctatggccacggccacgcgggggctgcgcgcgcttcccccacgaggctccaggcggcggagccaggcgggccagcgaccctgtgcggcggcccgatgccctgtccctgccgcgggtgcagcgcttccacagcacccacaacgtgaaccccggcccgctgccgccctgtgccgacaggcgaggcctccgcctgcagagccacccgagcaccgacggcggcctggcccgcggcgcctactcgccccggccgcctagcatcagcgagaacgtggcgatggaggccgtggcggcaggagtggacggcgcggggcccgaggccgacctggggctgccggaggacgacctggtgcttccagacgacgtggtgcagtacatcaaggcgcacgccagtggcgctctggacgagggcaccgggcaggtgtatcccacggaaagcactggcttctctgacaaccccagactacccagcccggggctgcacggccagcgcaggatggtggctgcggactccaacgtgggcccctccgcccctatgctgggaggatgccagttaggctttggggcgccctccagcctgaacaaaaataacatgcctgtgcagtggaatgaggtgagctccggcaccgtagactccctggccagccaggtgaagcctccaccctttcctcagggcaacctggcggtggtgcagcagaagcctgcctttggccagtacccgggctacagtccgcaaggcctacaggctagccctgggggcctggacagcacgcagccacacctgcagccccgcagcggagccccctcccagggcatccccagggtaaactacatgcagcagctgcgacagccagtggcaggcagccagtgtcctggcatgactaccactatgagcccccatgcctgctatggccaagtccacccccagctgagccccagcaccatcagtggggccctcaaccagttcccccaatcctgcagcaacatgccagccaagccagggcatctggggcaccctcagcagacagaagtggcacctgaccccaccacgatgggcaatcgccacagggaacttggggtccccaattcagccctggctggagtgccgccacctcacccagtccagagctacccacagcagagccatcacctggcagcctccatgagccaggagggctaccaccaggtccccagccttctgcctgcccgccagcctggcttcatggagccccaaacaggcccgatgggggtggctacagcaggctttggcctagtgcagccccggcctcccctcgagcccagccccactggccgccaccgtggggtacgtgctgtgcagcagcagctggcctacgccagggccacaggccatgccatggctgccatgccgtccagtcaggaaacagcagaggctgtgcccaagggagcgatgggcaacatggggtcggtgcctccccagccgcctccgcaggacgcaggtggggccccggaccacagcatgctctactactacggccagatccacatgtacgaacaggatggaggcctggagaacctcgggagctgccaggtcatgcggtcccagccaccacagccacaggcctgtcaggacagcatccagccccagcccttgccctcaccaggggtcaaccaggtgtccagcactgtggactcccagctcctggaggccccccagattgacttcgatgccatcatggatgatggcgatcactcgagtttgttctcgggtgctctgagccccagcctcctccacagcctctcccagaactcctcccgcctcaccaccccccgaaactccttgaccctgccctccatccccgcaggcatcagcaacatggctgtcggggacatgagctccatgctcaccagcctcgccgaggagagcaagttcctgaacatgatgacctagaggcccgagcgcctggtgctgagtgcacccggaggggtcatcgctgcccagagcctggggattccagctgtcttgtctttttccaaaaaagtgttaaataggcttgaggggttgttgcgcaatggccgcttcagatgacagatgttgtaagagaaggtttatgggcatcctctctggtcttttggattattcctcagaacaatgaaaaaagtctccataggacaggaaggaatgcaaaactcatttacacagtgctttccagcctttggtgcttacaggaccgcgctgttccggcttcttcacggctgacattcggctaacgagggattactttggccaaaacctttcaaaggatatgcagaaagatggtagggagcatttgggtttgaatctgaatgctatactggatactctgctccggaaagatgagctttttattctactacttggaaggaaaaggaattcctggtccacctgaattcctctatgaagcctaactcttgaggtctctaacataccttgtcatagaggaaaagcacagattatacctggatgattcaggagcacattctgattccaggtttggtagagctggctcttctactccgtaaagccgagtctgggactggcagcccatccaagtgtatatgaatgaataaagcatccaagtatatatgaatgaataaagtatgtaagtatcaccagaaaaaggaaagaaaaaatgtactccttggggcaagcccagaagctgccctggcctctccagaccgtgtttacagtgtttgcatgtagaatgtagcccttcctgaaaagaagacttgtttctaaatacctcggggctgctggagccgctgtgggttagggatggactgaggcctcgaggagtgagggtgcacccggggcccagcctcaggctgccctagggatctctcagtaggaagaggaagttgcgtgtttacccaatcctgtttctccaatgcaacgtccacccactttaccaccaaaaactccagggcctgacggcagcccggtcccccagcactcaccagcagcccagtgttctccaccaagccacagtgtgcatgcctggtatcctccggattcccttccttctgcccgctgagtcactgggcagagaatgatgacatgtgtaggtggtgtggttgggggtggaaaggggaaggggttgatcctcaggactctgagggagcatcgttgaattttcctgttcagtgtgaccaagacccacctggaaatggaatttggaactggcttcaggagacatcattcctgaacacactgtagggtgaattggtgcatcttccccaccatacacacacacacacacacacacacacacacacacacacacacacacacaccccaaaccttttcatggggaatgtgtggcaaccttgccaaacagcaccactcagagtgtgactctgactgtgaccttggccttaatgaggaacttcttaggagagtttgaggacaaggccaacatcgtcatctgggctcgctgcgtcccagcacatcaaactctgtccagagacaaggccaactgcaaatgaaagccagggaacattgctaagggtctgtggctctgtggtggtgttcatcgccttcctgagataggatttcccttgccagtcccaacctgtatatattctgtacagaagacatccctgaatatactgtaggtgagtcgtccagccaaatttatatctccaaaacatttttagctttttctacatgctatgaattgagatgacatgctcaacttgtaaataagtctttttgtacattaaaaaagtaattttttcataatttatcttgtctatctgcttcccccttgacagtagttaatgagaacctgggcagtaaatttggtgcattcgagcagaaattaggctgtattttttcttaacagtgtcaaaattgactatcccgcctttgccaagaaatgtttaatgctgaggcatttactggctgtttgtttgttgtctccttggggccgggcagggtttgacatttcacagtgaatatctgactgctcttccggtgagccactctgaacatctatatgcattgcagaccggggtatagacccaaacactcctagggtcagaaccctccctttggtgggccctctgatggagcatatttcatcagggtggggcggggtgagatgggcaaacccccaaggctctggtgcaggtagaaggagtcagggcaggcaggtggcacctccaggatgcccagcagttggccttggcaaaggggcccatggggagcaaccacgagcaggggctctgagctctagggggccgcccagcaggtggacagggaaagcctgggtccagtgggcagacagtcagctgttggcccctacagtaaacctcagggagcccttgaatgagtcatgaggccccatctgggggtagggccagagacggagcagggagcagagccccaggactgaactagaggggaagagggcactttctaagggccaggcacccgggcctctgaacaccgagcccagagccctttaccctctcctctccaggagagaagccttagcacgcaggctgggcagtgtggacaccaaagacacatgggacatcatctttgcctggaaggcatgagacacatggaccggggaagggttttgtggtcagacacttgcaggaaacccccaa

SEQ ID NO: 14517 - DNA, 203475 bp, Human; identical to SEQ ID NO: 14516
  misc_feature (1)...(203475): n = A,T,C or G

SEQ ID NO: 14518 - DNA, 203475 bp, Human; identical to SEQ ID NO: 14516
  misc_feature (1)...(203475): n = A,T,C or G

SEQ ID NO: 14519 - DNA, 203475 bp, Human; identical to SEQ ID NO: 14516
  misc_feature (1)...(203475): n = A,T,C or G

SEQ ID NO: 14520 - DNA, 4992 bp, Human
gtgctgggattacaggcgtgagccaccgtgctcagctgagagggatatttcttgatgtgttttcaagattgagctgatggggcctgaacgtccgagatgaggggaatagcagtgcaggtgatggtggcaccacctacagagcggggatgatagaatagaagtggccagataaaggctgcaggagaagtcttgggagttgggagagcaggtcggggtccatggtcaggggttgatcttctctggtccagaaaagtcctctctggctgggcgtggtggctcacgcctgtaatcccagcactttgggaggccgaggcagggggatcatgaggtcaggagatcgagaccatcctggctaacatggtgaaaccccgtctctactaaaaatacaaaaaattagccgggcatggtggtgggcacttgtagtcccagctactcgggaggctgaggcagaagaatggcgtgaactgggaggcggagtttgcagtgagctgagattgcaccactgcactccagcctggagcgacagagtgagactccgtctcaaaaaaaaaaaaaaaaaaaaaagaaaagtcctctctggggaagtgacatttgccctgagagctgaagggtaagaatttgcttcgtcgaggcctgtttaggcggaaacaggagtacatgaagaagtcccgaggcaggaagaatttgatgggaatttaaaaaattaaaaaaaaaaaaaaaaatggggctgggcatggtggctcacacctgtaatcccggcactttgggaggctgaggcatgcggatcacctaaggccaggagtttgagaccagcctgaccaacatggtgaaaccttgtctgcactaaaaattcaaaaaaaaaaaaaaaaatagcccggtgtggtggcggatgcctgtaataccagctgcttaggaggctcaggcaggaggatcacttaaatctgggaggcggaggttgcaatgagccgagactgcactattgtactccagcctgggcaacaagatcaaaactctatctcaaaaaaaaaaaaaaaaattagccaggcatgttggcaggcacctgtaatcccaaccctttgggaggctggggcaggagaattgcttgaacccagaaggcaaagctttcagtgagccgagattgcgccactgcactccatcctgggtgtcagagcaagactccatcttaaaaaaaaaaaatggaagcagctcagcgaggcacaaaacaggaagtggaaaggtggagtgaggtcaggccaaagcctgcacacagggcttgtgggctgcactgtgccttcgggtcttcatcctgagggtactggggagccacagaaggctcaggggtggggcagttgagagtaacattatcttgtttacaattttattttttttatttatttattttttgagacggattcttgctctattgtccaggctggcgtgaaatggcgtgatctgggctcactgcaacctctgcctcctgggttcaagcgattcacctgcctcagcatcccaaggagctgggattacaggtgcctgccaccacacccagctaatttttgtatttatttattttgagatggagttttgctcttgttgcccaggctggagtgcaatggcgcaacctcggctcactgcaacctccgcctcccgggttcaagcaattctcctgcctcagactcccaagtagctgggattacaggcatgtgccaccacgcccggctaattttgtatttttagtagagatggcattactccgtattggtcaggctggtcttgaactcccgacctcaagtgatccgcctgccttggcctcccaaagtgctgggattacaggcatgagccgccgcacctggccatgtttacaatttttgaagccgacttcaattgtgggtggcagaaatctttgaggggaggcaaagaattgacaaaggaggtttggggccactatctccaggcagtggggacaaggttcagtccctaacgcccactccactccccacaggccctgtgcaccaaggtgccggaactgatcagaaccatcatgggctggacattggacttcctccgggagcggctgttgggctggatccaagaccagggtggttgggtgagactcctcaagcctcctcacccccaccaccgcgccctcaccaccgcccctgccccaccgtccctgccccccgccactcctctgggaccctgggccttctggagcaggtcacagtggtgccctctccccatcttcagatcatcagatgtggtctataatgcgttttccttacgtgtctgatcaatccccgattcatctaccctgctgacctcccagtgacccctgacctcactgtgaccttgacttgattagtgccttctgccctccctggagcctccactgcctctggaattgctcaagttcattgatgaccctctgaccctagctctttcctttttttttttttccccactgagaaggggtctcgctatgttgcccaggttggtctcgaactcctggcctcaagcgatcctcccgcctcagcctctcaaagtgctgggattacaggtgtgagccaccatgcctggcctgagtccagctctttaatgcccgttcatctcagtcccctgcccgcaatcctgccttctggcctcctccgtccctgatcccgcctctgcctgcccaggggctgcccctggccgagtcactgaagcgactgatgtccctgtctccaggacggcctcctctcctactttgggacgcccacgtggcagaccgtgaccatctttgtggcgggagtgctcaccgcctcactcaccatctggaagaagatgggctgaggcccccagctgccttggactgtgtttttcctccataaattatggcatttttctgggaggggtggggattgggggacatgggcatttttcttacttttgtaattattggggggtgtggggaagagtggtcttgagggggtaataaacctccttcgggacacacttcggcatctgagtcactgggcctctgccccgctccccggcacgtcaggagagcaggccctgtccgctgccccacgccgggcccgccgtctgctggcctagagatacctgcttgggccactcagggacgtggggctctctgcactcacttgacatctttttctggggtgccctgtggggtctgtgggttagggatgagttggtcctgggcctgacctgcaggagctcacgggaaaggaaaagaagggagctcacgggaaaggaaaagggagctcacgggaaacgagggtgataggtggtacatctgtcgcagcccaggatgatctgtgcgggacagaggcagcggcctgtgaggcccaagcaggcgtgtgggtaagggaagaacagcacggccggctgcagagcaagcctcctcggcccggggaccacagcctggcgtgtcacacgtgggacctcaggaggccatacctttaccgagctggagaatgggagtggggggaggagggatgggaggaccagaggagcaggaagggctctggagcctggtggtgaggtcgctggagggtggcaggctgaggacaccagggcgagggcccacgggagaggcctcctgagctgggctgaggacagagaggaagggacctggctggcgactgagaggctggagggcagggcagaggaggaggaacctggtctggccccacagctgggtggggcccccctggagaggaactgccggaagaaggtgctgagctcagaggcccagtgaccttagacacaggcggagcgaagacaagggggctagaggatgtgggttctcagtcacagggtctctggcacccccctctgggtctttaccccctcccatctctgggtctctgtccccatgctctgggtctttgctttccgagcctctgttcccaccccacctttggccctctttctctgggcctctttccacccctggcacccagacctctggccccctctctctgggtctctgtccccccctctggatctctggccccccatctctctctgggtctgtcccccgaccctgagtttctgtctccctctctctgggtctctgtcctctctctggctgtcactctctcttgggtctctgtacctcccctctctctgggtctctttccctctccccggtctctgtcccccgcccccgggtccctgtcccccccccccaggtctcagtcctccctagtctctgtccccttctgagtccctgtcccccctctctctgggtctctgtacccccttctctggatctctgtccccacctctctctggatctctgtcccccactctggatttctgtcccctcccgccgggtccctctgggtctctatcccccccacccctgggtctctgtacctccctgcctctgtccccccccacctctgtccccccctctctctgggtctcttttcccctccctctgggtctctgcccccctctctctaggtctgtccccctcccctctctctcagggtctctgtacccctctgtctccgggtctgttttcccctctctctgggtctctgtccccctctctctcagggtctctgtctgagtctctttttctctgggcctctgtctccccaccccacgttctctatggtcttcagatcctgtctctctcagcccctcctctccctccacctatgggccccaaggcccctctcggccgactaaaggtctctgggctgaggtatgacatttggtaaatgagtaactcgggccccacagtcaacggggtgctttggacggctgcccctcctccatggactcttcccagagaccccaagtcaggggagagagaggggcagaggatcaatgagtgtacactgagccaccacccagagtgaggggacaatatggccacaggcaggatcccagaaaaaaaaaaattatgggaaccaaaaagacacggagacaaagcacacagccggcttccaacaaggggggaccttggggtagggg

SEQ ID NO: 14521 - DNA, 5637 bp, Human
ctcgccacccctgtgtccacctgcagagttatgcagtggtccccaactagggcccctgccaccctcattcctaagggaggctggagacttcttccatggccgaaaatccacatctaagtccccggcactagcaaaaaggccctgtcatgggggctccctgccccagttgagattggaggaacatggaagaagctaaaataactaattaactcagtagcatcacactacctgctctggagaaaaaaaaatttaatattattattttttgttttttgagatggagttctgctctgctgcacaggctggagtgcagtggcgcaatcttggctcacggcaacctctgcctcctgggttcaagtgattctcccgcctcagcctcccgagtagttgggattacaggctcatgccaccacgcccagctaatttttgtacttttagtagagatggagttttgccatgttggctagtctggccttgaactcctgacctcaagtgatccacccacctcaaagccacccaaagtttggggattacaagcgtgagccactgtgtccggcctggagaaaggactttaaatgacgcaatgtaggaagagcaaggttgtggagatctgctgccctggctgaggtagctcatgcaatcagtctctctgagccacagtctcttgatctgtgaaatcggaagaaaataatacctccttcacaagacaagtggcaggtcagatgtgagaatgcacaggcaggccctcggcaactggaaaagctctatacagatctgaaaaggaggaggagaaaaaagaggaggggcttccatggctggacagggcatctttctttttctttttctttttttttttttttttttttttgaggtggagtcttgctctgttgccaaggttggagtgcagcagcacgatctccgctcactgcaagctctgcctcccggattcacgccattctcctgcctcagcctcccgagtagctgggaatacaggcgcccgccactacgcccagctaacttttttgcatttttagtacagagtggatttcacctggttagccaagatggtcttgatctactgacctcgtgatccgcccgcctcggcctcccaaagtgctgggattacaggcatgagccaccgcgcccagcctgatagagcatctttcggcgtgatgtgttctgagttccaaagctgaggaagagactcaaatcttcaagagctcttctaactttgagattctctgatggtttcagggctatgggaggaagagcttgtggtccgtgtctgctcccgggatttctgtttcttggtttgtgtctctgctgcaagtccaaggagctggggcaataccttgagtctgggttcttcgtccccagggacctgggggagccccagcaatgctcagggaaaggggagagcaaagtgtggggttggttctctctagtggtcagtgttggaactgcatccagctgactcaggctgacccaggagtcctcagcagaagtggaattcaggactgaatcgtgctcacaacccccacaatctattggctgtgcttggccccttttcccaacacacacattctgtctggtgggtggaggttaaacatgcggggaggaggaaagggataggatagagaatgggatgtggtcggtagggggtctcaaggactggctatcctgacatccttcgccgcgtgcaggttggccaccatggcctgctgccagagggcacccacgtgacccttaaagagaggacaagttgggtggtatctctggctgacactctgtgcacaaccctcacaacactggtgacggtgggaagggaaagatgacaagccagggggcatgatcccagcatgtgtgggaggagcttctaaattatccattagcacaagcccgtcagtggccccatgcataaatgtacacagaaacaggtgggggcaacagtgggagagaaggggccagggtataaaaagggcccacaagagaccggctcaaggatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaaaaacaaacagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccgtgagtggatgccttctccccaggcggggatgggggagacctgtagtcagagcccccgggcagcacagccaatgcccgtccttcccctgcagaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatgggggtgagggtggcgccaggggtccccaatcctggagccccactgactttgagagctgtgttagagaaacactgctgccctctttttagcagtcaggccctgacccaagagaactcaccttattcttcatttcccctcgtgaatcctccaggcctttctctacaccctgaaggggagggaggaaaatgaatgaatgagaaagggagggaacagtacccaagcgcttggcctctccttctcttccttcactttgcagaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgtttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgaagttaccttgtgttcaattccccccatcttcattgaacatcctctgtgcagggacttgacccctgtcctgctagctttgcactgaggcaagttttgtccatgcctagtagtgccaccatctttactagatgaggtttctaaagagcttggcatggaaggaaagcctggggggccttagaagccatcacttaggaactgggagagctccaggcaagccaccttatctctttgggcctcagtatcctcactcacatccccatggtcagtagagtgccaagcacatggtggacacgcagaagtattgatcatcttcctcacctcccctaggagagcccttgggaatccccatataatattctctgaagacctcaatccaatgagccaagtaattgactcggtagcaaactcatggaaaggacattagaagccaaaaggaggtagagtatgtcccagtacaataaccagcctctgatctcaaggaagaaagaacagagctgcaggtgagaagtgtgcgcctcaaatcaccaaagtgagagtggaaggagcacccaccagtcccttggaggcgatccctaagaccggtgagaatggcttcgaaaaatgtgat

SEQ ID NO: 14522 - DNA, 5637 bp, Human; identical to SEQ ID NO: 14521

SEQ ID NO: 14523 - DNA, 5637 bp, Human; identical to SEQ ID NO: 14521

SEQ ID NO: 14524 - DNA, 5637 bp, Human; identical to SEQ ID NO: 14521

SEQ ID NO: 14525 - DNA, 5637 bp, Human; identical to SEQ ID NO: 14521

SEQ ID NO: 14526 - DNA, 5636 bp, Human
ctcgccacccctgtgtccacctgcagagttatgcagtggtccccaactagggcccctgccaccctcattcctaagggaggctggagacttcttccatggccgaaaatccacatctaagtccccggcactagcaaaaaggccctgtcatgggggctccctgccccagttgagattggaggaacatggaagaagctaaaataactaattaactcagtagcatcacactacctgctctggagaaaaaaaaatttaatattattattttttgttttttgagatggagttctgctctgctgcacaggctggagtgcagtggcgcaatcttggctcacggcaacctctgcctcctgggttcaagtgattctcccgcctcagcctcccgagtagttgggattacaggctcatgccaccacgcccagctaatttttgtacttttagtagagatggagttttgccatgttggctagtctggccttgaactcctgacctcaagtgatccacccacctcaaagccacccaaagtttggggattacaagcgtgagccactgtgtccggcctggagaaaggactttaaatgacgcaatgtaggaagagcaaggttgtggagatctgctgccctggctgaggtagctcatgcaatcagtctctctgagccacagtctcttgatctgtgaaatcggaagaaaataatacctccttcacaagacaagtggcaggtcagatgtgagaatgcacaggcaggccctcggcaactggaaaagctctatacagatctgaaaaggaggaggagaaaaaagaggaggggcttccatggctggacagggcatctttctttttctttttctttttttttttttttttttttttgaggtggagtcttgctctgttgccaaggttggagtgcagcagcacgatctccgctcactgcaagctctgcctcccggattcacgccattctcctgcctcagcctcccgagtagctgggaatacaggcgcccgccactacgcccagctaacttttttgcatttttagtacagagtggatttcacctggttagccaagatggtcttgatctactgacctcgtgatccgcccgcctcggcctcccaaagtgctgggattacaggcatgagccaccgcgcccagcctgatagagcatctttcggcgtgatgtgttctgagttccaaagctgaggaagagactcaaatcttcaagagctcttctaactttgagattctctgatggtttcagggctatgggaggaagagcttgtggtccgtgtctgctcccgggatttctgtttcttggtttgtgtctctgctgcaagtccaaggagctggggcaataccttgagtctgggttcttcgtccccagggacctgggggagccccagcaatgctcagggaaaggggagagcaaagtgtggggttggttctctctagtggtcagtgttggaactgcatccagctgactcaggctgacccaggagtcctcagcagaagtggaattcaggactgaatcgtgctcacaacccccacaatctattggctgtgcttggccccttttcccaacacacacattctgtctggtgggtggaggttaaacatgcggggaggaggaaagggataggatagagaatgggatgtggtcggtagggggtctcaaggactggctatcctgacatccttcgccgcgtgcaggttggccaccatggcctgctgccagagggcacccacgtgacccttaaagagaggacaagttgggtggtatctctggctgacactctgtgcacaaccctcacaacactggtgacggtgggaagggaaagatgacaagccagggggcatgatcccagcatgtgtgggaggagcttctaaattatccattagcacaagcccgtcagtggccccatgcataaatgtacacagaaacaggtgggggcaacagtgggagagaaggggccagggtataaaaagggcccacaagagaccggctcaaggatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaaaaacaaacagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccgtgagtggatgccttctccccaggcggggatgggggagacctgtagtcagagcccccgggcagcacagccaatgcccgtccttcccctgcagaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatgggggtgagggtggcgccaggggtccccaatcctggagccccactgactttgagagctgtgttagagaaacactgctgccctctttttagcagtcaggccctgacccaagagaactcaccttattcttcatttcccctcgtgaatcctccaggcctttctctacaccctgaaggggagggaggaaaatgaatgaatgagaaagggagggaacagtacccaagcgcttggcctctccttctcttccttcactttgcagaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgtttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgaagttaccttgtgttcaattccccccatcttcattgaacatcctctgtgcagggacttgacccctgtcctgctagctttgcactgaggcaagttttgtccatgcctagtagtgccaccatctttactagatgaggtttctaaagagcttggcatggaaggaaagcctggggggccttagaagccatcacttaggaactgggagagctccaggcaagccaccttatctctttgggcctcagtatcctcactcacatccccatggtcagtagagtgccaagcacatggtggacacgcagaagtattgatcatcttcctcacctcccctaggagagcccttgggaatccccatataatattctctgaagacctcaatccaatgagccaagtaattgactcggtagcaaactcatggaaaggacattagaagccaaaaggaggtagagtatgtcccagtacaataaccagcctctgatctcaaggaagaaagaacagagctgcaggtgagaagtgtgcgcctcaaatcaccaaagtgagagtggaaggagcacccaccagtcccttggaggcgatccctaagaccggtgagaatggcttcgaaaaatgtga

SEQ ID NO: 14527 - DNA, 5636 bp, Human; identical to SEQ ID NO: 14526

SEQ ID NO: 14528 - DNA, 5636 bp, Human; identical to SEQ ID NO: 14526

SEQ ID NO: 14529 - DNA, 5636 bp, Human; identical to SEQ ID NO: 14526

SEQ ID NO: 14530 - DNA, 5636 bp, Human; identical to SEQ ID NO: 14526

SEQ ID NO: 14531 - DNA, 5693 bp, Human
ctcccctgccctggctggtcccacgtgttcatggcagtaacctgtctggggagcctcgccacccctgtgtccacctgcagagttatgcagtggtccccaactagggcccctgccaccctcattcctaagggaggctggagacttcttccatggccgaaaatccacatctaagtccccggcactagcaaaaaggccctgtcatgggggctccctgccccagttgagattggaggaacatggaagaagctaaaataactaattaactcagtagcatcacactacctgctctggagaaaaaaaaatttaatattattattttttgttttttgagatggagttctgctctgctgcacaggctggagtgcagtggcgcaatcttggctcacggcaacctctgcctcctgggttcaagtgattctcccgcctcagcctcccgagtagttgggattacaggctcatgccaccacgcccagctaatttttgtacttttagtagagatggagttttgccatgttggctagtctggccttgaactcctgacctcaagtgatccacccacctcaaagccacccaaagtttggggattacaagcgtgagccactgtgtccggcctggagaaaggactttaaatgacgcaatgtaggaagagcaaggttgtggagatctgctgccctggctgaggtagctcatgcaatcagtctctctgagccacagtctcttgatctgtgaaatcggaagaaaataatacctccttcacaagacaagtggcaggtcagatgtgagaatgcacaggcaggccctcggcaactggaaaagctctatacagatctgaaaaggaggaggagaaaaaagaggaggggcttccatggctggacagggcatctttctttttctttttctttttttttttttttttttttttgaggtggagtcttgctctgttgccaaggttggagtgcagcagcacgatctccgctcactgcaagctctgcctcccggattcacgccattctcctgcctcagcctcccgagtagctgggaatacaggcgcccgccactacgcccagctaacttttttgcatttttagtacagagtggatttcacctggttagccaagatggtcttgatctactgacctcgtgatccgcccgcctcggcctcccaaagtgctgggattacaggcatgagccaccgcgcccagcctgatagagcatctttcggcgtgatgtgttctgagttccaaagctgaggaagagactcaaatcttcaagagctcttctaactttgagattctctgatggtttcagggctatgggaggaagagcttgtggtccgtgtctgctcccgggatttctgtttcttggtttgtgtctctgctgcaagtccaaggagctggggcaataccttgagtctgggttcttcgtccccagggacctgggggagccccagcaatgctcagggaaaggggagagcaaagtgtggggttggttctctctagtggtcagtgttggaactgcatccagctgactcaggctgacccaggagtcctcagcagaagtggaattcaggactgaatcgtgctcacaacccccacaatctattggctgtgcttggccccttttcccaacacacacattctgtctggtgggtggaggttaaacatgcggggaggaggaaagggataggatagagaatgggatgtggtcggtagggggtctcaaggactggctatcctgacatccttcgccgcgtgcaggttggccaccatggcctgctgccagagggcacccacgtgacccttaaagagaggacaagttgggtggtatctctggctgacactctgtgcacaaccctcacaacactggtgacggtgggaagggaaagatgacaagccagggggcatgatcccagcatgtgtgggaggagcttctaaattatccattagcacaagcccgtcagtggccccatgcataaatgtacacagaaacaggtgggggcaacagtgggagagaaggggccagggtataaaaagggcccacaagagaccggctcaaggatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaaaaacaaacagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccgtgagtggatgccttctccccaggcggggatgggggagacctgtagtcagagcccccgggcagcacagccaatgcccgtccttcccctgcagaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatgggggtgagggtggcgccaggggtccccaatcctggagccccactgactttgagagctgtgttagagaaacactgctgccctctttttagcagtcaggccctgacccaagagaactcaccttattcttcatttcccctcgtgaatcctccaggcctttctctacaccctgaaggggagggaggaaaatgaatgaatgagaaagggagggaacagtacccaagcgcttggcctctccttctcttccttcactttgcagaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgtttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgaagttaccttgtgttcaattccccccatcttcattgaacatcctctgtgcagggacttgacccctgtcctgctagctttgcactgaggcaagttttgtccatgcctagtagtgccaccatctttactagatgaggtttctaaagagcttggcatggaaggaaagcctggggggccttagaagccatcacttaggaactgggagagctccaggcaagccaccttatctctttgggcctcagtatcctcactcacatccccatggtcagtagagtgccaagcacatggtggacacgcagaagtattgatcatcttcctcacctcccctaggagagcccttgggaatccccatataatattctctgaagacctcaatccaatgagccaagtaattgactcggtagcaaactcatggaaaggacattagaagccaaaaggaggtagagtatgtcccagtacaataaccagcctctgatctcaaggaagaaagaacagagctgcaggtgagaagtgtgcgcctcaaatcaccaaagtgagagtggaaggagcacccaccagtcccttggaggcgatccctaagaccggtgagaatggcttcgaaaaatgtgatcg

SEQ ID NO: 14532 - DNA, 5693 bp, Human; identical to SEQ ID NO: 14531

SEQ ID NO: 14533 - DNA, 5693 bp, Human; identical to SEQ ID NO: 14531

SEQ ID NO: 14534 - DNA, 5693 bp, Human; identical to SEQ ID NO: 14531

SEQ ID NO: 14535 - DNA, 5693 bp, Human; identical to SEQ ID NO: 14531

SEQ ID NO: 14536 - DNA, 5692 bp, Human
tcccctgccctggctggtcccacgtgttcatggcagtaacctgtctggggagcctcgccacccctgtgtccacctgcagagttatgcagtggtccccaactagggcccctgccaccctcattcctaagggaggctggagacttcttccatggccgaaaatccacatctaagtccccggcactagcaaaaaggccctgtcatgggggctccctgccccagttgagattggaggaacatggaagaagctaaaataactaattaactcagtagcatcacactacctgctctggagaaaaaaaaatttaatattattattttttgttttttgagatggagttctgctctgctgcacaggctggagtgcagtggcgcaatcttggctcacggcaacctctgcctcctgggttcaagtgattctcccgcctcagcctcccgagtagttgggattacaggctcatgccaccacgcccagctaatttttgtacttttagtagagatggagttttgccatgttggctagtctggccttgaactcctgacctcaagtgatccacccacctcaaagccacccaaagtttggggattacaagcgtgagccactgtgtccggcctggagaaaggactttaaatgacgcaatgtaggaagagcaaggttgtggagatctgctgccctggctgaggtagctcatgcaatcagtctctctgagccacagtctcttgatctgtgaaatcggaagaaaataatacctccttcacaagacaagtggcaggtcagatgtgagaatgcacaggcaggccctcggcaactggaaaagctctatacagatctgaaaaggaggaggagaaaaaagaggaggggcttccatggctggacagggcatctttctttttctttttctttttttttttttttttttttttgaggtggagtcttgctctgttgccaaggttggagtgcagcagcacgatctccgctcactgcaagctctgcctcccggattcacgccattctcctgcctcagcctcccgagtagctgggaatacaggcgcccgccactacgcccagctaacttttttgcatttttagtacagagtggatttcacctggttagccaagatggtcttgatctactgacctcgtgatccgcccgcctcggcctcccaaagtgctgggattacaggcatgagccaccgcgcccagcctgatagagcatctttcggcgtgatgtgttctgagttccaaagctgaggaagagactcaaatcttcaagagctcttctaactttgagattctctgatggtttcagggctatgggaggaagagcttgtggtccgtgtctgctcccgggatttctgtttcttggtttgtgtctctgctgcaagtccaaggagctggggcaataccttgagtctgggttcttcgtccccagggacctgggggagccccagcaatgctcagggaaaggggagagcaaagtgtggggttggttctctctagtggtcagtgttggaactgcatccagctgactcaggctgacccaggagtcctcagcagaagtggaattcaggactgaatcgtgctcacaacccccacaatctattggctgtgcttggccccttttcccaacacacacattctgtctggtgggtggaggttaaacatgcggggaggaggaaagggataggatagagaatgggatgtggtcggtagggggtctcaaggactggctatcctgacatccttcgccgcgtgcaggttggccaccatggcctgctgccagagggcacccacgtgacccttaaagagaggacaagttgggtggtatctctggctgacactctgtgcacaaccctcacaacactggtgacggtgggaagggaaagatgacaagccagggggcatgatcccagcatgtgtgggaggagcttctaaattatccattagcacaagcccgtcagtggccccatgcataaatgtacacagaaacaggtgggggcaacagtgggagagaaggggccagggtataaaaagggcccacaagagaccggctcaaggatcccaaggcccaactccccgaaccactcagggtcctgtggacagctcacctagctgcaatggctacaggtaagcgcccctaaaatccctttgggcacaatgtgtcctgaggggagaggcagcgacctgtagatgggacgggggcactaaccctcaggtttggggcttctgaatgtgagtatcgccatgtaagcccagtatttggccaatctcagaaagctcctggtccctggagggatggagagagaaaaacaaacagctcctggagcagggagagtgctggcctcttgctctccggctccctctgttgccctctggtttctccccaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgtaagctcttggggaatgggtgcgcatcaggggtggcaggaaggggtgactttcccccgctgggaaataagaggaggagactaaggagctcagggtttttcccgaagcgaaaatgcaggcagatgagcacacgctgagtgaggttcccagaaaagtaacaatgggagctggtctccagcgtagaccttggtgggcggtccttctcctaggaagaagcctatatcccaaaggaacagaagtattcattcctgcagaacccccagacctccctctgtttctcagagtctattccgacaccctccaacagggaggaaacacaacagaaatccgtgagtggatgccttctccccaggcggggatgggggagacctgtagtcagagcccccgggcagcacagccaatgcccgtccttcccctgcagaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatgggggtgagggtggcgccaggggtccccaatcctggagccccactgactttgagagctgtgttagagaaacactgctgccctctttttagcagtcaggccctgacccaagagaactcaccttattcttcatttcccctcgtgaatcctccaggcctttctctacaccctgaaggggagggaggaaaatgaatgaatgagaaagggagggaacagtacccaagcgcttggcctctccttctcttccttcactttgcagaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagctgcccgggtggcatccctgtgacccctccccagtgcctctcctggccctggaagttgccactccagtgcccaccagccttgtcctaataaaattaagttgcatcattttgtctgactaggtgtccttctataatattatggggtggaggggggtggtatggagcaaggggcaagttgggaagacaacctgtagggcctgcggggtctattgggaaccaagctggagtgcagtggcacaatcttggctcactgcaatctccgcctcctgggttcaagcgattctcctgcctcagcctcccgagttgttgggattccaggcatgcatgaccaggctcagctaatttttgtttttttggtagagacggggtttcaccatattggccaggctggtctccaactcctaatctcaggtgatctacccaccttggcctcccaaattgctgggattacaggcgtgaaccactgctcccttccctgtccttctgattttaaaataactataccagcaggaggacgtccagacacagcataggctacctggccatgcccaaccggtgggacatttgagttgtttgcttggcactgtcctctcatgcgttgggtccactcagtagatgcctgttgaattcctgggcctagggctgtgccagctgcctcgtcccgtcaccttctggcttcttctctccctccatatcttagctgttttcctcatgagaatgttccaaattcgaaatttctatttaaccattatatatttacttgtttgctattatctctgcccccagtagattgttagctccagaagagaaaggatcatgtcttttgcttatctagatatgcccatctgcctggtacaatctctggcacatgttacaggcaacaactacttgtggaattggtgaatgcatgaatagaagaatgagtgaatgaatgaatagacaaaaggcagaaatccagcctcaaagagcttacagtctggtaagaggaataaaatgtctgcaaatagccacaggacaggtcaaaggaaggaggggctatttccagctgagggcaccccatcaggaaagcaccccagacttcctacaactactagacacatctcgatgcttttcacttctctatcaatggatcgtctccctggagaataatccccaaagtgaaattacttagcacgtccagttaggtagatccttgtgtacttcttggttgttcagagatcatcaaccagtgcaaacaatccccccatcaatacacagcagtgcctgcccctctccccccgaggtcttccgaggcccttcctccgtgcctgaaccccctggacatatcatatggcaaactgaagtgtccaacgagatataggaagtgaaacacgatgtacactgaaacgtgcaatacaaatatgcagcatgaagtgcctcggttcactaacccgagctacgctgggtgcttcttttctaccactttccttaatgcctatggacacctcattctgtggctgaagttaccttgtgttcaattccccccatcttcattgaacatcctctgtgcagggacttgacccctgtcctgctagctttgcactgaggcaagttttgtccatgcctagtagtgccaccatctttactagatgaggtttctaaagagcttggcatggaaggaaagcctggggggccttagaagccatcacttaggaactgggagagctccaggcaagccaccttatctctttgggcctcagtatcctcactcacatccccatggtcagtagagtgccaagcacatggtggacacgcagaagtattgatcatcttcctcacctcccctaggagagcccttgggaatccccatataatattctctgaagacctcaatccaatgagccaagtaattgactcggtagcaaactcatggaaaggacattagaagccaaaaggaggtagagtatgtcccagtacaataaccagcctctgatctcaaggaagaaagaacagagctgcaggtgagaagtgtgcgcctcaaatcaccaaagtgagagtggaaggagcacccaccagtcccttggaggcgatccctaagaccggtgagaatggcttcgaaaaatgtgatcg

SEQ ID NO: 14537 - DNA, 5692 bp, Human; identical to SEQ ID NO: 14536

SEQ ID NO: 14538 - DNA, 5692 bp, Human; identical to SEQ ID NO: 14536

SEQ ID NO: 14539 - DNA, 5692 bp, Human; identical to SEQ ID NO: 14536

SEQ ID NO: 14540 - DNA, 5692 bp, Human; identical to SEQ ID NO: 14536

SEQ ID NO: 14541 - DNA, 7616 bp, Human
tgcatccttgtccacgggatgtgtgtgtcttccctccctggagtgggagctgcttctcacttgtttttttaaattttttatttcaatattttctggggtacaggtagtttttttggttacctggataagttctttagtggtgatttctgagattttagcgcacctgtcacctgaggatgggtgccaactgccccccaccaacctccgtgccccctacagtccgctgagccctaggaccagctccagagtaggccccacaccacagggtccaggcaacacacctgtgtgagcatgcacatacacacacacacaccccccccacaaacacgtgtgccccaagcctttcccagttataccccccaactttggggagacactagccccaaagttaatgaaggactctgtcgttaggggctcaggaagagtatttcctaaaccatgagactcccagattttgccccactccccccgggtcagtctctctccagccaccctcaccagcatgcgggcccatgggcctcaagctgacctcaggtgatgtttatatttctgagctgtttattccatgaactgaacatctgacagcttttcagagaaatgttttttcatttggaacatctggaaacaagaaagaacatctggggctgcccggaacgggctgttcctcggatgaaaccttaaccctcctgcccctgacttccgtggctcaggtcctggcctgcaccccttgagagtggcccccaccttatcaggtccgaggcctaggccaagatctaaagagggaccacccagaccctctgccttccaaccatggcatgggaggtggttctgcttctccctaaatccagacagacctgccccagcacagactggaaaacggagggttgtgaggagagtgagaggtggacagagggcaccgacgatttagcatctcttcctctcctgggggtcgaggatgagagacaaaaaagaagctgccaggaaacataaaattcagagggctcagctgcagggctgaggtctgcaagcatgctgtgtacacttgtgcatgttgtgccctgcacaagggcatctctgaaggggctgcattggacccaggggcaggggcgcaaaggtgagtttatatcagttcctgagcactgtggctccatccagcactctgaggacaggcaggatacagctggaggacctgagggctcccccacaccagctcctgttccctgcccaagaccccctggacctgcagacaacaattcaacgcactcagagtcccacagttaagaactccctgaagaagcccccagtggctgcgtggtggattttcgcaaagctgtctccacctacatccaccctgtttggcagcccctacatactctttcacagcatgaggaagggaggcctctcaccaagacctggactgaatcttctcccagtggctgccacacctgacctgctcttgctccagaacctctgtggctcccatcctccacagggtcaacttccaacatggctgcctgcactccagccaagaggctctgctctgggcccctccagatgcctgacctgggtctgtggctgccctgtccttcttcagtgctcctcttcccgctgggtgaggaatagttcaggacagaggagctaagttcaggttcattcataggacaggtgcctatttcgctcacggcccaggaatagagacttgccgggctcggcccttcggggagctggcagacggcagaggggaggctggctggcccaggggatgaccaccggtggggtaagcacagacagaggggagcacaggcttcccccagaagactgagaggccccccagaggcatccacagaggaccccagctgtgctgcccaagctgggcgaccgccaaaccttagcggcccagctgacaaaagcctgccctcccccagggtccccggagagctggtgcctcccctgggtcccaatttgcatggcaggaaggggcctggtgaggaagaggcggggaggggacaggctgcagccggtgcagttacacgttttcctccaaggagcctcggacgttgtcacgggtttggggtcggggacagagcggtgaccatggccaggctggcgttgtctcctgtgcccagccactggatggtggcgttgctgctgctgctctcaggtacagaacccacgacgaggcctgtggggtttgctctcatctccagctgtctgggccctgcggctctgcctcctgcttgctccaccctcctcctctgtctctcactctttaccgcctgtctccctctcatggccctggggcctgggtctgtgggtgtcagctgcacgtggtgatgggctcaggagcctgtggccccagttcctctcctgcctggagagcatcaggctgagctgggcatgaggagcaaaccagagttagcaaccaggaccgtggaagaactaggctcaggaggaagagaggctgagggcggtgcctgggggtcgggaggggagaggctgtcccaaccggaccctggaagatgcaagatccaaatgtggtcccctcctctgggaggtgaaagatcctccgggctgtgactttcttcctgtctctctttaaaaaaaaaaaaaaaaagagagacagggtgtccctatgttgcccaggctggtctcaaactcctggacccaagcgatcctcctgtcttggcctctcaaaatactgagatttccctgtccctcctgtctcattcagatgcctgctcaaagccaccctgagggtcaaaggcagaaagggggctgggggcagggcttccggtacccccaccccatatctgtctcccaagtactggggacagggaggaccgaggggtcttgaagctgctgtcatggaaggaggaagtagctccgggaacatagagggcatgcaggggtggggcagcccaggccagaggaggccctgactggccccgcccacttcctcccacccagcagctgagccagtaccagcagccagatcggaggaccggtaccggaatcccaaaggtcagtagcctcgcctgccgcttctgagggcaagttgtgtgcgactatgtcctgtgtccgactatggtccctgtcctgggggcggtccgccttcccacccttgcctgatctccccatccaggattcccatccccaggcctccttaggatctcctctgagccccacccccagcccactgtcatcctcatcagacacatgccctccagccttggccactgaagggctgggctaaactctgggtcatagcaagggagcctgggggttcctctaggactcaggcccgggcctgtctagctgggaatctggctgagtctcgggtgagccctccagtgcagggtcactatgtgaggggctcagggattcccgggcagtgctcgctaagaacaaggcagtcgaagctggaaagagggttctggaacaagaagtggacccagtccctgcaggagggaagagggggatgatggagggaagtcatgcagggagggggtcgactgaggaaggtctcagttgacagactaggaatttggcctttatccctggaggaacgggggagactgaggatttcaagcctgtgcagggcagcccagtgaaaggaggggccaggcctgtgggcctccaggtcctgggggtgtggcctgggtcaggctgttgtaatgggcataggaaggaatggcaaggtcccagggctcttccaaaggaaaatcgaaggggaggtggggcagtcgggaagaggtggagtctgagagcttggccgtggcttctcatgtggctcagcctctcacgtggctctgcttcccaactccaacctcagcctcctgcctgtcccacaccctgagaagcaaggactaagcccagggagtctgtgccagccagggcaggggcctgctgctggggctggcactcaggaagatgccaagcggaatgctgagcctggccttggcacccacaggtagtgcttgttcgcggatctggcagagcccacgtttcatagccaggaaacggggcttcacggtgaaaatgcactgctacatgaacagcgcctccggcaatgtgagctggctctggaagcaggagatggacgagaatccccagcagctgaagctggaaaagggccgcatggaagagtcccagaacgaatctctcgccaccctcaccatccaaggcatccggtttgaggacaatggcatctacttctgccagcagaagtgcaacaacacctcggaggtctaccagggctgcggcacagagctgcgagtcatgggtgtgtgccaggtggctgggacgctcctgtagctgtccgccccaccctagcccggcctgcctcttgtggtgatggtcatggccctagagcactcaggagagccactgggacctgagggagctgcccttgtaggcctaaaaggtggactgtggcccaggctcacaaccccacccctgtccccgcaggattcagcaccttggcacagctgaagcagaggaacacgctgaaggatggtatcatcatgatccagacgctgctgatcatcctcttcatcatcgtgcctatcttcctgctgctggacaaggtgatcaggggacgggggaagccttgggggaccgcagaggaggccaccgcataggccaggcatatgcagggtctccatctccccagctctcgttgtggccttcttggtccagcctgtccccactggctcaccaattcaatcattccttccttccttccttcattcagctgttcttgcagaatgcacctcactcctgacccctcacccctctccctggccctccccagcctggcccagcaggggatggggctgggggacactaacactctgatctccatccctctccgcccccaggatgacagcaaggctggcatggaggaagatcacacctacgaggtaaggagaggggcaggcccagcagctctgagtcctcggggtcagtggccactatctgctggtgtggttggggtgtggtcccggcctgagttccacttaatgtctccagggcctggacattgaccagacagccacctatgaggacatagtgacgctgcggacaggggaagtgaagtggtctgtaggtgagcacccaggccaggagtgagagccaggtcgccccatgacctgggtgcaggctccctggcctcagtgactgcttcggagctgcctggctcatggcccaacccctttcccggaccccccagctggcctctgaagctggcccaccagagctgccatttgtctccagcccctggtgtccagctcttgccaaagggcctggagtagaaggacaacagggcagcaacttggagggagttctctggggatggacgggacccagccttctgggggtgctatgaggtgatccgtccccacacatgggatgggggaggcagagactggtccagagcccgcaaatggactcggagccgagggcctcccagcagagcttgggaagggccatggacccaactgggccccagaagagccacaggaacatcattcctctcccgcaaccactcccaccccagggaggccctggcctccagtgccttcccccgtggaataaacggtgtgtcctgagaaaccacacacaggctcgtggcatcttatgggtttggggtggataggaacatctatgtgggcacttctgttgtttgaatgtggcatctgtgagccctcaagggtgtgggaaaggtaacagccacccctcctctccgaagacccagttggagcctgtggtcgcatccccgtttcttctccctggaacggggctgcatgccaggccctagctggacccagagcagctggccagtgactgggcctgtccttcccctcagcagggacaccctcatcttgcacttcattcagccgaaaagcggcaattgagtcccactctgcctccacctacaggaagccctcccaaagcacctgggtcctcgcccaagccctgctcagaccagcctatgcagcggcgacttagctactgccttgtgctactcacactggccttggttctccaggcaaactggaagctccctgagggtaggggtttccctgcctctacaacactcccacccccacctcccaggaagcctaggaaagcttgatgcaaagccatcaagagtgagatcctgaagagtggagctttgtatggtgaagctttggggttcttagccaggggaccccttcagactttcccagcctcatatcggaggtcccctatggccccagggtcctcaaacaatggtccctagggccctccagctcaccagctgtgggaggtactgggaacagctgccagctgggagaccaagtgcaatcaacctgcacgtgcaaagcctccctcccaagccaggctgtgctccacttcctgttgaccctggagggaatccttcgaggcccctctgctattcctgctctgaattccagcaagggagcacctatgctgtgggagctgccagtttaactggggaatcaagaccagcacaggggaactagtgagaacagtgccaattttcaccagattccctctggaattccaggtggggcaggtgggtaaggcccccacgcctgcagtttcaggtaaatctctccaccaccctgggccaggctgggccaagccaggcggcccctgtgttttccccagtctctgggctgctggagggaaccaggttgttttggcatcagcctctactgagccggagcccttcctttcctgctgctttgcatagtggcactaattccgtcctcctacctccaccagggacctaggcagccgggtagatggtgggaggaggcttcacttctcccccaagcagggtctccacctgcttgaggctgccctgggttgggggaggccttggctttacctaaagactttttaacacctctgaacaactcagtttccctgagactttgaagttcttgttttatttatttatttatttatttacttatttatttatttgcagacagagtctcactctgttgcccaggctggagtgcagtggcaccatctccgctcactgcaacctccgtctcctgagttcaagcaattctcctgcctcagcctccaaagtatctgggattacaggcgtacaccaccatgcttggctaatttttgtatttttagtagagatggggtttcaccacgttggccaggctggtctcaaactcctgacctcaagtgatccatccgccttggcctcccaaagtgctgggattacaggcatgagccaccgcgcccagcccgaagttcttgttaacagagaatcatttgagcatagaccttggcccctccaccagacacccccaaagggcttgacttcatgggttataatgtaggagccctccccggtctgtttttctgttttaagggcttacactctgggggacatcatgtctgtctccccagaactgccataggcaatggtaatatagctgggtactgatggtggggacaagaaacatctcaggttgcttcatctgcgaaatgggaatcctaaaccccatccgagggaaagaatttggactggacattgttttgtaaaaaattatcacaataaaattgagggccaggcgcattgg

SEQ ID NO: 14542 - DNA, 7616 bp, Human; identical to SEQ ID NO: 14541

SEQ ID NO: 14543 - DNA, 387902 bp, Human
  misc_feature (1)...(387902): n = A,T,C or G
tcaatactaggaatttagtatttcttttctagagtcttattttaactttttattgagtaaaactagtttgaaaagttgagttttttcctgttccagagcctaattttatttaggatctgacccatgaaaattcttaatgagttacataagatgtcattccttcagttaactacaatgaaagattatgaaagtaactgatgaatggagatatgaagtgctacgtttttcaaaacaattggaactgctgtggcactattgactggagattctttgtggggggcaatgtaaggagggcttttctcttaggatacctccttagaccaacccagagctctgggaagctgctcttgaggattttgtatcttttcatcccgctagtgggcctaatttgcagtgaccccctttaccttaagtcatagtatctgcaacaaggcctcatttcttggggaagatagcaaacttgtagttaaaaggctctaggcccagtcctagatataggaattgaataaaatcatgaatgtaatcatgtaatcatttcctccttgtaaattaagatttgttactaatttatgtattcagctggtaaatgagcaactttctattgtgtcaggaatgggggcagtagattaagacagaaccactaacagggaggaggtcattgcctatggaaatagctgttgcagcactcttctgagcctgaattttaaaaataacaaacatggctttgcttcatgatctatgaagtaccataggaattcgggaggtctgaaaacgaaaagtatcaagttcaagctaaaagattaaactacaagcatttattaggttgaatatgagaataaaataaaagtgtagtcaacccttgattattcacagattggctagagtttatgattatcaatgcccttcgattctccttttgcttccaactaccaactattgaatatttttttgctcattaacacctgtctaggagtgggaaggtgaaatgctaatcagccaatttggttaattgttagtggctgctataatccttttttttttaagttgagataaggaaatactttacttaaatattggctgtggactactaaactttatgtcaccttcccttcctttttactgcatggataaatgcaggtatttagttcttagtaaggtagtagagagaattaaaaagatagtaattcatcaatccaatgtttttcaagtatcacactataaattcacattacataattcttattggccagtgttcagaaaatattaatcttctacaatatgactactttaaaagaaagcttcaagatttaatagttgcaattttaagtgtagccctatataaataactgcacttgctaagtggatttgtatcaacaggaacataacttctagaaaattactcaagactaccctcccttttgcctgtgatagacatttgggaccctccccaaaccaaataagggaaagaagaatgttctgagcattaagagcactaagaataaatctgagctctcacggataagattactttcaactctttatttcatgttttctgacatagaccccaggatctgtaattatcttagagaaactgcgggggcttagatggtactttgtagttcatttggttttttttgtttgtttgtttgttttttgcctttctctctttggggctgaagagctggtgtgtctgtgtgtgtgttcctctagagtgccaaaaaagaaaaaaaaaagtgctgaagagtcctagggagatgaggctatttttgtttgaagctgatacttctagctgagccacaagtgctgcttggaaagggcttaggttgtttccagggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggtattgctaccattttccgatagtatcaagtaaggaaaaaaaatatgcaaatcgacagccacattaactgtcgatgtgtccatttaaaatgttgctttaaggtaattgccttggtcaatgattctatacaggatctgagaagtggatttaggagctgagaggctgccagatctgtatattgggggagcaaaaagagatttctcttaaattttgcatgtggaaactgttctctgctataccaaaggccccactagttaacagttgttactcacacctctataaatagctatggtcatgtaacatgatggccgatatcttatccagcaaaaattacaaagttttcaaggatggagaccatgatgaacttaaaatattacactaatgcttacttaaaatattacactaatgcttacttaaacttaaaaagtaatttgaagcatttctgctttatgatatttttaaatggagaccttaaatttgtttttcctttcctactagggtatgtaaaacacacatacatatatatgatttatatacaatttaagacataagtgttcccataaaatttgtatttatttgaccattaatggaaattcagagataaagactggaattccacaaacttactgtgaatcagtatgatttttaaaataaagcaattaagtgttagaattctggttctttttgtaaattcattcttcattttcctctaaatggtaaattctatctttatgttacaataaatattttctgtttcaatgctttactgaaagctacatactataatacatatcttctatttgatggttgctagttatatatatttatatttcatatatacttcatatatatatgtacgtatttcttagaatgaaggaaaccttcaaaactaaattactttgaatacagacacagtctggttctagttgaggtaaaacttttggaggtggatctaaaatttgcttctgacagctgtaagaaaatcagacaggtggtgctcttaacaacttccaagttaaatgctgtgctggtttgctttgaataatacaactgaaaaatagaatatttgtttttatttttgagggtagaaattagtatggacacacagtaatttctgttggagatttttagtcaatatttataagaagtgccttatttgtaccttgcactgagaaattcagtctgacacctcgtattaataacaattactgagagatttctatgtgttaggtattttgctcagaacgttatgtgtgtttacttatttaaaactgacacaattcaattaagtaggcattattatctcagtttggcagaaaaaggaactgtaactaaaatgttatgtgacttgctcaagaccagcattaccaacatttaaacccagcccctttaaatcttgtttgtgtgtgtgtgtgtgtgtgtgtgtgtgttttcttttctgtgagaggatatcaggtttactctttaccaattttagttcagaatttgctaactaaatataaatagcatttttcctattccttagatattctgtgtcatgttgcttttagtttgccttaaagaaagctatgtataaaaacttcttgtttagctctgcacaagttattaagatagctacgagcgtcttaatcttctgtttctctacctctgttcagggtttgggctcccaggtgattcaggaggtcagttgactaaaccatcttgggcttgcttgtggattatgttttgtagaacttgcatttgattcaaaagactttttacaggaaaattcttgattatgaaatagagcttttgtttctgcctttgctctgcgggggtttaaaagggccttggaagaccttctggagttacccataaaaataattacattagtaataaaattaaaaagtagaaataccatctaattcttgggtgatggtcattttccacttccgggccttaacagttcataggatctatgttatctgaacatcaattatgcatttttttttgttttctggaatgatttattaataatatttctcaaatgaaaattagactgccaactcaaatgaactcatcttttaaggaagcacagtcattctttgatgatatccaaagttttttcacactttgttactacacagtttcatgttatctttgcaattctcaccttttgtgccctagctacaattgtcttcctccagtcttttataaaaggtatacctttgtacagtgccttggtacaggctattttctgagcctgaaatagtcttattttatctcatctgctatatttttttcaaccatttatttatttattttattttttttagagcagaatttttctctgtcacccatattggaatgcagtggcatgatcatagctcactgcagtctcaaactcctgggttccagcaatctttctacctcagcatcagaagtagttaggactacaggtgtgcaccaccatgcctggctaattttttttttattattatttttgtaaagacacgacctccttatgttgaccaggctgtacttaactactggcctcaagccaagattctcttgcctctgcctcccaaaacattgggaatacaggcaagaaccatcacgcctggggcttgcaatcacttttggacacattactgaaatgtaagcactctatcagtagacctatgccacctatcaatcaattaccttttccatccatttatcacgcacacacacaaaacagtttgtggcacttaagaatataagagataactcattaccttagaaagctctagttaactgttctcatctcaagttttgggaagacaaggctcatacagattatatgactgtctcatggtcatgggaaattaggagagatctgaggataaatttcatgcctcccatggctcatcccagtgcttattcaactacagtgcatgtcgtgcctataacctcacctagttgctcacatcaatttccactgcaggttccaagctggcttacttcatccagtggaagaaaggaaataatgctaaatacagaattgtgtttcaggtacagagtaatagataaattagaaataggacaaagttgaactccaaaggattttagggtaataacacctttgattctggcaaaataaattaataaagataattataacagcaatgataacatatttattctgaagacataagatgtcaagcactgtattaagcttgataaatattcatttaatcttcagggccaccaaatgagaataaaggctaatattattgctgtttagagaataggaagctgaagttgagagagtttaaagaatgtgctagaattcacacaactgtatgtgatatagctaggattcatacccatgcctgaccacagagtcatattggatatgtcttcttactgtgtgagactgttaggttggtcaattaggttgttattggagcctacactaggaccatgttacatttaggtaggttgaatcaggcccagactggattacactcaaacagcacacaggtttagggctataaacagtcctttatcttccttgcaatgtaatgtatccaagttgctgggaatcccatatataattaacttagtatttactagaacgcttagttcaagaaagctttttatttaaaatgttagaagagcttatatccaactctcaacttataaactattacataacctcaggcttcaggagaagaattattgcactatgtgtggaattctttccttaccattagccgaatcacgtttcactgcttctgtaacaatcaaacctatgagaagatttgatattcaaaatttagagcaaaaatggtcatttatattctacacactgcattactcccatagagtctgcagcacaagattactcactattgctctcaagaaaaaaaaaaaatcaagaattcacagccagactacttaacaactaggcaaacaagttatatcatctagcatgacagatggtgaaattatgaggcgatccaacctatgtttctgcatttacctcatcaaagcaaagggcagctgccctggcttaagcggggatgagctgggggtacaaagggatgtagcactagtttcaagccctggtcacttccaggagatgttcttgattttcctgataaagcaacataccacatatattatttttagtcttataagtacattttaaaactgacattagaaagctagcctattcaaaagaggagtaccacgatggtgaaaggcacagttaaatgaaaagatttgtgcatggtttgtttaagtagaagactggattttttcattatgtagcacttgagggcaatgcacagacccatggataaaagtctggaagtcacaaaaaaggcacactattggcaaaatacaaggcaaaacccaaccaaccattaaaatgatagctagaactgactcttctgactagaaagaaagaaaagagaaagcaagaaaggagggaaggaaaaggaaatacacagcctccaatttttaagaaatagagggatgaggaatatgccaaaatctacaccatagtaggcagtaggctctgggaacctctacagtacaaacaacccagttacttcaaataagttcctgggaacaagaacaagaaaatctggagaacagatgaaaagaaatgtaaaaagttagcaacccatcacaatgtatggaatggttggatcatgattcaaacaaacaaccttaaaaaattctgatgaaacaagtgaaaatttaatatactctggatgttagataaccttaatgaataattatatttttagtgggataaccgtattgtggttgtcttttaaaattacttattatttggagatacacattcaaatatttatgaaggaggtgatgtgatatttgaaatttgcttctaaataatatgcccaagaagaaagtagttggggtgtgggtggggtaggattggccattagttgattatgttgaggctgataatgggtacattaagtttcattataatattgtctacttttgggattatttaagcttcttcacaataaagagttaagaaaaaaaacagagttgatgttgttagtagagtaaatcttttaataagaatttaattttcataacatatatgggtcagtgaattctctggtcaccaaatttattcgtaagtgcaaattactctctaaattgaacagtgtctgttgttactgaaatgaaaaccaaatatgctcatattaagcagagtagtctggaaatatacttatgtttgtaaaagcagacaaggaagtaatcatttttaatatctattataatatgggaatctggaggttagtttcatattattggtaacattaattagagacattaattagaaatagtttgtttttgagataggtcatgggaaaacctgagaacaatttgaaagcctaagaagtcaacatgatgcaagaaaaaatagttctaaaaagtgctatggcttggaacattgcatttattgacagggtattaagtatgaagcttttgtatgactatctctttgaaatatcacaaaaactgtgaaaggcaggtatcacataaacctgattagtctgactctgaaacttcttgttattctttactgctcaagttcactttaggaaaatagaaaaaaaaaaaaaagcagattgtgaaaaccaggagagtatagttcactgaaaatcagagagaaaatatagtgcagagctgggagaaagaagcattaagaaaagagagtgtgatagagtagtaagtgcatggagttttacttaagtcagaaattggggttcaggcactatctccactactcaaccactcttggtctggggaggatggggcctcaaaagaagggtcatgaacttggttaattaaaaataatatggccagaggaatttttaaaaattttacaagatcatgctatttggcaaattaagtttatgttttttaaattgttcaaatcatccatgatacaaaatttgcagtgacaatgagcagaaaatatagctgtgtagtgtcagcccttgttaggttccgttaagaagctttttcttgtagtttttattattatttgtaataggaactatttttctccccaccccataagcacatagtatccatgaaaatgttccgtttatgagcttaaatgtttcttattttttttcctatttatttttggttatcattatgactgtaatttaaaattcatgctacttttacaatgcaaaaatgaattgaggctattcagttattatactaaaggcttaggaatccatagagacttaaggcctccaatactgttggcattaatttttaatcagttaacaatatttaatatgagagaaacataaaacagtgcaactaagcaattttaaaatcatctacattgacctttgtgttgaatatatcaatttgaaaagaaaatggttaagattttccagtaaagcttttggttttatagttatgcttagttggagcttaaagatagtattaaaacattattcttttcttctttcaaacaaaaagaaacccgttggggacatgtttaatgtatttttaaaaaatacatattatctaatgtaacatatttaaaaagaacaaagcaggggaaaaatcttcatctggcaactatgcattaacatcatacaataatgtcgactttacggagttcaggctccattttacttaaagttctaggaagatttgtcaaggttaagtttttgctgtctccagttcccacctgccctggataatacgaatgacaggcttggttttttacagagaatacttatttgattgtcatgtaaatatatattacccctagtgagggttatgcagagacagatgaacttcctggtccaaacagatagtaatttttatcttcaaaggaaaccaaaaagagtatccttggcaaatgtgcaatgaataaagtcttgctctgctctatacaagttaatgctctctaaacatcaaacatctccacatctccatgcctgaagtgaagctgtcaaagacacacagaatttacaattgtgagagattctttggtatgtaaatgagctgtttcctcataaactgcagactctatctcacttacaatgtactttaaatattacatttaaatatatgtggtttagatattttctaatttgttatctgtgccagaagctagggcatgtggttttcacccaaacaagttaaagacatgatattttgacctataagaacaaagataatttaaatggagcaacctgttctttataggggaaacttggtttcatttagacagcatgaagctggaactcattgtgacaaaccagttttatctttgctacgcatttgctgcatcattctcccctccctgacacaggttactgaagtgttgagaaaaacaaaagaaggaaaaactcttagtatttcaaacttagttttaatatggtctagggcattagtgagctcgtggatgtgagagattcagtttccatttatacagacgttcaaaatacatatttagcaaactttccttggaaaattgtctgttgcctttgaaaataaaattatcatgtgattaggggaattttctgtttgaggaagacatttaatataatgtcaagacaaaaataagagatatgaagtggcacttctctgacattcactgctggagctattatttttgcccatggttattctgatttaacctatatattattgactaggggaaaaagcgtactgtaaaatctgaaagttactacagtatagtaaaatgccaagtttgtgaatttaaatctgcagaaatattaggcattgcatttagaaaaaggcaagttacctccatctgaaatataacaaaattttagattctatggtattaattatcatcctagatgtagatttatgaagcagtatgtcatgccagaggtttggttttattcaatattttaatacctattacgtaccaaattgaatgcctgacaatgtggacacaaaaatgaatgataaaaggtccctgctacattgcaaaacaaaaagaaaagagcaaaaaataacagtgagaataaagactggacagattataaaacatttgattccaatttgaattgcagccatgtctctttttattgcactttgctttattgcatgccacagatattgcatttttcaaagaaaatgaataaagctatcaccaccatttttccaacagcatgcgttcatttcctgtctctgtgtcacattttggtaattctcacagtatttcaaatgttttcgttattggtatgtctgtttcggtgatctgtgaccattgttctttgatatcaatattgtaattgttttaggtcaccacaagctgcccctatataagatggtgaatttcatcaataaatatgtgtgttctgactgctccaacaactagacattcccactatctctccttctcctcaggcttttctgttccccgagacacaacaatattgagattaggaaaattaataacctacaacagcctctaagaattcaagtgaaaggaagagttgcatatctttactttcaatcaaaagctgaaaataattaagcttactgaggaaggcatgccaaaagccaagataggctgaaagctaggcctcttgcaccaaacagccaagttgtgaatgcaaaggaaaagttcttgaaggaaattaaaagtgctactgaacacatgaatgataagaaagtgaaacaaacttattgctgatgtggagaaagttttagtggtctggatagaagatccaaccagccagaattctctttcagccaaagcctaatccagaccaaggccctaaatctcttcaattctgtgaagatgtggagaggtaaggaagctgcagaagaaaagttggaagctagcagaggttggttcatgaggtttaagaaaagaagccatctccacaacataaaagtgcaaggtggaagcagcaaggattgatgtagaagctgcagcaagttatccagaagatctagctaagatcattgatgaaggtggctacgctaaacaacacattttcaatgtagactaaacagtcctctattagaagaagatgccatccaggactttcagagctagataggagaagtcaatgcctggctccaaagcttcaaagtttaggctgactcttgttagggaataatgcagctggtgacttcaagttgaagccaatgctggtttaccattatgacaattccagggctctaaagaattacaataaatttactttgcctgtgctctatcaatgagataataaagcctgcatgacagcacatctgtttacaacatagtttactgaatattttaagcccactgttgagatttactactcaaaaaaaaaattcttccaaagtatttctgcttattgacaatgcacctggtcacccaagagctctgatggtgatatacaaaaagattaatgttgttttcgtgcctaacagaagatcatttttgcagctcatggctcaagaagtaattttgattttcaagacattttttaagaaatacattttgtgggccaggctcggtggctcatgcctataatcccagcaatttggaggccaaggtgggtggatcacctgaggtcaggagttcaagaccagcctggccaatgtggtgaaaccctgcctgtactaaaaatacaaaaaatcagctgggcgtggtggcaggcacctgtaatcccagttacttgggaggctgaggcaggagaattacttgaacccgggtggtggaggctgcagtgagccgagatcgtgccactgcactccagcctggggaacaagagcaaaactctgtctcaaaaaataaaataaaataaaataaaataaaataataaaaaattaaaaaaaacattttataaggctataggtgacatagggagaaatacctcttatggatccaagcaaactatattgacaactttctcaagaattcaccattctagatgccattaaaaaatataatttttacattacaaatttttttatttttattgttattattatactttaagttctagggtacatggggaattgaacaataaaaaatatttttgattcatggcaggaggtcaaaatatcaccattatgtaaaaagttgattccaaccctcatgatgactttgaggggctcaagacatcagtggaggaagcaactgcagatgcagtggaaacagcaagagatctagaattagaagtggaagctgaagatgctgtaatctcatgattaaacttgaatggatgaagagtgacttttttgttgttgtttttttttcttttgagccagtgtctagttcggcatgcactggcacagtcttggctcactgcaacctctgcctcctgggttcaagtgattctcgtgcctcacccactgagtagtgggattataggtgtgcatcacactgccaggctaatttttgtatgtttttgtagagacggggtttcaccatgttggccaaggtggtcttgaactcctggtctcaagggatccacccaccttggcctcccaacgtgctgggattacaggcatgagccaccatgcctggcctaggaggtgctttctatgaatgagcaaagagagtggtttcttgagatggaagctactctactcttaatggagatgctgtgaactttgttgaaatgactacaaaggatttagaatataacatagagtagaagataaagcaatggctgggtttaagaggattaactctgatttcaaaagaaattctcctatgggtaaaatcctatcaaacagtgaatgtcacatactacagagacatctttcatgaaatgtggagtccatcgatgtggccaacttcactcttgtcttattttaagtaattgcttcagccactccaacctttagcaaccatcaccctgatcagtcagcagccataaatattaaggcaagaccttcaattagcaaaaagattatgactcactgaaggctcacatgattgttagtattttttagcaataaagtattttttattttcaatcttgttggctcagagtaggtgtatatatttatgggatgcatgaaatatttttatacaggcatacaatgagtaataatcacatcaggataagcggggtatccatgacctcaagcatttatcctttctttgtgttagaaacagtccagttatactcttttagttatttttaaatgtacaatgaattactgttgactgtagtcactattgtgctatcaaatgctagatattattctttctaactatatttctgtacccattaaccatccccaccaacaaagtatttttaaattaaggtcttacactgctttttaagacataatgttattgcacatttaatagactagaatacagtgcagacataacttttatatacactaggatacagaaaaaaaaatgtgtgatttgctttcttgcaattatttgctttattgcatggtatctccaaggtgtgccttatggtgtttgatgtaaagaatgtcatattattgttcataaatcttatgattatttcactttgaaacttgctgaaaataatttagtataactaaagaatgtcctattcttaacactggtaattcgcagtgcacatgacattattgtgaaggtgtaatgatttttcaaggagtaaggagatcaagagtacatttgatcaatgcagaaatgacaaaaaaaaaaaaaagagacaggaagtaggtgagaattagtagtctgtgggatgtagccctgggatgactgggataccaagttaccttgccaagaaattgggtaaaattcctgatttaaatactaaattttcggtcaggcacactgttgctataatactataaaagctggatgtttcatgtttctgattcgtttttaacagttattatgtttcctagttccctgtcatcccatctgagtgttctcccattatttgaacctctattgctgatttccatccccacatacgctactttgagcttactttgtatgtatagagaccatttccagttcatgaagaaataaaaaaaaataccaactgtcagaaaggtaatcattaaacgagtttcttctggcttacaaagaagaatcagttgctacagtaaaaccaaatctgttggcagagttgttctaaatactatgagaactagtggtcaggccagtggtcttgtcaagagttgctgtaaaagcatgacagggtccatagaccaagcctctgaaaatgtgagcagaaagtacttagggtagcagtaatgactagattaaggcaataagtcagcagaattctctagggcctttgttcatagtgactgagagttatattagaaataatagttctgacagtttccggaaaattttggctacctcttgaattaagtagaccagatttcactgctcagtttctgcccagtccctcaggatttgaagtgtcttgttggtctggctagaatgatgtgctatactatcgtggtatgggtctctgtttttgagggacgtgagctctcaatacccaggtgctttgagacatagtattttatcttcttcctatcactctgtcatttacctgtggatggagaggaatgaaaagtctgaccccctgagtgataagcatgcacctaacaaacatcacttgtatatatttttggtatctacttttgccaggtactgttttaattctaaggatgaaatgtaaaatatacagaaatctagtcctcaagaaatgatgagataattgtatatgtaactctctgacactgggctgccagttcaaagtttcttgaaagaagtatgtataaagttatatacaaaaattgtgagataggtttcttggtttcttgtcaaatttaaaatagacaatgtttacatgtataaagctattagggaatgaatcaatataaaacaaataagcaaatcaactgatgagatattaatattgggaaaatctaagaagctaggagaatggatggatttggttggtcagggactgacataaaggaggagaacttatgttaacatttgaagaatgtttctaaattaaaggacaggaacacagaagaaagagcaaagaattaagtttttaacaacatccctagatcctaaaaattccaggttaattcattttagaaacaagtatttgatttcttaaactaaattaataaatatggtgatcttgggttcagtgaaccaagctgaaggagacacactttattggcattcagggtggaaaaatttgttgcaacgatcttccctaaagattgcaaaataattagtacccagtagcacctctcaccataattttgactccataaacacccccaaaattttcctatcagagatgataaactacaccacagttaacaagaacataaagatgagtatagatgctagtggtagcttcaaaggagatgggattgaaatcctcaactatgagaaactctaagcttagttatctttcaattttatatataagattctttttatgtcaatagaggggatttggattggtgagaaggtcattttgcttctccaatcagttatttgtttgcctcaatttgctacttataattctataatagaaagggaaaaaaaaagacaataacctcagggaaatacagggcaaaaagattcacaaactaaatggaatgacatacttccctcttgagaaaaatcagtgaaaggtgatgacttattttctgtgtccttgagctaactaatgagttgcaaagtgacagcataatttgaggagaggcacaggtggaagcagttctgatgggtaaagtgaaagagagtgctttgcaaaattgcccgatagagttttacacaagctaaatagcaaacctcaaggtggattacatttcttttacttgagagtcacccaatattttgtcatagtgaactctacatgtgcttagagtacctccagtgtttctttaatcctttgcaatactatcatgatgacaaatgtattttcaaatcatataaaaacttgcttaaaattaagttgttaggtaatactgagctagaggccaaaatgcgcaagaactctatatacaagtgtaaaaagaattaggacactgtggtgattactgaataatgctgtcccgcttagttttcaagagaacagccgtctcctcagttcagtgtttaaaaacatactatgagtcatcataatttttaaaatatttttcttaaaaattcattttagtaaaatacagactctgaaagtttcataactcacatatgcggttgactcttgaacaacacaagggtaaggacaccgacttaccagtcgaaaattcacatataactttgactcctcccaaaactttattaatagcctactgttgaccagaggctttaccaaaaacattgttgattaacacatattttgtatgttatatgtgtgtgcgtgtgcctgtgtgtgtgtgtgtgtgtgtgtgtgtgtctgtatatatatatagagagagagagataattacaatgaagtaagctagggaaaggaaaatgttttttaagaaaatcataaagaagataaaatatatttagtatccatttagtggaactggatcatcataaagaccttcaatttcatcatcttcacattgagtagactgaggaggaggaaaaagaggaaggattggtttgctgtcccagtggtggcagaagcagaagaggttaaggagttggaaggggaggccagagagccaggcatatgcactataactttcatttaaaaagattctcacgtaagtggaactacacagttaaaacccatgttgttcaagagtcaactgtctttatatatcatttactaaggagtaatggagttgatatccacataaccaacacccagatcagggaactatttccagcacatgggaagcccatattcatctatccatactttgactctcactttggtgtcgcttcccaattaaggctcctctttctttgaactttcctctccagggaaccagcttttttggtaatggttttctttctttgctttatagttttatgacctcaacatcgataaacaacatagttatgctaagtttgttctttatataaatggagcaccatggcatgtattgttctgtgttttgctgcattaattcctcattttgtttataagagtcatctatgttgttgtatgtagctagagtttgttatttttctttctgtacagtgtttcattgcataaaagtcactgtttatccaatagatttttgtttcaattgggggaggctatgatgaatgatatttttatgttctttttttagttttaatatctattattctattatcaatgtatgtttatttcatggcactatgttctatggtgaaaagttgaattcagcatgaagaagacaccttgctcactcaaactggattgtttaaatctaattggaaaatgtggagaaagggtgaccttgtgggtgtctcctagaaacgtcctgttttttagaagaaattgatctagtctcacaagatatataaaatggatgtttggaggagcagagagaaaatgaatagaatcctaaggacttctcagagttttgtctctgagatagtaatcctcaccgtatagcaacccctttttgagactgtatgggcagcaatgtaaaaattgacatgtagagtgaggcattcaactaatattgattgaatgtcatgtcctcattgccaagcattttacttggagctggaccaatagcagtggacaaaaaaggtccctattttcctgcttctgtcagaacactccatgactagaatctccattgtcactaggttctgcaccttgctgtcctgggcactggtgagagcaactgagtttttgcttgttgaggctcctccttctaggatccttggtacacttttatccaatggacatcatctttaatttgacttgctggctttattagaatattgctattgttaacattcaggcaaaacttaggtttccacttctattcttcctgcttttagatgaagattgcccatctttaaaaggtgacaacttcaggcagttaattttgtccactttagtttagtttgctagcttaagctctcagaaattattcaatattcaatttaacggaaggaggttttactgaggtggaaagcctaactctgcctcagtgtgtgagaaaagaaggattaaaagataatctatctccatttatctatattgtattacctccaaaaacgaaaaaaaaattctatttgtaaaactctgtgaagagcatgggtatactaggcattctttcctgttttttgatttgggtcaaaatgtatgaatgcatgtgagctatatggacataacaactttgagaaaattccgaataagttttattctcccagatcagagtttgtcagtgtgtagtccccagaccagcagtgtcaacatcacctgggcacttattggaaagggacattactgggatacatctcagacttttgggatcataaactgtaagaggagagtatggcctagtgatctgtgttctaacaaaccttttagatcattctgacacacgttgaagttttaaagccgcaaccctagttaactacatatagactttaaaaacaaattccctactaattccaattaattagggataaagatccaaatcaatcatgtagtatagtggcttaaaactcacaataacagaggattcttttcatgataaatttgtgatcatgcacaagaagattcttttcatgggcaatggaaatctgaagaatggagatggaggaaaagaaatcaaagagagaaactatttgcctggaagagagcaaaagtgtgtggaggtcaagagcccaacatgtgcacactgaaactcatgaaattttccccataatcagctatttctctggacctgcagggttctgtttttttatctgtatgcacagtctctaaactttggagtcctcatttcttgtattcaccttttcctttttcttctcatttaaacttcagttattttttaaattagaactcctgttctaatttaaactcctgttatttcatatatggatgtctgtatgtgacagattgtatttttcaaaagtggctgcagcaagatttcccatctcatgtgttcttcttatactgtgatcttgactcttcttctcttgagaggtgaggtctacttttcctcccgttaaacacaaacagacttgtataacagcttcaacaaagaacatacagtgaaaatgacttccaaggttagatcataaaaataccagacatatccaggttgctggtttgggatacctgcttttgaaactatgctgtgaaaaaattaaagcagcctggaggcaggcccataatgaaagagaccaagaccttgacctgcaaacccagccaagcttccagccaacagccagcaccaactttccagcaatgtgaatgagtcatcttgataatggatcctctagtccccagtagagccaccacatgtgacaactgtggagcagaggcaggccatacctgctgaactctaaccaaattacaaatttctgggcaaaataaatgattacagttgttttaggccactaaactttggaatcttttattatgcagctacagataatacattatattagcatttttgtaatctcctcacttctaatgtatcttgcaatcttgcacactaagttcataatactacattacccaatgaataatggtaacttatttagtgtacagttgtttcagccaaattcaacatgacgctaggcaattttataattgttatacttcttcagtttcatcattgatttatttacacatttattcctttagtaaaatatatttaataaatgttgattattataataaaatgtttgagttactggagagaaattcataaaaaagaacaaggaagaagaggaggagagaggggagaagaaggaagaggatgagaaagaggaggaggagagaaaaaagcagattctcaactaaggttgtcacacaacttgacaattttgcaaatgtgaatgggcattttttaaattagaatgcccaaaagatacacggttgtgagccatggattttgagcaatacttaatttcactgagcaggcctaaacaaactgtgcataagagagtgctcacacaatgtctactgatgaagagtagtgagaatattggttgtggtatacagaataattgtcccccaaaatattcatgtcctaatccccagaatctgtaaatatgttaccttacctggaaaagagaatttgcagatgtggttttattaagaacctcgagcgggagagaggaccctgaattatctgggtgggcccaataaaatcacggaagtcctcaaaattggagaactttttctgttggtggccagcgggagatgcaatcagccagcactggctttgaagatagaggaagaagctatgagccaagttatgtggcaacctgtagaaggtagaaagtacaaggagatggattctctctagaggccccagaaaggaatgtagccctgaagacactttgattttagctccttgagacccatgttggacttccaagtacagaattgtaagataaatttgtgttaaatttgtggtactatgttatggtgcagtagaaaactaatataccagtgtgtatctgattactataactctctcttactcactggaagacaaatttttagagggctcatataaaattagcataggagaatggcaaatttatttttcctgggcccagtgcagtggctcattcttgtaatcacagcactttgggaggccgagatgggcggatcacctgaggtcaggagtttgagaccagcctggccaacatggcgaaacccatctctactaaaaatacaaaaattagccgggtgtgttggcgggcacctgtcatcccagctacttggaggctgaggcaggagaatcactaggacccgggagacagaggttgcagtgaaccaacatcgcaccacttcactccagcctgggtgacaagagcaaaactccgtctcaaaaaacaaacaaacaaatttatttttcatgaaatatttttacataaatctttttaaaaataaatagtctcccttttatattagcaatctgaaactaaaaaggagttcctttatcaaggtcacagagctcatgattgtgacaactaatgatacattgacgaacaagattattctttctgtagcaatgactttcaagccaagaaatgaagttatctagcaagtaacattttccagctaataatcagcaaaattagagaggcactttatttttttttccactaatatatatttgaaaaccttaggagagagactgtagcttgtgcaatatttatttcttcttaatattgctacattgaacctgcttccattcaactcaacaggcatttctgaaatacaaactgtgacttgttctataatcaatggtgtttgtatatatattcagccacctacatgcaatatataatacatattatctgcattttaaactgaacttttaaaaacgacccctctggttcttcgaccaggacaccttgccctactttggaatgggtatccttcacgttcctgggctggcacacatcaggaagctatgtacattttcagctggataagagcctattaatagaaagctgacactgctgtggttaaaaaaaatcaggtcagagattaatttcatgaaacccatagtcatgtcagctaaatatgatctgtttgaggtaggtgaaggatgtgtgatcactctgttgttcaaactcaaataaatatgtctttcttttatatttgcaccatgaaatattttttcatttgtctaggaattctaatccttgcataaaatcatgcagattttaaacttctgaaacaatctttgtgcttaaacatcttccaaataagactacttagagaaaaaaaaatggggatcagaatgtgggatacaagaagatatgacaaggtgattaactgaatttgttgtaaaaataaaagttagaaatagaaatttggaataagcataaagttaggtttgcaggaaagcaagttgtatcagtttgacctggaaatactggatgttatttaaagggcagaatgtagacatacctttgatgaggagtattaaaagaaaatattcaggaaggaaaacaacaataacaacagagcaaaattgtaagtggtaagaaatcatacatacatgtttatacagcatttacacagtataaatgcatatgaataaatatgaagtatacatatatttgatttgtgatgtacagaataaaatgtaaaattaaagattttaataaatattgagttcctacaacatatcagacactgcatgaagcactaaaagaaaacatttgatttttttttttttgcaaacctgctttataaataatgtaaagtataacgtatattatggatataattttcgtttttgagatggggcctcactctgttatccaggctggagtccagtggcatgatcatagctcactgcatctcaaactcctgggctcaagggatccttccaagtcgctgcaagcacaggcacatgccacgacacccagctaattttttttgtagagacaggatcttactgtgttgccaaggctggtctcaaattcctagcctcaagtgatcctcctgcctcggcataccaaagtgctaggattataggcttcagccactgcccccagcctaatttttataggtcttttttgctttattatatatttttaactgacacatatatatgagttacatgtgatatttccacacttacatacaatgtataatgatcaaatcagggtaattagcatgttcatcacatcaaatatttatcatttctttttgttgggaatattcaaaatccattattctagctattaaaaatatgcaaaaaattgttgttaattatagtcactttacaatgctgtaggacagtagaacttattcctcctatctagctggagttttatatccattaaccaacctttggctatcctcacatccccacactttctagcctctagtaaccactattctactctctacgtctatgagatcaacttttatagcttccacatatgagtgagaacaaataatatttgtctttttgtgtctagcctatctcacttgacatagctcatccacgttgctgtgaatgacaggatttcattcttttttagggacaaataatattccattgtgtgtgtgtgtgtgtgtgtgtatatacatgtttttcaaacgtgaatgggcattatatatatacacacacacacatacacacacacattccattattcatatatacacacacagacgcatacaccacatttgctttcttcattcatctgtggatggatacttaggttgattacatatcttggttatcatgaatagtgccacactaaacctgggagtgcagttatctcttcaacatactgatttcaattcgtttggatatataccaagtagtaggattcctggatcaatggtagttatattttcagttttttgaggaagccccatactatttttcataatggctgcactaatttacattcccaccaacagtgtgtgagagttcccttctccatgtccttgccattatttattatcttttgtctttttgataatagacattctaactggagtgagatatctcattatggtgttcatttacatttcactgatgattcgtggtgttgagtatttttttcatacacctgttggccatttgtatgtatcttttgagcgatgtctattcagttcatttgccaggtttttaatcacactatttgtttattatttgtttttgctattgtttgagtttcttgtatattctggacattaatatcttataaaacaaatagtttgcaaatcttttattcttttctgttggttatttctttactatgttgattgtttcctttgctgtgcagaatctttttagtttgatataatcccatttgtctatttttgcttttgtttcctgtgcttttgtggtcttttccataaaatgttttcccagaccattgccttaaaggaattcccctaaattttcctgtagtttcatggtttcaggccttacatttaagtctttaatccattttgagttaatttttgcataaattttaatttaaaattaaactttaatttaaaataaatttagattaaaattttaaatacacttacgtttttcaaaaatatttgaccattctgcagttataatattgatataaatatcttcaataagtgtaattaaaaataattttctaaaattgtatttttatatataatagtgtaatagtataacagtagcttaaagtcagtagctagttttaatatttctattctagaataacattgcaagtatgttttattttctaaatttacattttgtatatctttgaattcatattaaaatggtcaatttgagggttttttttgttttttttttttttgtttttttttttaatgaagcactttcccacggtaacattcttatgttaatcatatggtggggagtttaaagcaggaagtgatttatacatacctacagccatgcctcccaaaccttaacatgtatatgaatcacttgaggatcttgtcaaaaggcaggttctgatttagtagttctgggatggagcctgagaacctgcattcctaacaagccccccaggtactgaggaggtgctggtcttagagcacagtttgagtagcaatatcctagagcatcttaaagggtgactagaaaataactctgctttagcttccagtctctaggtttcaactgaaatgaataaaccaatggatatcctgtgagaaaggaccagaggaagaagattttcttttatcatttatcttttatgtgacttttgaaagaatgtatatgagcctttttaagaaggaaagttcacaatactggttatttgtgtgccatccaactcatattcattgttatgtggcatcaaatagtttcaatcctgccaaatctaaaaacaattttttcacctttcaatgatacttttatgatggctttggaaggcttagatgttttaaatggatattaattgtaagacattttattttgatgctttttaacacaaatattatcaattactatcaatttatatttactgaatatcatctggtgtcttgtattaggtttgacacttctgaacacatttctctctacaaggcactgcaagctgtctccatgcttaatttaaaaaaaaagtttcaactaagctctgaataattgagttcattgagcagaataaaatagtggattaattaatagtgttacctttaatggattagtgttgaaaaatatgctcatctctctttctgttaagagtgataaatttttaattccttgtaataattaggaaacataaaacgtgcaaatatatgctgaaatgtatttattcattaaactgataccaaatcattacgtttattttaattgaaattggaaatgtttcccagttttaatgtaagttgggattttgctcatggaaagtttggcattagctgaccattcccaaatcatgagtctgttttctaggatactgttggcacacaatatgagcctcagatttgttcaatgcataaaatttcccaatgctttggtaagtgaaggatgatgcagtcgtcctttgtacttattttaggtcattaaccaaatgtactacttttccttgttatttgatacatctaattttatgctgtattcagttattgattttatttctatgatgagaaagaaatgtcatgatgataagtaggtggaattatagaaaaatagagttggaatgaattgaagaccacctcaagcagtttcatataagacacaagtgttattcatgttaaaaaattatgtgcctggagactacttctagtctgtctactgtccctaggcaggaatatgcttaaactgtgagaaagtcaaagaaaattaatatctaccctatagttaaatatttccacgcactggtactcaatattttccttagaaaactacttgtgcctaaccatacttatgtcaagatgtcttcatcttgacgcacagtggtgcgtgcctgtagtcccagctatttgggagcctgacgtggaaggatcccttgaggccaggagttcaaagctgtgatacatgatgatcaggcatgtgaacagccactgcacttaaaagatgtcctctcctaaatctctcctgttaagatttaacacaagtgattctccttactcagcctcccgagtagctgggattacaggcgcccgccaccaccatgcccagataatttttttttttggattgctgttcttatttcctttttttaaaattttattattattacactttaaattttagggtacatgtgcacaaagtgcaggtttgttacatatgtatacatgtgccatgttggtgtgctgcacccattaactcatcatttagcattaggtatatctcctaatgctatccctcccccctccccccaccccagataacttttttttttctgtatttttagtagagaccgggtttcaccatgttggccaggctggtctcgaactcctgtgacctctcaggcgatacacccacctcagcctcccaaagtgctgggattacaggtgtgagccattgcgcccggccccctcttctattttcgaacttgaaaatggcagatcaccactgtctttatagagactctttgttttgtagaacactaatcttgaacatcgttcttagcttttgacttaagttgaaaggtttgaaccaagaaaaacttttcttcatatgctgtatattatttccagacttttagtcatattaacttcttatgtgcaaatctcaatagtgtattttgggaatgtgtagatgtgatatttcaaactttattatcagataaagcaaaggttctgactgatccaaaaatctccaccaaactaattagatggaatgccagccttgattctgtgcttgtgcttactgactaaatatcagctctgtgtatcaagaatatttggtgaaaaaattgtatgaagagtcagacaatcatagatctaaaatcctgtactcacaatgtgacttatccatgttttctttctgaaatgcagcttttttgatctatgatagaacgattacaatgacagttcatatactatatatatgaaagtaccagcactgtcttatacataataggacatcataaatatgaatttatttcttttatcttatgttgatcaaacattatgggagcgctaaagaattataaatctacataggtgtatgcatgaatcatacatacataaaatggataatacataaaaattatttcatttttatttattcataatagtaaagattataatgtccctctaacttaagcagactacagtgtgggcaactgttacattgttcttttttgccctctcatatcttgtgaatatagcgtaatttttgttctactcaattcagttctcttggttattccaaaagtattcgcatttgcatttatcagatttagaatttaaagtaaaaccttatttttatacattgaggttttacttttcaattttcatttgcatactaatcacattttagtattttacaggaattatgaagttcctaagtaaattacttctttcagctctaagaatgctcacaaatgactaaggtaaatagtcttctcagagttgattcagcttattgggcccttgtgttatttttctattgttgtgctacagtgttatcacactcagcagcttaaagtagcagtcttgattatcccacagtttctctgtgtcaggagtctgggtgtgacttaattgggtcttctactttggggcctctcaaatctgtggcacatttttaggatctgatctgctctcctagatgtatttagactctaggagtcccactttggtgctcaaataaacttaatgcagtttttttcttttgttaaatgttatgaaaaacatgagggaccacattcatttaactttgtttccagagagtccccatacttaaaagaaaaagaggaggcatttggtgtctggtcttgcattaacttctactcatagtccaactgtcgctgtttaaaatgaaggtacattataggctctcatagcatggatatgtctcatttgtagcatttgtcacagatacaattgttcatttatatgattatttaatagatatctctgtcacttactcttggcccagtaaagacagcgactatgaaaaaaattgcttaccttttgtacccaagcacctggcagagtgcttggtacatagaaggcattcagtaaatcattgcagagtgaatgaacacatagcgacatggaatgagagtcatcagtaactcaaagctcttcctgggcaacataagtgatgttatcaagcatcaggaagcaatagaggctgcattgatttgaagctgggacctgttttaagggaagaaagaaattcacagtgagaatggtgcattactatggctgagccatgttgttctttggtatattcatttttatctctattttctctaacatttttaataccctggcatttactgaggcatcattagacatggcacttgtgaaacttcagtatattttggagactcttaatagctattgcatgcaagaaatcattccgttcacttgtgaagtcaactggacaggtgaaaattaaagctatttttgaaatcacttgtggttgttccatataaaattattctccagttgtaactttagtttattgaaaaagcttatttcaggacttctagtataaatttacttctaattatttggaaagtttcttatatatcatccatccactgaacaatcatataccgagtgcctccttttttagctagatacagtagaaggagctaggaatagagactggtagggtggaaagacaggaattttaatgtaatatatctataaactttatatgagaacaattatgattcatgcacgcaatatcatgatagcacataagtaggataccagcccataggctagggacaaaagtgggaacattctcaggaataaattctatttagaggagatacgtgagtgaagtctttaagaaccaattcaagtcagtttggagaagaacaaagagagaagtgattaattccctaattttgttccatctgtgttttgccaacttatatttaattctctcatgtaattaataaacaagtgtttatcaagcagtttgagattggcaagatggatttctttttttataaatacacaaataacatatgcttgagttataaaagtaagaaagtacagaaaatagaaaaaagatacactcatcattataactatattatactcctctaatttcttttcacatgtatgttataattatatatttttacaaaaatggggttatgctgactaatgttttatgatgagttctctaataaaaatttcttgaattttttcctatcagtaaatataagttttactccacatatatatgcatggatatattgtatttcattatattgtttacttagctgatccttttttgttgaatactgcttccattctttttgtttttgtttttttgagatggagtctccctctgtcacccagactggagtgcagtgtcacaacctcggctcactccaacctccgcctcctgggttcaagtgattctcctgcctcagactctcaagtagctgggattacaggcgcacaccaccatgccctgctaatttttgtatttttagtagagacggggtttcaccatgttggccaggctggtcatgacctcctgacctcaagtgatctgcctgcctcggcttcccaaagtgctgagattacaggtgtgagccaccgagcccagcctgcttccatttttttttcatgagtataaacaatacagaaatgatcatatttttgctcagtgattcattcctttgtaaaactttaaaatgctgattcaaagacatatgattttaagcatttgacataatgataaattttccccagaaaacgtatcccagttttaacaaccatattcaatatgttaatcttcatttcttcataccttttccaatactgtgaatgtacttttgaatgttttctgatgatataagaaaaaacatatcatttttaaagttgcataatgagattgaggtttaccatttattgttcaatattgtttcttttgtgaaatgcctacacatttcaggataaattttgccaaattcaaatgagttataaccatatatttgaaatatatagccctttactaagttgctttcaattctcactgatttagtcattttttcactaagatatttatgataaacacaactctcgtgaaaatgttttaagaaggctaaagtgaaattggcaagaagataacacttttgaagaccgtgctgggatcaggatagaattgcaagtgactgacaagtattttttaaattaaattatcatagctgccctagaagatagagcatattaataatgaaacttaaagataaggaacttaaagtacagagatactaaataatttacccaatcaatcagttagtaagatgtacagaaaggaattgagcccatgttgtctgagttcatatatgatatatgtatataaggttgcccatttgaagtatcacatttatctcaggctcctaagttcaatatcattattttcacttgcagttagtaaattttggagtatagttgacaccttattggcacttcttcatagtaaaagctattttgaaagtataagtctgggctgggcttggaggctcatgcctataatccaggcactttgggaggccgaggtggaagaattgcctgaggccaagagttcaagaccaggctgggcaacataaaaggccccatctctaattaaaaaaaaaaaaaaaaagactaaaagagaaagcataaatctgaatgtgccattaataaagttacatgtctagaacatagtagactgtgaagccatgaaatagcttaacagtaaaggaaagaggctttaatattttccttacaaatgaaagtatcttcaggttgtaaatcagaatttatgaatatggcaaataaacataatctgcaagttgtataatttctatatggagagcatctgacgattaaaaacaaaatcttgctgcagcaacacaaatgacatgtttgtaaattcaaacacaagccatgtgcggagagactacaacctttatccaaacgcttgtttgatacagcagagggccatgtgctgaaaatacaatctccacatgttaaggcccagtaatcttctaaattaatgtaatctgtatatatagagaaagtatatgatcacagtttctgaatctcttttgaggtttcttctgagtttcttcataggcatatatcaacattaataacctattttattttttaccaacaatagtgagtttatgtccttccagcacaatgctgcttttataagtcccattgagtttagtctacgaagcatatttactttcacatttccaaattagcagaattaaaatgttaaagaccatgtacctcataatggaagcagaaattcattaagaaataatttatgaaaatgaatcaataaagtaatccctaattaatacaataatccagtactgtaattgaattcagtttctttttgagaaccacttgtgactgtgtctgaaagctttgcagtgttttcaaattgttttgtaagaagagaaccctcaagattctttcagtggaggcaaaggcaaaaactcaggcttatcaatgtgtggggggactcccagaggcaacaagttcccaggggacctcagtatctagattagtgcttgccaacatgtaacatgtgccactaatggtaaagatgattgtatatagtataaagatgagcatttctattttaatagtcatacatttctttgaatacttattagaagcaatataactagcacatctaacccataatttataactgtagctagatgaagctatattttttgaaaattgctacataataaaagtttttaaaatattgtagatttatacataacaaagaatatttggcttatgattaaaaatgggttattaaataaatactgcatggacacatttatatatcaggaagaaaatcagtgaacctctgtttctaccatatatgagtaactactgaaagaataacatcttaaatataaaaataaaacaataaaagtgttgactaaactagaaaattatatgtaaagcctaatgatgaggaacttcctgagaatgaaaatttaagatatactttttaataagatggacatattcatatgtccatcacacacatacacacacaaaatctatggtacaacaaattatggcataaaaaaagcaaataggaaacaaagggaaaaaaaccatgcttgttcaatagaagtctatatttggtcagatgtatttatgcacttatataaaatgtatgtatatgtatgtatggattaaatcattaaaatatttttcagattatattaaaaataatatgagtgatacttgattatgttagaaataataaagttgatacttaaactactgaaaaatctccttacggtctttctcattctactaaattatttaattttgttctttataatttcattaaatgtcatttttatcttgcttgcactataaatatatttagcaaattctttattcacaggaaactaggagataaacttcagtttggtaacattgaatgagcacacatttgaaaggattgattttccaataatgatcattggcttggcttcctctttcacagagataatgaggccagtctctgcccatgccactgaaacttaaacttgaaaattttactcagtgatgctaaccatcaaaaacaaaataggaggcttaataggcataaaagttaattaaactatggttataaattttacaaatattaatttcttcaggaatgcaatcttttattattaaaaagcttttgtttttgtttttgagacagtcttgttttgttacccaggctagagtacagtggcacaatctcggctcactgtaacctccgcctcccaggttcaagcaattctcctgcctcagtctcctgagtagctgggttataagtctatacaaccacacttggctaatattttttttttttttttgtagagagggtttcgccatattgcccaggctggtctcgaacactaggcctcccaaaatgctggagttacaggcatgagccaccacgcctggcccaaaaacatctttatttgttgttggctgccatcactaaaccgtcttgaatcatatgaatcatcttacacatctgatgtgttatgtcaattatttcaggctttcttctaaaatatctgcttatttctctccaatatgttcagaggagttttgcctagccctagaaagagttaatgtatattttatacatatatgtttatatatatgtgtgtgtttatatgtattatatataaatatatatttatatataaataattatttgatggaaataataattattaaataattattaaaatatttattttgacaatgtatcatttagaataaaatgaggatagaaggcaacataccacctggctactttgttacaagagtcacaatgatgacagcttacctctcaaattaaaatcttattttgtaaacaaatatatctacatgcatctagtcaacaatgatatgcaaatcacatctgcttgtgcacacaatgagatatgtgtgagtgtttacgtgtttggcatatttgtcaataatataaaatattaagaactaagaaatgaccattatttttcccatctaggtactaatctattctagtgactataaattcataattttccccagcaaacttacttgttttccttgatttcccgtagtggtgaatgacaccactgtctgtttatttacctactttctagaaatagaacactaataatcaaatcattgaccttccccaccctcgatttatcatatcattacccctcccaacacaaacactctctaatcatcaaacaatttaagtcctgcagacactgtttcctggatattttaaaattccatctctttctctctattcttcgtgtcattctgagagtttggcctcttatcacaaaaaccctagatttctgcaaaatcttctaatttagcttctgagtcttaccccaactactgtgcccagctgtttaaataagctttccaaaatacaaatatgattaagatccttctgtaatatttagctctggcttgctgtgttgtttgttatgaagtccagcctcttcatttcagcactcgcaggcattgtaaatgtattttctgcctacctatctctttatccttttccctctccattttgctacaagtgtctttgcctccggcaatgtgaatagacctgcaatgtcatgaatgtaggcttctttcattctttaagcttttacacatgctgcccctttccctggcttagttgtcctcctcacagtatgttcccacagcagcctgtgcgtgacagggtcacacgattaacagtgctgtgattatggctcacttctctgtctgcctcagcagtctctaagacccttgagggaaggatcagatcttgtttttctgtgtccaacactgtcacggtaagcactcaatattcatttgtcaaatgataaaaggggacaaattcagtagttgagttagttgtagcaatctttcggtaactcatctatttattccagataggtataatgttattccttttgataaaaatattaactctaattacattttctaaacaacatataggaaaatatcagtaggggtgagtacattattggaactgatgcatttgagaaaagtagattattagatgcatgtgaattgctaatttcagtttatgcccaatgatatcttcagaaatgcatgctgtgaggtaaaaatttctggaaagatctaacttttacgaagtgattgcaaagtagatatccaagggaatttccagttgtcattatcagcaaagggttcagaatctatggaacatggacaatggcagtaagcaaagtataaagaatctcaaatctttaaaaattaaggagtatagagtctaggtccgtctttttcattatcataacatgaaacaatgtctggaacatagtaagtgcttagtaaacatctgataaatgaatgtatgaaagaataaatgcatgaatgttggagggataattgaataaataagtaaataaattgatcccattttataatatttagctatggtataaaaacaaaacaaataccaaaataaagtgtcttgaaaaatcatcacagacctcaatacagaaaaaaaaagagtaaaacaggtatatatgtaaataaaagaagttttgagaggaagggagataactctgaacataatttatagtactaaagtttcagtaaaggataagatatgcattgggtttgattagaaagataaaaatcaagtgttgacatttttcctgtggcctctgagataagactaagactaaatcagcctgttcatttctagttctaattgtgtgtctgtgatcttagtttagattatgtgtacacagaaaaaagtaaaaataaatactattatggttgtgactggatttcagtagttctttgatttatccatttgttatacattagtccttggaataacaaaggtctgagttctgaatatctgaaatttaagtgagaactaatgttagattaaataatacatccaacattaaaattcagtttagtgctgctgcataatctcataaatctaaatcacatactgatttttttttaaataactgtcctttggctgaagtaatagcatgaagtcgttgatgtgtatgaataacacagtaattaagttgtttttactttgttgctggtttgagattttgtcctgggctgtgagtgctagtccactgacatatggaaataacaagagcttccttttaaaaggtgctctttccaccataagtgcagggagagggaagtttatcctaagtagtatgattttcatggagttcagtttctctgtgttgtcagcagtacccttcacatggaaggaaatacattgagatagggtaactcctggagtcagctgagttggggtacccctctttgctcttcaaactcattttttagttttatttcaataattgttggggtacaggtggtttttggttgcacagataagttctttagtagttgtttttgagattttggtgaactcatcacctgagcagggtacactgtacccaatatgtagtcttttatccctcgttcccccctacaacccttccctctgtgtcctcaaagtccattgtatcattctaatgcctttgcattttcatagcttagctctcacttataagtgagaacatatgatatttggttttccattcttgtgttacttcacttagaataatgcccccagctccatccaagttgctggaatggccattacgtgattctgttttatggctgagtggtattccatggggtatgtatgccacattttatcatttgttggttgatgggcatttaggttggttatatatttttattcaaacttattttttaaaaaacagattcaaatgcaacttctcctcactagaatgtaaacgtcatgagagcagggactatattgccagtgtttagaatggtgcctgacatatagttaccattcattaggtatttacaattattcttgataccttagttccagctaatagaattgataaagtctagctctctgagttctagtcttgataccaccattttccagtacttatcacataatgtttctgagcctcagtttcctctttctaaagtgagaatgagactagctgccaaccaacctcaagtagatcagttgatatgatgtatgtgaattgtgtaacaaactgaagtgttgcacaaatgtattaatataatattgttaacctaacaaacaagtaaaaacttttgaagtggtcttttgttacctgccagcttagagttccccagttcatgtagatcaaaactgggattgccacaggttgcagaaggatgcctggacaaagaagtgagaatgtgtgcaaatctgacatgttctctctgcaagaaacactgagctctggtgtagcagccctgactgcttagaggaggcaactccttttaccaattagcaccaatggggcatgtggagtaactggagccatggcaaagatcaccattgattctccattatattcgatttagtgttaaaaaatatagtccctgttatgatgaaacctgctattcaatgtacagaaagggctgcaactttgtccttcttaaatcctatgggtatgcataccacaggggtgaacaaaaggtgttgatgacaacatatcactctgagtttctttaacctgttgtaaggtaaagcattatgctgttcatagaaagttgataaattttggtcctcaaaagtcagacttgtcaatgcaggacattttgttacctacttaaattctatctctgctgtgcatccagaaaaatataaaactttaatactgatatctttattaaaaatggatatgcatatatttaatagtcatcatcacaaaattgattatggtatactttaaatagcctttcttggccagccttttataataacacagataaattgtctactttttctggtgagagagtggggaaaaaataaggaattaggtagatacaacatgtatgtttttccaagtattttcatatttgcaacttttcagttatgttcagtatttaactgataagtacatataaataataatttttttgtttttaaaacaatttgctaacagccaaaagtgcatataatactattcaatagatgtaattgtgctaaacaaaggcagaattcttttctctagagtttaaatgtgggaagcaaaaactggacagtagaattatccctgtacttatgaacgtctctcaacaatacttatagttatttgtgattttgaatgatgaatgttctactgcctctccaactgctgtataaccagagcggtcaatatttttggacacaaaactgaatgcacttcatatccccgtgtgtctctaccagaacaaaacttcagggcccagaaaaactgagaacagctaccactatttctgttccctcagattatgtccccatccctttcccataataaagcttcctgcccttttttcaggcccccactgccaggactccacccattttctccattgtccactgcacagcgccatcatcattgtccgaagctaaatctttcccctttacacacccaacccgggttccattctgaggagggcattcctcctttctcagctcctactcctggagattctattgcagtggctaagattcaatggtgttctacatgcagaccctctgggggcttagcttaagggaagggagagcactctgcttattcacattaataagtcttcagataccgtgaggatctggtgatacaggttcagatacaaaacatgctcctggaataaatgcctgggaacggtaacacaaaagggcacaaaggggttcatttctaatacagtacacatttttggagcatctattccataaaaggcatcatgtggcattcagtattcaactctgcacaccaattcaataacatttgcttagtgccagtcattgtgctgggcaccagaggtatacaaatgaatatgagaagcttctaggagcttatgttctaatgggagatctggaaacataaacaggcaattgcaatataatatgccaatatgtgcaaaaagggtattctggaaacatccaggaaggacatttatctcatctcggaggcatatatccatggcttcctgaaagaactgaagcttgagctgactagcacttgctccacactagataaaatgcaaacatatttaaaagtgtgaggatgtctagagttttatttgtgtaacaattcagctgcataatactaaaaagattttggtaggttgcataatattaaaaaggttttgatactgagaccataaccaaccctcatacattctttaatcaaaatggggaaatacatttgtgctccaaataaccaccttacagaaatctttcaggacataatgcttatttagaaaaaaaaaatagcaccaaattatgaaagggattaacaaaaaaatggcaataatgtgcttttttgcaattggtagtgaatgcattaaaaacagtatgatttttacatgaatgaaaatgcatagttttacctattatgcattctgaacattggttgaagaaataaatttctgaattatttacatctcatggctttattgcaatggtagttatgaatgagtttagcatcagttgtgtactttgcaatgtaaaggctcttcaaataaatgaaactctaagcctccagggcttatattctcagttatataaccccaatgatcatatccacgaaaaagcagtttaatctcagaattttagaatttcatgtacagagcaaagaataaatggatagagctgaagtaatttcccctcagagagacattgtagaaagccatatttatatgtaagaatatttatcattgttatcaattaatagttagggagtttgtcattaaagggaagagttaacagctattgtgcctgacatattgctaagtactgcaactattttttatgatcatcctatgaggtagttttaatgatctgttttatagagaacaccgaggtgcagatgctagtacaaagttaggattcaaacccagcactgtcccatcctagcactacttttatttcctgtgccatatgcctctcctatgcctgattcatatttatgaaatgctggcttaaattattactaccaaatttaaaaaacatgtaatactttttaaagtttttactatgtcagttacttttctagattaaaagagcagaaattggcgaactctttttgtaaagggcctgttagtaaatgttttaggttttgtgggctgtatggtctatatcactcttgctcaactctgccactgtgggaggaacgcatagacaatagacaaaatgcaatatgaaaatgaatgggtgtggctatgttccaataaacttgagtcctgcaaagggagtaggtagcaaggtagacaatcaggtgaatttatttcagatttaagatgcagaatactcaaattcataagaactgagagatcactgtgagtcccaggattcacacaggttttgggtttgctggagtatacaactagaagggatgagtaatgggagctagggtttcttaaacgtagtgtgcaatctttgatacttcatgttttttttgtaatgttgagactatatacagggccttaaatatggaagtggaaaatatacatacaatacgatctgttatttttgcttcaacctcacgatagcgtgtctattgcacttaggattttgctatagggtacattcccttaagggcacttactgagtactgctatttaccttgaatattacatgctttcactttccattgatcttggtcactgtagaagggagggtcagtccctgatttacatttgcagaaaatgactagtttttagacaaatgaagtgatacctctagggtccccagcaaactcttcttccagcacccagtttgctgctccatccacaaccttttgctgtggagccatggcatattcttaatgccttattaaaataatctgataagatcttttctaattattctttattttcataggaactaaagtcatcttcaaaggaaaaaataatacaggaataccttgaagatacttcagatttaggtccagatcactgcaataaagccattatctcattaaaacaaatcacactaattctttggtatcccagtacatataaaagttatatctacactatagagtagtctattatgtatataattacattatgtctaaaaatatatacacactttaatttaaaaatactttatttctaaaaactgctaacaaacatcaaagccttcagcaagtcataatctttttgctggtaaagtgtcttgccttgatgttgatgtctgctgaccaatcatggtggtggttgctaaaggttggggtggctgtggcaatttcttaacaaaagacaacaatgaagtttgctgcatcgatggactctgactttcagaaaagatttctcaatagcctgcaacattgtttgatagcattttactcacaggagaacttctttcaatattggagataatcctctacaactaggccagttttttaatttactaagtttataaaatattctaaatcctttgttgtcatttcaacaatgttcacagcatctttaccagcagtagattccatttcaagaaatcactttctttgctcatccataagaaagcatctcctcacctgttcaagtttaatcatgagattgcggcagttcagttccatcttcaggctccacttctaattctagatctcttcctatttctattacatctgcagttgtttcctccacggaagtcttgaaccccttaaagtgatcatgagggttggaatcaactgttaaggaaatcctgataatgttgatattttgacctcctactttgaatcccaaatgtttttgatggcatatagaatggtgaatcctccagaagattgtaaatttgcttcatttagatccaagaaaagagtcgctagctatagctttacaaaaacgtatttcttaaaaaataactctagaaataaaaattactctttgatccatgggccacagaaaagatttttgtgttagggggcatcaaaaacaacattaatctccttaaacatctctatcagagctcttgagtgaccaagtacattctcaataagcagaaatattttgaaagaaatatatacatatattttttctgagtaataggtctcaacattgggctcgaaatattcagtaaacagacgtgctgtcatgcaggatttgtcattccactgatagattaaaaaactgttgttccactgatagagcatagacaaggtagatttagtataattcttcagagccttgggtttgtcagaatggtaaatgagcattggattcaacttaaagtcaccagctgcattagctcctaatgatagagttagcctgtcctttgaagctttgaagccaagcattgacttctctctaggagtcaattgatttataaaaatcctaaatggcatcttctttcaatataaggctgtttcatccacattgaaagtttgttgtttagtgtagccattttcatccatcatcttagctagatcttctggacaccttgcagcatatatcctctacattagcatttgttgcttcaccttgcacttctatcttatggagatggcttatttcactaaatctcataaaccaacctctgctaccttccaacttttcttctgcagcttccttacttctctaagccttcacagaattgaagagagttagtgccttggtctggattaggctttggctgaagggagtgttttggttggtttgatctattcagaacacttgaattttcttcagatcagcattaaggctgttttgcttttttatcatttatgtcctcaccagggtagcactttttaatttctttcaataacttttcctttgcactcacaacttagctgtttggtgcaaaaggcctagcttttggcctagctcagctttgaacatggcttcctcactaagcttaatcattgtagcttttgatttaaaagaagagatgtgtaactcttcctcccatttgaacatttagaggccattgtagggttattaactggcctaattttgattgtgtctcagggaatagggacgtctgaggagagggagagagagtagagatggccagttaatggaacagtcagaacacacacaacatttatcaatcaagttcaccttcttgaatgggtgggattcatggagcctgtaaacaattaatgggtgcaaacaaatacaacagtaacgtcagaaatcactgatcacagatcactgtaacagatgtaataataatggagtagtttgaaatattgtgagaattaccaaaatgtgacacagaggcatgaagcaagcacatgctatgggaaaaatgatgccaatggacttgctggacgcagggttgctacaaccctcaatttgtaaaagtgcaggatctgcaatgtgataaagtgaagcacaataaaaggtagtatgcctttacttgtatgcttttaatttctcacttcgatttccaaatctctttatggtaagttcacttagtaactagtcagtctttcatcaggatccactgcagggcaaattggctttgtcccatttaccaagagcttgctttagatcgtacagtctgagaaggatatgactgcagaaagtgtcatataaaaaataataaaatcctgtttcatagggaacactactagaatgatgaggtttgtaaaagacttttattcaaaagaactatgagaagtacaaatgaacaatggaataaattaataagtgatttcattaaaatgttctgctttacataattaagacttagatgttatagattattctcagtttaaatttcatgagaaataatttgcaggacaccaggaaatgttgctattttgctataacacacattttaacattattatgaattccaaagactcaaaaatgttcattattttctgtataaggaactgtgagtctcaagatggcacaacttaacgctatttgcataccacagaggcatattctgggtggagccatgttctagaatttttttttttcacttgcttgtttgcttttcgtttcaaatatcaggccttcttgctagagaatggggtttgatcctttcacaacttagaatttctcaggattaattgataaatttaataagcttgatgttttaaaactaaagtcatgctacctaaataatactaaaaatatattaaaatgcatttttttggcatttcatactataaattttcagttgtttattaatcctaaaatgatccctgtattttaggttctgagggtagtggattttgttgaataaattattgtagaatcatttaacaaacattataaccagaatttcattctgtttggtaacattcatgctttggacatttttaaatcattagataaaaattttctttttctgggataagtgaagaaagtgggtttcctttggagaaacattttattgtaaatattttaatttaacaatttttaaaatgacatgatgtaattaaattatataaaagctacaacctatagtagagctttctctgaaagctctatccttcacagaattgaagagagttagtgccttggtctggattagtctggattaggcatccacaaatattgatttttgatgaaagaataaaatatgtggtcttttacagttatagattcataaggtaaaaataatagggttatttgaatgttaaaatcttatttaaagaatctaatatttcaatttattgaaaaaatgaataatttggacaaatagctgcatttaatttctggtcaaattgtagttactctgaattctgacattatcatttcattaaaatatgttgatggcatatgcctcactgacctatggtgtttgcatgtatgtgcacacatgcatacatcttttaaaatatacacttttctacatgcaaatattttttaatccagctaacctaattatgaccagaagccatcccttggatgatttcagttttcagctacatctggaatttgagaaggaatcaatttcctctacaatttaatcaaaattttattttacacaactcattaatagtaatgccttaggtgtacatttaacttaaacttttaaaagataattttattgtatggtgaggagaccatataacatttgtcataggttgaattgtatcttcccacaaccttatgttgaagttctaattcccagaaactcagagtatgatcttaattggtcatagtgtctttacagaggtaatcaagttaaaattaggtcattaaggtgtgatccaatccattataactggtatccttatggaaaggggaaatttggagacagaaacacatagaggaagaatgccatgttaacatgaagccagccatctacaagccaaagagagaagcttaaacagattcttccctcacaggcctcagaaagaaccctatcaatactttgatttcagacttccgcttcctccagaactgtgtggcaacacatttgtgttgtgtgtaagtcacccagtttgtggtatgttgttatgtcagccctagcaaactaacatagcatttatttttttgccaaatgacaagtcagctttcacccatggttaagttttgttaagccctactcataagatggcctcattttattaccgaagtgctctttgagccattgtggcttctgaaatgatggaatatttctcagaaagtcatatatacctccagaaatctggcttgtgtgatgattttcagtttcactggtgcagagatgttatataaacctatagcaatgtaattgtgatcaattttggggctagcatattaactattgtagttttcttatgaaaactgccttagcaaaactctttaatgatctggctctttttatgatttgtagagtatttgaaagaagacatgtttaattagaagtaacatgggtaaaataattgatgctatttttgaagaacttcctctaacactgaaccaatgagtttaatatccaaatttgaatatataatgtgtatccctgttgttatcagattaaaaaagaaagtgatttttatgcaagaaaaaaatgattcctaaactgtttttcatttttcttatttttttctaagatagaagcagacattgaatggcagatatcttgcagagcataaccctagatcaatactattcaagggaggctgcttagtaggttccaaaaacatgagctctaaagcaaccacaattttataaagcctattttactgaatcagctatggcttgctgacactaatgcagttgtaatgcttgaataagcttagtcaaataaagcttatgaagctcactccacagaaattactgctttgagtgatttaaatgtcagaaatatgggcttgtcatttttttcccagtaaaatcctattcagataagctatttgaaatgatccgatagggaattcactgttccttgtaatactgacagtcccaatgcctagagtccaccctgcattgaccccaaggaaagtgacgtcctgcctgtctctagcagtaatacaaggttgagtcccccgacagtaaatatcaaattggttcttagaggacaagggtctcatttttcatttattttttaacctcctttagatgctgaggatgtaattttatcttgggaatgcttaataaaatgactgctctcctgcttagtaaaaactgaaatgttaagcagtgtgaaggggccagatagaaaaagtccattcattattttatttatatctttgcttttaaaagtcagtttctatcagcaatgcaattgcccagagaaaaagccttttattagttgccaatgagtggcatttcttcctcacaaaaattttaagacccccatcttaggtctatttggacgagcaggatgagaatgttgaagactaagcaatacacagtactttgaaaactctgataatgagtagacttcagaaaattggttctttttaactcttctttttcagtttcctttcatatcaaagaggaaaagaatacttgtccccactctctaggtgggtgcagctttatcggcctgtttctaaaactgtgtgagctttttagaagaaaggtgttgtataaagtattatttgtgtttacctaattgcttgctcttttgaaatatgggcatgaataccttaatgttcttttcagaagcacataaaggagcttcaagctcatttaaaagtccttcgaaaggcacagggagctgctggtttttttcttcatagattaaatgataaaaacaaaacacataggaaaccttatctctctaaattttcaggctgcattttcttcctaaaatacgtgtatttccttcgtgagatgtgtatactcaatccagaaagatagaggtttgggcaaaactatcatgatctgttctaaaccttttaaataacttaataaagatttgggactgggcatggtggctcatgcctataatcccagcactttgagaggctgagacaggtggatcatctgaggtcaggagttcgagaccagcctggccaacatggtgaaaccccatctgtactaaaaatacaaaaattagctgggcgtggtggggcatgcctgtaatcccagctactcaggaggctgaggcaggagaattgcttgaacccaggaggtggaggttgcagtgagccaagatcgtgccactgcaccccagcctgggcaacaagagtgaaattccatctcaaagaaaaaaaaatatttgggttcaggtaaaacaaatataatgatatgttaatacaatggtgtccatatttaaatatatattttttctcacaaaattcttaaatattttactatatgagagagaaaaatactctatggatttgttttctacacaattgtggtaatagcattaattctggagtcactaaagaaagtgccaatttatattactgacaaatttatattactgataattaaagatgcatgaaagtagacatattttattataattttttatatcaaagcgcttgggctactcaataaattcagtcctttccctgtttactgattatatattttaaaacagtggtttccattctttttggcaccagagaccagttttgtggaagacaatttttccacaggccagggcaggggacatggtttcaggatgagttaagcacattatatttatcgtgcactttatttctattattactactatcattattattttttttgagacagagtctcactctttcgcccaggctggagtagaatgggcacggtcttggctcactgcaacctctgcttccagagttcaagcaattctcctgcctcagcctcccaagtagttgggactataggcatgtgccacacacccggctaatttttgtatttttagtagagacggggtttcactatgttggccaggctggtctcaaactcctgacctcatgatctgcctgcctcggcctcccaaagtgctgggattacaggtgtgagccacagcgactggccctgtttctattattattacattgtaatatataataaaataattatacaactcaccataatgtagaattggtagaaactctgaagtgtgttccctgtaactggacagtcccacctgggggcgattggagacagtgacagatcatcaggcattagattctcataaggaaccaacaacctagattcctcccatgcacaattcactatagggttcatgatcctatgagaatctaatgccgctgctgatctgacaggagatggagctcaggcggtaatgcaagccctggagagtggctgtaaatacagataaagtgttgcctgcccacccgctgctcacctcctgctgtgtgacctggttcctaatgggtccgtggcctgggggttggggactccagctgtaacatatctctagtcatatacacatacatattaaaaattgtaattgttaaattatcactacttttccaacaaatggatggaaatttccttataagtagaaaatataggactactatcatttatatttaaatatatttttaaaaaacaggttgcttcatcacatttgcctgaatactgaaaaaagtaaaatttaaaaaagaaacttgggtcttagttcttgcacttccataaatttcctgaaagtagctattggcaatatgaggaatctacaattttctgcctacagtcttaagcagaagctttatatgaagtatttatcattactagtgaatacatctgcatgaacttatggttaccttgtgtgcctttgaaggagggggactgtcatactctcttacaggtaataaaatagaatctactgtgacacaatagtgtgattatgactccatgtggggtaaagcagcaggaaatgattaattcttaaggaagagctgatttccatgaaaatatctttaggaaagagaaagtaaaaaacgcacattagagtcaacaaatcatgaaaagctcatgattctgaagcattcagcttagtatttttttccaaattgaaatggcatgtcattactcaaggcttttctgtttcagtgggtttgcaattcaatgacaatgggacaatttagtaggaggaatgctggggctaggtaaagttttatttgtgcaaatttggcccaggaagaaaatgtgtcagcacaaacataaaatactagaaaattaatttcccaaatgaactgagtatagttcatggatcttatgtttatcttattcaaatgatatttgctaagaaccagagccttgctactatatccgtgagattgaacccacataatttgggagattttctgcagattctttccgcaaacttctaattcacaaagttgggcaaatcctggaatggcttatcttactgcatgagacttcctgggttcatgagaggaagatgaataatttttctacaatgaaactgattcaacctgtcaaatttattttcgtaaaaggtcttttcatgggtcctgttaatttttatccctaatctgtcccactgtacatagtgccctctgacattttgatttaggctacttgggcatgtagtggtaataaggaatcctggccatgatttctgttattttaacatgaaagatatttattctattaaaatagccaagcttatcaagtttaacatatactaatagtcttttacagcatttctttaaacattcccagaaaaagatacatgctatggactggtttgcattcagccctgcccgataaaactttcatgttgaaatccttacccttaatgtaatggtatttatagataggggccttcaagaggtaattagtttagaatagccttcagactctcagaagtaaatgtctcctgtttaagcacactagggatagtattttgttatggcagcccaagcagactgagatcataaatcatcacacatttgtaaattgatgatcaggatttttattcattttgtaaagtaaaaataaaactctaaatccccaacttactgaatggctccttcctctctgcccagggaactccaaagtaaacctgaaaaactagttcaggccatgatgggaaggaggtgtcagacatgtctccttatatctccttccctttggaattcaggtgcaacttgccagcattaacattaaaacagagatttttaagagttgcgaaacagactctttgtagcaataagataccagattccaacttgactagcatagcatcatgtgacagatagcagaccctacaagaaataaaaatattgtaccccaaaatatatttgacatattttgaaatggccttattaggctgtctcttgcggaaaatctacattctgtagagaatttccctccctttccagatcttgtcctgatgcaggagagagtaactgagagtctagcacattttggggtctgataagagacatttgccatctattctctctgaagcctgctacctgaaggcttcacttacataataagaaacttgatctccattgtcaggcctctgagcccaagctaagccatcatatcccctgtgacctgcacgtacacatccagatcgacagttcctgccttaactgataacattccaccacaaaagaagtgaaaatggcctgttcctgccttaactgatgacattgtcttgtgaaattccttctcctggctcatcctggctcaaaagctcccccactgagtaccttgtgacccccactcctgcctgccagagaacaacccccccttttgctttacctacccaaatcctataaaacagctccacccctatctcccttcactgactctctttttggactcagcccacctgcacccaggtgaaataaacagctttattgctcacacaaagcctgttggtggtctcttcacacggacgcacatgaaatttggtgccgcgactcagatcaggggacctcccttgggagatcaatcccctgtcctcctgttctttgctccgtgagaaagatccacttacgacctcaggtcctcagaccgaccagcccaaggaacatctcaccaattttaaatcgggtaagcagactcttcttactctcttctccaacctctctcactgtccctcaaccactttctcctttccactcttcaatctcttccttctcttaatttcaattcctttcattttctggtagagacaaaggagacacgttttatccgtggacccaaaactctggcgccagtcatggactagggaaggcagccttcccttggtgtttaatcattggagggacacctctctgattattcgtccaggtttcagaggtgtcagaccacgcagggacgcctgccttggtccttcatccttagtggcaagtcccgcttttctggggaaggggcaagtaccccaaccccttctctctgtgtctctacctcttttccacctttctggggggcaagaaacccccaaccccttttccttcaccctgagcagcaagtcccgcttttctagaggaggggcaagtaccccaacctcatatctctgtgcccccatcccttatttccgtgccccaacctcttatatcgctgtaccccaatccattatttctgtgccctaacctcttatatctctgcaccccaatcccttatttccatgccctgaccttgtatctctgtgccccgacccctttcccgcttttctggagggtaagaacccccaaaccccttccctccatgtctctactctcccttttctctgggtttgtctccttcactatgggcaaccttccaccctccattcctccttcttctcccttagtctgtgttcttaagaacttaaaacctcttcaactctcatctaacctaaaatctaagtgtcttattttcttctgcaatgccgcttgaccccaatacaaactcgacagtagttccaaatagccagaaaacggcactttcaatttttccatccttcaagatctaaataattcttgttgtaaaatgggcaaatggtctgaggtgcctgacatccaggcattcttttacacatcagtccctctatagtctctgttcccaatgcaactcatcccaaatcttcctcctttccctcccacctgtcccctcagtcccaaccccaagcatcactgagtctttctactcttccttttctacagacacatctgacctctcccctcctcgccaggccgagctaggtcccaattcttcctcagcctccggtcctccaccctataatccttttatcatctcccctcctcacacccggtccggcttacagtttcattccgtgactagccctcacctgcccagcaatttactcttaaaaaggtggctgaagctaaaggcatagtcaaggttaatgctcctttttctttatcagacctctcccaaatcagtgagcatttagactctttcatcaaatatgaaaaacccagcccagttcatgactcgtttggcagcaaccctgagacactttacagccctagaccctaaaaggtcaaaaggccgtcttattctcaaaatacattttattacccaatctgctcccgacattaaataaaactccaaaaattaaattccggccctcaaaccccacaacaggatttaatcaacctcgccttcaaggtgtacaataatagaaaaaagttgcaattccttgcctccactgtgagacaaaccccagccacatctccagcacacaagaacttccaaatgcctgaaccacagcggccaggcattcctccagaacctcctcccccaggagcttgctacaagtgccagaaatctggccaccaggccaaggaatgcctgcagcccaggattcctcctaagccacgtcccatctgtacggaaccccactggaaatcggactgtccaactcacccggcagccactcccagagcccctggaactctggcccaaggctctcagactccttcccagatcttcttggcttagcggctgaagactgacgctgcccaatcgcctcggaagccccctagaccatcatggatgccgagcttcgggtaactctaacagtgaaggataagtctgtccccatcttaatcaataccaaggctactcactccacattaccttcttttcaagggcctgtttcccttgcctccataactgttgtgggtattgatggccaggcttctaaacctcttaaaactccccaactctggtgccaacttagacaatactcttttaagcactccttttaattatccccacctgcccagttccctattaggccgagacactttaactaaattatctgcttccctgactattcctggattacagctacatctcattgctgcccttcttcccaatccaaagcctcctttgcgtgctcctcttgtattcccccaccttaacccacaagtataagatacctctactccctccttggcaaccgatcatgcaccccttaccatctcattaaaacctaatcacccttactccaatcaatgccaatatcccatcccacagcatgctttgaaaggattaaagcctgttatcactcgcctgctacagcatggccatttaaagcctataaactctccttacaattcccccattttacctgtcctaaaaccagacaagccttacaagttagttcaggatctgcgccttatcaaccaaattgttttgcctatccaccccgtggttccaaatccatatactctcctatcctcaatacctccctccacaatccattattctgttctggatctcaaacatgctttctttactattcctttccacccttcatcccagcctctcttggctttcacttggactgaccctgacacccactaggctcagcaaattacctgggctgtactgccgcaaggcttcacagacagcccccattacttcagtcaagcccaaatttcatcctcatctgttacctatctcggcataatctcataaaaacacacgtgctttccctgctgatcgtgtccgattaatctcccaaacctcaatcccttacaaaacaacaactcctttccttcctaggcatggttagtgcggtcagaattcttacacaagagccaggaccacaccctgtagcctttctgtccaaacaacttgaccttactgttttagcctaggcatcatgtctccgtgcagcggctgctgccaccctaatacttttagaggccgtcaaaatcacaaactatgctcaacttactctctacatttctcataacttccaaaatctattttcttcctcatatctgacgcatatactttctgctccccggctccttcagctgtactcactctttgttaagtcccacaattaccattgttcctggcccggacttcaatccagcctcccacattattcctgataccacacccgacctccatgactgtatctgtctgatcctcctgacattcaccccatttccccatatttccttctttcctgttcctcaccctgatcacgcttgatttattgatggcggttccactaggcctaatcgccacacaccagcaaaggcaggctatgctatagtacaagccactatcccgcctctttgaacctctcatttcctttccatcgtggaaatctatcctcaaggaaataacttctcagtgttccatctactattctaccactcctcagggattattcaggccccctcccttccctacacatcaagcttgaggatttggccccacccaggactggcaaattagctttactcaacatgcccggagtcagataactaaaatacctgttagtctaggtagacactttcactggataggtagagtcctttcctacagggtctgagaaggccaccacagtcattttttcccttctgtcagacataattcctcagtttagccttcctacctcaatacagtctgataacagacaagcttttattagtcaaatcagccaagcagtttttcaggctcctagtattcagtgaaacctttatatcccttacggtcctccatcttcaggaaaagtagaacagactaaaggtcttttaaaaacacacctcaccaagctcagccaccaacttaaaaaggactggataatacttttatgactttcccttctcagaagtcagacctgtcctcagaatactacaaggtacagcccatttgagctcctgtatagacgctcctttttattaggccccagtctcattccagacaccagaacttagactgtgccccccaaaaacttgtcatccctactatcttctgtctagtcatactcctattcaccgttctcaactactcatacatgccctgctcttgtttacactgccggtttacagtttctccaagccatcacagctgatatctcctggtgccatccccaaactgccactcttaactcttgaagtaaataaataatctttgctggcaggactatgctgatctccttaggcactctctaagcagatgtcctgagtcatcccaattcttagaccttttatacctgtttttctccttctcttattccgtttagtttttcaattcatacaaaactgtatccaggccatcaccaataattctaaattacaaatgttccttctaacaaccccacaatatcaccccttaccacaaaatcttccttcagcttaatctctcccactctaggttcccacgccccccctaatcccgctcaaagcagccctgagaaacatcgcccattatctctccataccatcccccaaaattttcgctgtcccaacactttaccactatttcattttatttttcttattaatataagaagacaggaatgtcaggcctctgagcccaagctaagccatcatatccctgtgacctgcacgtacacatccagatcgcgggttcctgccttaactgataacattccaccataaaagaagtgaaaatggcctgttcctgccttaactgatgacattgttttgtgaaattccttctcctggctcatcctggctcaaaagcgcccccactgagtacctgtgccccccactcctgcctgccagagaacaacccccctttttcctttacctacccaaatcctataaaacggccccacccctatctcccttcactgactctctttttggactcagcccacctgcacccaggtgaaataaacagctttattgctcacacaaagcctgtttggtggtctcttcacacggacgcgcatgaaatccataactccttatcttaacccagacacacctgtctattgattctgggttgttagataataaactaactcttacttaactttttcaaccagctgtcaatcagaaaatctttgaatctgcctatgatctgcccctcacttcgagtggaaatgccccccatttcgagttgtctcactcttctgaactgaaccaatgtatagggtacatgtattgattattggttttgcctgtaacttttgtccccctaaaatgtgtaaaatcaagctgtaacccattcacctttggcatatgttcttgggacctcttgagatgtgccttgggccttggtcacttatatttggctcagaataaatccattcatttattttacagagtttgattctttttgattggctatctacccatttaatctcttcaatctggttttggaaacctctcccagatgttgccacttggaaatttaaaaggtttaataacatctgaaattgtctccttacaaaaagttttctctgtttgatgattggcattatttactgaatatatgctttctttctgtcatttttttctaaaacattagtctttcctccactgttgtagccttctttggaccagcaaaactttgcagttcttatgagattctcttgaacagacatgtttttacttctaccactagcatacctctcatctcaacgttttctcatatcatgaaaatgttttctttgctacttatttatttcttggattagaggtcactatataccgcataaccttctatatgcagaaatattgaggttatttaacatgacactttttaaagctgatttcctgtagcaacacttctaatatttctcatatttaataactattggggccttaactgtgcaaaatgtgctatgctaagtgctatgaaaggatagatgacttgatccctacctagggccttgttgaagaacaaagatctataaaaaaagtcagaataattttgttcacatcacagtattcatcaaaaaatgctatggtattacaagtaagaagagtagagttcaggtcaaaagattaaggaaatattgtcaaggagttgacatctgaggtaaatcttggaagaggagttagatttaaacagtgggaatttaataagattgttttaaaaaaataaatacagattcatcaggaacttttggccactttaaattagtaaaatgcaatgggcttcacctgtaatgtctcaggaattcaatatctctggcttcaaaaaatgaattctagccaagtgtggcagctcttccttgtagtctcagatgcctgggaggctgttgggaaaggatcacttgaggctggggtttgagaccagcctaggcaatacagcgagaccctgtctctagaaataataaaaaattaaattaagaaatgaattctagttttcaacctaaaataattaaaagtatcataatctaataatttaaagagagtttcttcaagtgcaaactgtgaggatggaccacttggaaacaccaactacaaaggaatgaagtcagtgttccaaagtagagaggttgaggctttatttacatagagaagaactctaagcagttttccaacattatttatacaaggttgttgcatagttacagctatttgattggtgataggcagggtctctttttgacagggtacatttaatatatattttataaagggtataataatcatggttttctgtcatctgttctaagcaaaccaggacaacaaagaggaagttaatctataacaatgtcattagaaggcaagaggttttccctgatgtcatttaattctgtctagccattgcagagaacaagaaaaatatgcaggtgagttaatctataatctgagaagttgtaactctaggtaactcagatcacagtcccatctttctcaaggcttaaagtgttttttgggggttctaaattttaaattttagcttttaaattttactagcctttaaattccagcttttaaattttactgattttacatagttatgctctcatcattgcttttcacctttaaattcaatttactgtttgtagaaaaaatagtgttctgaatggtgaggacctgctaaattgaaaatgtaaagtcaaagaccaataacgagctctgaaatggactgaaatggtcagtaacaagtaccctactgaccaaaaaaagcctgggaccagatagattcacagctgaattctattattaattgatatacaaagaagagctggtaccattccttctaaaattgtgtattagttccttttcatactgctataaagaactgcctgagactgtgtaatttataaaggaaagaggtttaattgactcacagttcagcatagctggggaggcctcaggaaagttacaatcatggtggaaggtgaaaggaaagtaaggcaccttcttttcagggtagcaagaaggagaagtgctgagtgagggagggggcagagccccttataaaactatcaggtcttgtgagaactcactcgtcacaagaacagcctgggggaaactgcccccatgattcaattaattccacctggtctctctcttgacatgtggggattatagggattacaatttaagatgagatttgggtagggacattgagcctaaccacatcagaggcactcctctccaactcattatatgaggccagcatcatcctcataccaaaacttggcagaggcacaacaacaaaaaaagaaaatggcatgccaatgttattgataaacattgatgcaaaaatcctcaacaaaatcttgcaaaccaaatccgtcagcacatcaaaaagctaatcgatcactatcaagtagtcttcatccctgtgatgccaggttggttcaacatatgcaaatcaataaatttgattcatcaaataaatggaaccaaagataaaaaccacatgattatctcaatagatgaagaaaaaggttctgataaaattcaacattcctttatgttaaaaattctcaataaactaggtattgaaggaacatacctcaaaataataagagccatctgtgataaacccacagccaacgtcatactgatggggcaaaatctggaagcatttcccttgaaaaccagcacaagaaaatgatgctctctcctaccactcttcttcaacatagtattggtaatcctgtccaggcaagagaaagaaataaagggcatccaaataggaagatagaaagtcaaactatttctatttgcagatgacatgattctatatttaaaaatatcaatagtcttggcctgaaagctccttaagctgataaacaacttcagcaaaatgtcagaatacaaagtaatgtacaaaaatcagtagcattcctatacaccaacaacagccaagctgacagccaaatcaggaaggcaattacattcacaattgccacacacacgaaaaaaccacctaggagtacatgtaaccagggaggtaaaagatctctacaatgagaattacagaacactgctcaaaggaaacagagaaggcaaaacaaacagaaaaacatcccatgctcacggataaaaataatatcattaaaatggccatactgcccaaggcaatttatagattcagtgctgtttctatcaaactaccagtgacattcttcacagaactagaagaatattttaaaatatgtataaaaccaaaataagggcccaaatagccaagacaatcctaagcaaaaaggaaaaagatggaggcattacattactcaacttcaaaccatactacagggctacagtgagcgaaatagcatggtactcatacaaaaacagtcacatagaccaatggaacagaatatagggcacaaaaataaggccccatacctacgaccctctgatcttcgacaaagctgacaaaaacaagcaatggggaagttatatgtaaactcatgtcacatgactccctactcaataaatgatgctgggataactggctagccatatgcagaagattgaaactggacaacttccttacaccttatacaaaaatcaactcaagatggattaaagacttaaatgtaaaacccaaaactacaaaaaatctggaaaacaacctaggcaatatcatcctggacataggaatgggcaaagatttcatgacaaagataccaaaagcaatagcaacaaaggtaaaaattgacaaacaagatctaattaaactttagagcttctgcacggcaaaggaaactatcaccagaatgaacagacaacatacagaatggaagaaaatttttgcaaactatgtatctgacaaaggtccaatatccagcatctataaataacttaaatttacaagaggacaacaaacaactccattaagaagtgggcaaaggacatgaaaagacacttttcaaaaggagatatacatgcagccaacaagcacatgaagaaagctcaatatcactgatctttagagaaatgcaaatgaaaactacaatgagatactatctcacaccagtcagaatggctatcattaaaaagtcaaaaaataacagatgtgaggccgcaaagaaaagggaacacttatacactgttggtggaagtataaatttgttcaactattgtggaaagcagtatggtgattcctcaaagaactaaaaacagaactcattcaacccagcaatcccatactgggtctatgcttagagaaatagaaattattctaccttaaagacacatgcatgcaaatgttttgcagcattatcaaatagcaaagacatgaaatcaacctaaatgcccaccaatgacggattaaataaagaaaatgtggtacatatacaccatggaatactatgcagccataaaaagaacaagatcatgtcttttgtgggaacatggatggagctgcaggctattatctttaggaaactaatgcaggaacagaaaatgaaatatcgcatgttctcacttataagtgggaactaaatgatgacaactcatgaatgcaaagaagggaacaacagacactggggcctacttgagggtggagggtggcaggagggacaggagcagaaaaaaaataattgttgggtaacgaagcttagtactggggtgatgaaataacctgtacaacaaacccccgtgaaatgaaatctgccttgaccttgcaatttccaagccactagaactgtaagaaataaatgtttcttgttgatagctacctagtttatagtattttgtcaaagcagcctgagcaaatgaaggcacttgctgtgatttgatagcctacttctcaacagtgctaatgttccttcttattttaactcctgtaaattcactttccccctaccttatgaagttggcattttcttttttttttattttattttaagtttggcagtacatgtgcaggtgagttatatgtaaactgatgtcacatgtctcctgacacttttcatgaaagccctaaattgccacccactccatccactgttccattaagtgaatttcactcaatccactgttccattaagtgaatttctttttctagtggtgggactagaaatggaaccagcccttgtttcccagacctccctttcctggcagtagaccttcattgctatggtctgaatgtttgtgtctctccaaaatacacattgaaatcctcattcctaaggtgatggcattaggagttggggccactggggagtgattagggcaggaaggtggagcccatgaatggaattagtgaccttataaaagcggcctgggagagactcctcacccgttccactcaatggaagagtgaatggagtgggtaggtaggaaggagtgccagataatgttaaaataaatagataaataaaataaaaataaaaataaattaaaaaagaaaaaccatacatatgtcaacctcagcagacagactaagtggcaaaaacatcctctgaaattgcattatgataatcatatcccaaaaacctgggagaaaaggtggcaatttagggcattcattaaaagtgtccagagactagtttacattttgtaaacactagaattggtaaaaaacattttaagttaaataatgaatttattatgtttgagctttatctgcccaaatgtctttccacttgaatttctatgaagttcttatttacatgcatgtattttggaacacaaacaatatagcaagagtcaccttttcatgtgattgggaattatgttcttaaagtaatttgggaataacacatataatgccatcagtagtatatacttcctttctctcatttgctctacacatcttgaaagagagatacagtgtaagagtactacacaaaccacatcacagggtgaaatgcaaaatcataattaatgcttttatgtaatgagaatgcaatgtttcatttataccattctagaatgtaggtgtcttccttgagcatcctgaaagagattgtattgtcagtgtcccacaggaaaaataaagaataataatatggaagtgcacttggcagtttcttcatctgatcgataaggcatcatgaggttaagtgacttctatcaggaggcttatggcttattcttctgcatataacctgactctagagccagtctttagatccattatataagcaatccctccttttactctataggaaagagtcgcatggccattaagtgagatccctacttcttttgaggctgattctgtctgacaatcaaaattttgtatgaaatcaaaatgaatagaattaaaaagcaggcctggaaagtgctttacatatcctagctgctctgctccaattctgagataccaactttcaagaggcatagcccatgtcaaattgctcggtaatatttacctctcattttttctgccatatcaataactagctcttgtcatctttaaagtgcttctcaaacattaaataatctcagatcacatactctgttctttgcatttatcttgaccagctgtcagagaaggcaatttattccctctcaattttattcctcttggctctgtgtggcttctgcagtaattttgaatggaaattgaaaggtacaacttaatgtgtttcataacaagggcaacacataattttctttaagaaggatgaccttcagattactttcaaattgcttatagctttggggttgtatactcagaacatattttcagtatctttgagtcatgattaattcttaagtggaaattttgagggtgtgaagattaaaaaaaggacaatgaaaaacataacagtattaatttatcattttcatctatttaaaaattgtaccataattggattggaaggatcattaagtgaatacaaatttagaattcatattatgtcagttgtttagaaaacgtaaaattcatttttaactcagagcttgcatttctgaatatttatactttctcaattttttgatcaaagaaaggaaaatgtgtgtatatatatatatatatatatatatatatataaattcatgttctgttttaaatgtttagcctttttacaatgtgaccaggattcaactcattcatatcaaatctcagtaaaattactccttgagtttcggtatacaaagcaggtatgtgtaatactgtttacagaaatagtctctaatatacaactcaatacagtgaatctgaagtgcaaaagcaaattcttgtgttctctgcttagtggtagtaggaaggcttccagtggttaaaaaactgcagattacaacatatcaactttcaggtgggccagtcctaaacactcataattggtttactttgctgcaaatcattattccaaaggtttgattcacttgtagccccacttgggtcttaaattgcatttcaaagcactcctatcattcatccattttcagaactaccattaggagtgatgtgaatttggcacaataatcaatgagaagatattatatgagtccttttaaaattttccttcttgagcaccacctcaagtgcagtttgtgaaatctgggttttagaagtattttttttatcttgctatcattttcactaagttaagttcaagaacttcggatatgtattccacagttttttttccgaaaagagatttgttgtcactattgttaatttctacctaaagccatttaaacatcttaattaaattattttgctccgatgttccttatcagcttttgaattttttgaaaatatggggctaaatttatcactgttatctaaaaaataactaaaaaactaattttgtttggttaccacctgttagtatgtgctcttgaatgcatttgattttctttcctgattagtcatagaatttcatgttatttatctcatttttgtaaagagaaggatagtattattttatgactaaagaaaccagaagagtaagactttattaactaaagtatttaattttgctggcagtgttatttctttctccaatacttaaaaattatcttataaactgcacttatactacaagcatcctgtgtacatagctgtttgaagggttcaaatattatttttctaatttaaggaattcagttatagtgataatgtttgtaccatgatgaaataactctatttgccatagatcatcttttctaattttgctaatgggataaaacagcctctacttgtacggataaattatactgtatgttcctctttgcctgtattacaagcagtcaattaattgattggaaaggataccaaggaagtcagagaatccttttttgagtccctgaaaatatcttagcctaatgtatgtgcttattaaatggaaacaaatgcctgcatttattgaagagttggtgcttccacctttgtttccgaggttaatcctgcctttctagccttttcttagagtgatatttgtagttgtagtgagagtcatagttgtgctggtagcaatgaaggtgatgtaataaatgaaaatagtggtgatgataataatgattatgatatagctcagtagttgttgtattgtcatttattaaatgactaccatgtaccaggaaatgtgtcaaacaatttgcatgagttatttctccaccatcacacacctgcaaattgagtcttaccaatctcattcatcagatctagatgcttctcactcagagatgtagtgtaatagcgaccttctagccatttgggtaatgcagagagaagccaggagttaattccaatctcttatctatgaagcccaaagcataacttttttgcttgactgtttccatggaaaagctagacatacctgaaaggaagagttgtgatggtagagcaagagactgatggaaagaagcactttaattccaccctgtcttcaaagagcacaaaggctaaaatctttcaattattattggacacattctaaaagaaactacagctactctttccagttgggtaaaactgactttgtgaaaaatgttaaagaaatttgagaatttagattttcttatgtatccatcacatagagatgttgcaattttgagataaatagtaaaattgaaacaatgtaatcatgtattttatattgaatcaaagttttctttcttggcatgtaattcttaaattattatagacaatatggtctgtattttaatacacaaaaatgttttttaactttgcttgtggcaaaaatatttggattggtagagttttattttcccttaagtattcaattacttacttcacatctgtataatttgggatttaaagtgctatgaacatgattttaattttctagtaggtctgcaattgttcttaaatgtaacatgaaatagttgttccagatgatctctcagttacttctagatttaactttctacgagtcaagtgtagcccagataatgagacatgttttctctccatccaggaggctttctagccatacagtagtatcaattttatagaagaagaatgagttacaccattgttagatgtacgttctgtatattaaaatagcattaaaagaaaaggtaaagagtcaccaaaaaaaggcaacataaaggttaaagtgttattatcttacatatgtgtgtatgtatgcaattttataaaccaccaaaaggaggtttacagaaaaatggaggaaaaatccacaagaaaagaaataccaaggaaaaacgaacatacaaacagctcatttctagtaatcaaatattgcaaataaaattcaaatcttctcttattgcaaaaattttaaacatcactgatagtattgtcaaggataaggtaacaaaactactggcatgcacaatttttaaaagatactaactttcaaatacgtgcatgtattctcaaagctataaaagtgattatgttatttgtcccaggaattctatatttaggactttctcctaaagaaataaataataatatgtgctgagaaaatttctgccctatcccaaggtagaaaactttttgattaaattatgcacagccataaaattacatgtcatgaagccacttaaatggtattttgagaaatacagaatggcaataaaacacacttctgatatattgcctagtaaaaaaaagtaaaagacaatgtgctaatgacttgtcaaaaccagataaaccatatttatatatttatatgtatgtacagaaatatacgtgcaaaatattaacagtggttatttctgggtggtgagattaaaactatctgcttatctatttattttatttttatattttttgaattttctctcatgaacatgtggactcttaaaatcaggaataaaagaggtactggatatagtaagactttctaacatcattatcttagatcttctgtgcccctacaaacaaacaaacaaacaaacaaacaaacaaaacatgaatgacctcattagatgacctcactagatgggtcaattatacaattaagttaaaatattcagaagaagttttatccatttgaaccattttatcacttgtgttgattctccctcagaggacttaggagatgagaaacactgattatatgagcgcacgagttttagggagaatagtaaatgctgaggaaaagataatgtgttagtgggcagggaggctttgtcctgccactaaggagttgtgctgctctagaaagcagtataaacaggttcagcactcatatagtcagtgtttctcatcatcaatatttaccatgaatctctaaattatattttcctttctgaatgtttgattaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcaggtaagttccataaaatttggctttaaaattaaaattaattcaaatggaaagaaacagtgtcccctccagttcctgcttggtttctgtttcatcttagtgtgaggaagaaacaccccacaaatgtgcttgaggatcactgaaatctgtttcattcttccctttttcctcctattctctttctttgttggtggtacttattgatttccaatgaaattgatatccttatttgcaagagctgaacaaagcctgaatgttgcagttcataaagataatagttaaaaagcttgggtgaagatttcgtttggaactggtactttatcaagcattaataaggaataatttgtaggttttacacttggcaatataaaaccaaaccaatcaaaacacttttggacaaatggaaaatattttaaagtatttttaagccctgctgtcatctggtcctaagtgtccttgccagacaaactctttgcttctgccaccggccatcctattttgagttcctgaaaataaagagagtttttcacaaaattacatataattgttcattttttgttcaatgatattttacatattttaaactgtatttatttattttgacatatgacaccctctattgactgtgagctccctaaggaaaggaatcagccaagtgctgagtaaatgttacatgactagatgagtgaatttattcttatcacttttttaccataagcgaaacatttcattaatcttttaatgtgttctctcatatgtactctcccctccccttttttctttctccaacaggagtagaatcagtaggacccagacactataaatactagtaattgcattctacatattcagggttctcctatttctcattatggaattttactcattcagcaatcaaatgtgtattctttgtgtcaggagatggctatgccacagacctcaagaagaaatacaatataaaattatgaaaatagaactctgttgtttgggtttattggcataaaggtgtgatatagtttggatatgtgttccctctaatctcatgatgaattataatccccagtgttggacatgggcctagcaggaggtgactggatcacagggatgcattttttagtgagtggtttggcactgtccccttggtgctgtcctcacaatagtgagttctcatgagatctggttgtttaagtgtgtggcacctccctgctccactctctccctcttctctggccatgtgacatgcctgctcctctctcctccttctaccattattgcaagcttcctgaagccctcccagaatccaagaagacaccagcatcatgattcctgtacaacctgtataactgtgagcctattaaacctattttgtttataaattacccagtcttaagtatttctttatagcaatgcaagagctttatagcaatgcaagagcttaatacagaaaattggcaccagtagtggggtattgctataaggataccagaaaatgtggaagcaacttgggaactgggtaatgggcagaagttcaaagagtttggattgctcagaagaagataggaagaggaaggaaagattgaaacttcttagtgactggttaaatggttgagaccaaaatgctgatactgatatgaacagtgaagtccaagctgatgaggtctcagatggaaatgaggaatgtattggagactggatcaaaggtgatgcatgttatgccttagcaaagatcttggctgcattcttttcatgccctagggatctgtagaagtacggacctgagagtaatgacgtagtgtatctgctggaagaaatatctaagcagtaaaacattcaagatgtagcctggctgcctctaccaacctattcaaagatgtgggaacaaaaaaatgacttaaagtggaacttatctttaaaggggatgcagagtataaaaatttggaaaatttgcagcctagccatgtgacaaagaaagaaacagcttttttgagagaggaattcaagcaggctgtggagaaaccacttgctagagaaatttgcgtaactaaaaagaagctacgtgctgatagccaagaaaatgggaaaaaggtcttgaaggcatttcagagacccttgcaacagtctttcccatcataggcccagatgtctaggagttaagaagggtttcctgggtcaggctcagggccccactgccctggccagcctcagaagagtgctgcctatattttggctgctctgggtccagctgtggcttaaaaggccacaggtgcagatcaggctcccactccagagggcacaagccataagccttggtgcctttcatgtgatgttaagcctgcagccatgcagagtgcaagagttaaagaggcttggcagcctccacctagatttcagagaatgtatgggaaattctgggtgcccaggcagaagcttgttgcagtggcagagcccaaacagagaacctctattagggcagtgcagaggggaaatgtgtgtttggaggacccacccacacagattcctcactggggcattgcctagtggagctgtgggaaggaggccactgtcctccagaccccaaaatgatagatccactggcagcttccaccctgcacctagaaaagctgcaggcactcaacaatgtgtgagagcagcctccagggctgaaccctgcaaaaccacaacggtagagctgcccaattccttgggaccccacccctcatatcagtgttcccaggttatgggacacagagtgaaagattattttggaaccttaagatttaatgactgccctgtggggttttcaacttacatggggccttagctcctttcctttggctgatttctcccttttggaacagtaatgtttacccaatgcctataccctcattgtgtcttggaagtaaataacttcttttgattttacaggctcataggtggaaggaatttatttccagatgagactgtggactttggactttggagttaatgctagaatgagttaaggctttgggagactattggtcggggatgattgtattttgcagtgagagaagaaaatgagatttgaggggccagagataaaattatatagtttggatatgtgtcccatataatctcatgtcaaattgtaatccccagtgttcgacgtggggcctcttggaagattattgtttaatagagatggatttttgaagaatggtttagccaattcccttggtactttcctcacaatagtgaatgagatcttgtgagatatgattttttaagtgtgtggcacctcccccgccccccactctctctcttgctcctcctctagccatccatccatgtgacctgcctgctaccccttcccttcaacttccaccatgattgtaaacaccctgaagccttaccagaagctgagtagatgccagcaccatgcttctgtacagactgcagaagtgtgagccaaatgaacttcttttctttataaatgacccagtctcaggtatttctttatagcaatgccggaacaacctaatacaaggtgtgattgagttgactctgccagcataccattggtagctggactaccaatgagttagattctcatctaacaagtagagaaaagtcccgtgatatcaaagaaagcaaaagggctatttatccagagtcataaatgtctaatgtaaataggcaatacatagtttattgtataatagaggcttttaaaatatacacagttgtaatgtctataatgtaaattatgacctagagttttaagtaaaagacacttggttaccttactctacaaaatttcatttcccttgagcttgcattgactgaagtatttccctatcagatgaaatgccagtaacataggcattgcccatagaaattaattgcagctctccaatggaagctctactgtgaactataagtatgccttattttaagtaatctaatctaaaaatctaattataggtagctgtgcattttataaaataagaacaaattcctttcaatgataatttctgtagtacacttgtacattgttaactttacaaatatttgatttatatgcaattcttgaaatatgtgtattataaaaatgaaagaactatataaattatggcttcaataacagtttcaaaatgtaaattatactcacatatttaatgttaattttgatagacacaattcaaacttttgctagggattagtattatcatgatgaatcttttgtaccatgtgataatctttgaaatatataattgttagtatttacaaaacaaggctagtggtaaaagaaataaactggaaatgatttggaaggccagaaagtcagggcaactgtcagttactctctggaagtttagaaaagtaggtaaatgccgtgaagccatgaaaaggttgttcatagagaaatgaaaatctgtttttataagctcatactgtactggattgagaagaataattctcttctgggcaacctttacaattccccctattttcagaattctgtctgatttatgcatatatttgctactagttggggacatgcagaattggcttttatttgtggttcatttagatgatttgggttcgttattcagctctatgaacctacaagctaacatgactaggaacttatcttttcttgtctgtgaaatggggataacatcttgctttctattctgcaaaatttttgactttgattcttcttatcaaatgagacaaattttaaggcaccaaataaacagactggaaaagatatttcacctacaccacacttcttacttaatgtaacatccaaataatattcaaacaatactatgcctatctgtcaatgtttgacacaatagctgaaagcaactctgaattacatagaataagggtttattatatcgtttatgaattcatggtagctgattaatctatgtaaggctgttgcaatgcatctggtgttgagtggaaagtagtcagggtggaaattgggaagggaagatggatagaatgggagggacttgggacaaactgaaactgacaagaacaaagtggaagacttgtttgtctctcaccaccacaaattacaattatgcggatgagctgcaggataaattgacgcctttcccccacggaactgcacgcgcacctggccaggatttggagacgctgaagaagccagcccagtgtgcgctggagatgtggcggctgttgccacacaacaagggcagctagactctctgggatcatgagcgtgagctgcaaaagcacctgccctacaccaaccttcagacaataaataatggcttcattattgccacattcgtgccttccaaaacttgcaaaaatgtcttgtttccaactgttacctgaaaacatacatataagggatttctgggaagacagttccagcttagtgctttgacagtgtgcaaagtcttcatataggacaacaatatcatctaacagctgaaacaggatacttgtgagagtgaaatggggagcaattaagatttacctcaggacatcagacacaaaccaaggtgtatgatcgctctgttatccacattgactttagttctctcctcaaagaagaatgattttggaaaccctaagtgggggatgggaggacagagaaacgttgctctcttagtaattgaggctagaggcttagaaaggctgccggagatcttcccttcaagcttctgcagactcagccagaaagacctccctctcagaaaatgaaggggtgccttgattatgtattctgatcttttggggccagaatttgtaggctttggttgaaatttcttacaaatttcttttgctttatttatgaagtgacaactttctcgctaaacaatcagaagtgcaaacaaataggatttataaagaaatgactacaaactaaggcattagtggatgttgatgattttcttctaggtcagaatgtacagcaatagaatgtggtaactcttttccttcctaagaacaaggatcatcattcattagcatcctcatccattagaggaaaacatcattacatggttgtaccagcgtgtctcaaagcacacttggtaatttttgcaagcattccacaaaatatacttatttcaaaccaattttgtaagaattaaatacaataatctatgtaaaacctacatgcctggcacataggagggactcattaaatgtaacttgaatttgaatcttattaccaggaagtaagatctgtaatctgagaagagagccagcaaagacataatagtaggaagcatcaatttcttatgaaaagtcttgcagacatctcctgatgtgccttttaaatagattttctaatgaggtgtgccatttatctgctgctcttggaaattaattttcctgactttttttcttttcttggcgcttagcccagttaagcaggtgcacggtttgtcaggctatgaatttagcagagtaaaatcatttagggaaggcccaaagtcagtcagaaagtacaaatttaacatttaattttacactcatatacacacacacacacgaatatgttattactttttaggaaacatggaagactgaaacactaaatgcaacatttaggactctatcaactctcatgtgtactgagttttcaaggagcacattttgtgtgtttcttactctgattcaagtcttatctcaaattccatattttctgctcactaccccaggcctatttggtcctcttggtcattacacctaaaaagatgcattttactacccaacttcagtctgtctatgagtacctgaaggaagcaaagagttctataattcaatatttcccagactctaataaaaagtgtatcaattcttcatgaaatgaggaaaaagataaagaaaaaaagtattcatttttaagaagtgttcttaattcttagattatattgttcctacatttttagtcttaaaattctcttttgaaattgtggtaaaaccggatattgtttttattgttgttttaataaaggcaagagcctgaggtgggagaatcacttgagcccagcaggcggatgttgtactgagttgagcttgcgccactgcactccagcctgggtgacagagtgagaccctatcttaaaaacaaaaacaaaaacaaaaacaaacaaaaaagtaaagcttccaaaactaaacctcaacttcattaaacaaatatgtattaaataattagtcagaatatgttaattgctgtattatctcttctccactaatctgttaaatttataatatggtgatccaagtaaatcatccaactggagtagtataatattttgacttttatgccaccagaaaattatttctgttgaatcgtagcttggaaacaaatttatggaaatctataaacctacaaaaaaccatgtgttcccatttcttattatacgcatagattcaaatcttgtttatatttaacatgggctttttttaagaagagaaaagcaaattcaatagtcacaccttttatacatatttattaataaaagtacaatatgatgccctaattttcatctggatacttgacagggataaaagaagccagaagtagttttttattttgctttgaaatataaagtgcccgttatttgacataggtctagctccagttagctggaagtattccaggtttaaacatctgtcgcacaattttgctggtaaagaattggttgattagggtcatattgagtaagagaggtgaaatatacatctatttgcattcagtaatgttccttttgcctcaagaagtaatagttgagtatcagtaaacttagttttacattgccataaacaattatatactgaaataaccacataattgtaagtagggatgtttgtgtttaatttcattaggtcccacacaagtgcacatttctaaactactgaagtaagttaatagtaaagatgagtgtggaaaaatttcagttgagaaagttttttaaagcagagggaaaatgcccatgcctcagatattgaaaagcaaggattggagctacaatatgactattcaaatgtagattagcaaagtgacagtcatttccttctgcagtcaataaaacaattagctcaccaaaagtgcttttaaatcaggatcctagtttttcctttggtttaaaagcatctaaatatccaacaatacttgcagatgcaagtattttattttttcaaaattgcaaatcaaatggattttatcttttagaatccaatgtacttcaggagttttgcatcctaccctttattttattttattttttgcatgtgtctcactctcttagtctcttttggctgatataacaaaataccataaactggatagcttataaacagacattatttctcacaattctggaggctgggaaattccagatcaagttgccagcagttttggtatctgtgagaacctactctgtagctcataggcttcttgctgtgttctcacatcatggaaggggtgaactctcttaggcctcttttataagggcactaattctgtttgtgagggctctgccctcaggacctaattgcctccaaaggccacaactccaaatactatctttcacattttactcatgtccatgtgaagagaccaccaaacatgctttgtgtgagcaacaaggctgtttatttcacctgggtgcaggcgggctgagtctgaaaagagagtcagcgaagggagatagggatgcggccattttataagattcgggtaggtaaaggaaaattacagtcaaaggggggttattctctggcgggcaggggcaggggtcacgaggtgctcagtgggggagcttttgagccaggatgagccaggagaaggaatttcacaaggtaatgtcatcagttaaggcagggaccggacattttcacttcttttgtggtggaatgtcatcagttaaggcaggaactggctatctggatgtgtacatgcaggtcacaggggatatgatggcttagcttgggctcagaggtctgacattcctgtcttcttatattaataagaaaaataacatagtggtaaagtgttggggcgacgaaaattttttggggggtggtatggaaagataatgagcgatgtttcacagggctgcttcgagagggattggggcggcatgggaacctagagtgggagagattaagctgaaggaagatcctgtggtaaggggtgatattgtggggttgttagaagaaacatttgtcatatagaattattggtgatggcctggatacggttttgtatgaattgaaaaactaaatggaataagagaaggagaaaaacaggtattaaaggactgaaaattgggaggacccaggacatccaattagagagtgctcaagggggttgagcataattacttgcttggttggtgagcttttaggctctatccaagtttttggggtgcagttcaagttgggctggtgtctggaatgagactggggcctaataaaaaggagtgtccatgcaggagctcaaatgggctgtaccctgtagcattccgaggacagacccgcctgaatgctgagaagggcaagtggtaaaagtattgtccagtcctttttaagttggtggctgagcttggtgaggtgtgtttttaaaagaccattagtccgttctaccattcctgaagattgaggattgtaaggtatataaatgtttcactgaataccaagagcctgaaaaactgcttgggtgatttggctaataaagaccagtccactatcggactgtatagatatgggaaggccaaaccgaggaattatgtctcacagaagggaagaaatgaccacagtggccttctcagaccctgtgggaaaggcctctacccatccagtgaaagtgtctacctagaccaagagttattttagttttctgactcggggcatgtgagtaaagtcaatttgccagtcctgggcaggggcaaatccctgagcttgatgtgtaggaaagggaggaggcctgaacaatccctgaggagtagtagaatagcagatggaacactgagaagttatttccttgaggatagatttccacgatggaaaggaaatgagaggttctaaaaggcggactagtggcttgtaacctacatggaagaggttatgaaatgatgacagaatagaatgggcctgtgaggctggaaggggatattttctttggtccaaaaaccatttgccttgtgtgggaagagattgatagatggaagtttcagtgagggagtgggtgagagtggccagatgagaaggagaaaatctgcacgagggatagaagttggaatgctagctgcttttttaattaccttatcagcataagcattgtcctgagcgatgggatctgagcccttttgatggctgcttttttagctaccttatcaggataagcgttgtcctgagtgatgggatctgatgccttttgatggcctttgcagtgaatgactccagcttcctttggaagtaaagtggctttgagaagcatttttattaaagaggcattaatgatggaggacccttgcatagtgaggaaatttctttcacctataaaacagcttggtggtgcaggatatggaaggcatatttagagtcagtataaatattgatgtgtagcccctttgtaagagtgagggcccgagttaaggcaatgagtttggcttgctgagaggtagtggagggggcagaaagtatatgcgtccggtgtgagaaagaaaatagattttggaagttatgagaactgtagagagtgagttgagcatagtttgtgattttgagggtctctaaaagtatttaagcagcggcagccgccgcacgcagacataagggctaggctaaaacagtaaggtcaagttgtttggacagaaaggctacagggtgcagtcctggctcttgtgtaagaattctgactagactgaagtcatggggtctgtctgtgaagccttgtggcagtacagcccaggtaattcgctgagcctgatgggtgtcagggtcagtctaagggaaagcagagaggctgggatgaagggtgcaaaggaatagtaaagaaagcatgtttgagatccagaacagaataatggattgtggagggaggtattgaggataggagagtatatgggtttggaaccacagggtggataggcaaaacaatttggttgataaggcgcagatcctgaactaacttgtaaggcttgtctggttttaggacaggtaaaacgggggaattgtaaggagagtttataggctttaaaagccatgctgtagcaggcgagagataacaggctttaatcctttcaaagcatgctgtgggatgggatattggcattgattggggtaagggtgattaggttttaatgagatggtaaggggtgcatgatcggttgccaaggagggagtagaggtatcttattcttgtgggttaagtggggggaatacaagaggagcacgcaaaggaggctttggattgggaagaagggcagcaatgagatgtagctgtaatccaggaatagtcagggaagcagataatttagttaaagtgtctcggcctaatagggaactgggcaggtggggataattaaaaggagtgcttaaaagagtattgtctaatttggcaccagagctggggagttttaagaggtttagaagcctggccatcaatacccacaacagttatggaggcaagggaaacaggcccttgaaaagaaggtaatgtggagtgggtggctttcattttgattaagaaggggacagactcaccctccactgtgagagttacccaaagcatctgtgatggtccaggagccttttgaggtgatcgggcagtgtcagtcttcagccgctaagccaagaagatctgggaaggagtcagtcagagagccttgggccagagttccaggggctctgggagtggctgccgggtgagtccgatttccagtggggtcctgcacagatggcacactgcttaggaggaatcctgggctatgggcatttgttggcccagtggccggatttccggcacttgtggcaaggtcctgggggaggaggttctggaggaatccctggcagctgcagttcaggcgtttggagttcttgtgtgctggagatgtggctggggtttgtctcacagtggaggcaaggaattgcaactcagaaatacattgctacttggctgcctctactctatcattgtacaccttgaaggtgaggttaattaagtcctgttgtggggtttgagggctggaatttaatttttggagtcttatttaatgtcgggagcagattgggtaataaaatgtatattgagaataagatggccttttgacattttagggtatagggctgtaaagcatctcaaggttgctgccaaacaagccatgaactgggctgggtttttcatatttgatgaaaaagagtgtaaatgctgactgatttgggataaagaaaaaggagcattaaccttgactatgcttttagctccagccacctttttaagaggaaattgctgggcaggtgggggagggctagtcacagaatgcaactgtaagccggaccgggtgtgaggaggggaggtgataaaaggattatagggtgcgggagtggaggctgaggaagaattgagacctagctcagcctggcgatgagcagcctggggaggaggggagaggtcattgggtctgtagaaaaggaagattggaaagaggaaagactcagtgatgcttggggttgggactgaggggacaggcgggagggaaagaaggaagtttgggacaagctgcattgggaacagagactagggagggaccgatgtgtaaaagaatgcctggacgtcaggcacctcagaccgtttgcccattttaggacaagaattttttaggtcttgtagggtggaaaagtcgaaagtgctgttttctggctatttggaaccactgtccagtttgtattggggtcaagtggcagtacagaagaaaataaggcatttagattttaggtcaggtgtgagttgaagaggtctttgagaacacaggctaagggagaagagggaggaatggagggtggaaggttgtccatagtgaaggagctaagtccagagaaaagagagggtagagacatggagagaaggggtggggggggtgcttgccccccaggaaagtggagaaggggtagagacatggagggaaggggttggaggtgcttgccccccagaaaagcggtgcttgctgctaagggtgaaggaccaagacaggcgttcccacgtggtcacacacctctgaaacgtgggtgaataatcaggcagttgtccccgcgtgattaaacaccaagggaagactgttttcccgagtccgtgaccggctccggagttttgggttcatggataaaatgcgtctcctttgtctctaccagaaaaggaaaggaactgaaattaagagaagggagagattgaagtgtggcgccaagattgaaaggagaaagaggttgaaggatagtgagagaggttggagaagagagtagaaagaggctgcttacccgatttaaaattggtgaggtgttccttgggctggttagtctgaggaccagaggttgcaggtggatctttgtcacagagcaaagagtaggaggacagaagattgatctcccaagggaggtcccccgatccgagtcacggcaccaaatttcacatttcactcatgtctgtgtgaagagaccaccaaacaggctttgagtgagcaacaaggctgtttatttcacctgggtgcaggcgggctgagtctgaaaagagagtcagtgaagggagatggggtgcggccgttttataagatttgggtaggtaaaggaaaattacagtcaaaggggggttattctctggcgggcaggggtgggggggtcacaaggtgctcagtgggggagcttttgagctaggatgagccaggagaaggaatttcacaaggtaatgtcatcagttaaggcagggaccggccactttcacttcttttgtggtggaatgtcatcagttaaggtgggaactggccatctggatgtgtacatgcaggtcacaggggatatgatggcttagcttggctcagaggcctgacactatcgctttgggatttggatgtcaacatatgaattttgtgagggcgtagacatttagaccatagaactctctagaggagagggacagactggtcattttagtctaatattggtattatccagaagtcataaggagagagagtgagtgagatttagagacagtgagagagaaaagaagaagaagaggaagaggaagaagaagaagaggaagaggaataggaggaagaggaagaagaaggaggaggaggaagaagagaaagaggaggaaatagagaaagagagactgaacaggaaaaaagaacaggaaaaaattatattgcaattagaatttttgtaaaatcaatcctccaagtgaagttaatattagaagcaccatgggaattttattaacccaacttttaatgtcatcatgctttgaggagtgttcattgagctaaagataagagactccagaaaatttcaacctatgtatatggtctctatgttaaaaatctcattgaatgaaaatctattcagacacttagttttgaagttaaatcacttatataattttgatttattgttcaagtgattgtatacaactatttaaatgttctatttttaaaatagaacatttattcctaagtatggcaatagcaaagtattcactcatttgtaaagtaaggcatttaaatatatgaaaatgtggtttcctcatactcttctctttacaaaagcatctgaaaggtgctctatagaagcatctcatgatttattttacaatctgattactcagtctgaaatctaattattcaatatttgtatatcctgctaaagtgttaaataaaaatttattttatcctacatatttagtttcaagaaaattttacagcatagcttttattccacatttctgtccatgtgaggatccttgaaatactcttttatactgtaaacaaaattatcaaatgcaaagattatagcacagtagctggattcaattttcattggcctccacctctgcatttcattattatttttacctttgttcctctcaaattgctatcagttagtcagttcttccccaattattattttagcataaataattttaaaggatcaatataagtgaatataaaaagaggatctcaaaaaatgagcctctcttaaaatgcttctgtgtggaaaatctatttttggaacatggttttaggactataaattattactattttggttacaacaaaagtggcttatcagatgccaaaatatcaagtgttgcttctggaactgaagcaatatatacaaatatagccatccttcctgcatttttcaagaaaaaataataagaaaatatgtaattccagtactatacatttagaaacgtccactggcaggatataaactcatcttaggggttaaatacagaggaataaaggtgttgcaataaacattttttgaatgcttgacttccttggatgttttacttatgtctctaattttgtctttactttcaatttgaaataaaacagaaaataagaacgcaataaattcatgggagaaaaaaaggcatttggctctaagaggttgaaatctcttccaccgtgatgacaaaattaaaaacggcagttctaacatcagtgaagtcaaccaaacatacccaggacaagtggcccaacttatgagaaactgtttggacttaaaaagctttaaagtataatgtcttcagtaaacatcaggtcaatgaagacaccaaatttcactgtgaatgtataagcacatatttttgtttattcgtaaacacctgtgcctagtattgttgatgctgaaaactccaggacccaaagtctcagaagactattaaattcactgtgcaagcttcttgtttccaatggattctgcttagaaataaattaaattagcatttctaccctataaccttaagaaatatttgactattaacaaataatgccagaccttgagcccaaactgtttcataagtctttgtattctctcagctacatttctgagtctaagaaacctattgacttagtggaaagagcattgttttatgcatatactgacccaccacttcagattttaaaaacatttttgttttgtttttcctatctgttttttctttcttcccaacttaggcggtgggatgggaatgaggaaacacatctgaagtttcatttggcattgggaaagttctaaagaaatttgtttaccttcaagacaaagactaagtaatttcacagtaatttaagcaaaaattgacatgtaactcagggcatattaaatgacacataatttgctaaaatttttcttaacttgataaaattttcaccaacagaagcaaaaatattcatatacatatttacagaaagggagaaaaactggtcacttaaaattatttctttaggtctagaaaattatctctatgtattttgaaataactttcctcacataccaaaattagaaccacctagatatcaattatatattacacttagaatattgtacataatcagtgctcaataattgttgtaaaagagaaatctctgctttgcttagccaagctcatattgagtactaccatacagaaggtacatacagcaacatataccaagtttaattgttcctggtttgggtagcattcatgacattaaaaaaaaacctttacctcaatttagttccaaatatttggatctgaatattttctgggaggtcaggggcaaacattagttgtttcatgagttccaatgaaaacagtctttggatttcatggaccttaccaaggttcgctatgagggcgtggtgactaagtgatctcatgctaatatttatagcagcctgcatttatggagcattgtatgtttgaggtaaatggtcatgaaaattaaactgataattatctaacatttattaaaccatattatctgccctctatgctgatatggtttgatagtgtccccacccaaatatcatcttgaattagagctcccatgattcccacatgttgtgggagggccccagtgggagataattgaatcaatggggacagtttctcgcatactgttcttgtggtagtgaataagtctcctgagatctgatggttttataaggggtttcccttttcacttggctctcattttcttttgctggccaccatgtaagacatgcctttcaccttccatcatgattgtgaggcttcttcagcaaagtggaactgtgaatccattatacctctttttctttataaattacccagtctcaggtgtgtctttatcagcagtatggaaacggactaatacacatgctttacaccaaaaagtttacgtacactgtgcttgagtgaacaccagtaagtgtcgtctggtgcaggcagagtcatgggcagaagggcagaagattcctgggacccctgttttcttgccttcctgtggagtggatcagacagatgcagatgggcaaatctagagactccacctcttagttgttctttccttggaaggaaagcataagggtagcattaaggttggggttaatcatttgggtttgagcgctatgcagtcagagtttaggtgctaagtgcatcagggaatgctggaaacaccagttgtgtagcacttgaagagtttgggagaaactgagatcatacacaggcctcctgttgaggggaggggaagctattagttctggctagcaagctgaaaagaacattttggtcattcaacagacaatcttgcttatttcttcacgttgatgtttactaattagcaggcatcgtaccatttgatttgtctatattatctcatgtattacgcataagatccttatgcagtcttattgtcattttatggttcagcaaatggaagcacagagtactttatcctttttcccactaactgaatatgttctaaattggagtacagagagtttgaatagaggaataacaggcactggaaagttgaggtcttgatttggaatagtgactttgggaaagcaaggcattgataaattttatagacatggcaaaagttaatcttctcaatatcatagagctaataggttggggaagtaccaggactagagaaaagtgagttaagtaccatgggtgcaaaattggagtcctccaaaacactcaaaaattgaaacaaataatattttcaggcagagtttaaattttcaaaattaatgcaaaaatatatgatgaagaaaatatcaacattttaaacaaaggcagaatgattattactgtttctccttttgtttcaatatagttggcacagcgctgggtaggaagcttgaacttgaatgctatcagtctgaactcagaacccaagcttgtaaccattgtgtgccaatgtttctcaggatatgaaaaataaagaagggtcaaatattacctacacactctaagactgatggccaaagataacagtgaaactatggtcttgattttttagaagggaagcagagaaaatgattatttttcttgtatagtcccatttagaaacttaagtacacgcatagtttagcttcaaaaccagaggacaaataaaaatcttacttaaacttttcttggcctctcttgtctctcttggcactctttcatcagtgccaagaatccaattactgaccacaagtaacctaaagcagttttcccggcattcagtggtatatttttctggaagaaaccttggatacaattaagaatgacttgaacactgagaaacatttcttatctcatataacagaagtgctgaaggtagagtgatttcaacattggatacttcaaggccttagcaatgtcatcgtggactcatttttttttccagttttaatccttgcctttctcagagagccagctactgttctcatggttacaagatgactgaagcagctgcaagcttttttattcccatgcagtaaagtctttgttcttccttttaagagcaagaaaaccccttctaaaatctccccacccaaaacgagaccttagaatcaattgtgaatttatgttttttgtttgacagcatatagcacaatagttaagaatcttgttttgatggcctaaaatgggtgtaaaacgtggctccatcacttactatgtaacctgaggcatcttatttaaattatctgtgccttagttttcctatgtttttaaaaaaggtataaaataatatacctatgtcattgggttattgagaagaaaatgtgaattaatacctgtaaagtttttataatggtgtctgactgttatttttaagatgattctcacagtcatgtatataattaaacttagggaaacatgaaagctaagaaaatacaattacctaagtatcttcttaaaaaaagacatcaataaaagttttagtttgcgttgaataatattttttccattgatatgatctggatttggatgtgaggtctgaaagacagaataagaatcaacttcaggactactgtcttatttaagtgtgtgtgtgtgtgtgtgtgtgtgtgtgtgtgtgtgtatttaggttttggaagaagtggtccacatggctgaaaatcagaaaatcagaagctgatctcaagctagcaatgataacttcataaaaatagcctgctttggcaattttagaaccaggcaatatatatatatatctgcaaaatacatacagtgcatttaagcataaggataattaaactgatcccaattttgttggattttattgttaagctcttcagttaacacttagaaagaagggaaatggagaaatagtctcaatctattctcatcataaaaatctcatttgcagatttttccattaggtataaaatataccactgctaaaaatgcctttaatggtgccagaacaatccagttccttacatatgattcttttaaaatcctcaattgcaattataaaattccatttcatttcctttgtctaaggtttaatctcaccattcaaacggccatttcttgctcacatgaaactctctggagtgtagtaaaatggggtgcaaagagtgaaagtacattatcaatgaatcatggagacaggcttcccagaaagcagcattttattcctggggtcactgaatggtctgtgtgctccacgaatccctcagaatggaatataaaattaaaaatttccccagaaatcctctcgttcatataatttttccgctctctatgagatcttcccatcagtataaaccatgggatattcttcctatttgaacaatggtaaaaacagaaaaactcactatgatcctagttcctcttctagtattactcaatctctgtcatatgcataaaaatatactcactgcctccaaatttttctattttgtcttgaatgcactccactgaaattgctctttgaaggtcatgagtgacatcctcgtcatccaatccaaaggtccattctcagtcttcaactttcttgacctatccatagcattttccagttgatcactctgtcctcctcaaaaacaatgtattaacctgatatctggtgcattacactttcttggttccttctccctctctctttcttgctcactcctgctctgcctgtcactctctctgtcatctcccctctgaatccattgttggctcctccctatctctctgacttatctccctgacatttgttaaagtgtctctgggtcaacttccttggtgatctcactcattgttatggctttgataccttctgtcttccgttggattctgaagtttctgttttcagttagagcttctcttttgtaaatcatgttgcattacacaaatgtctacatcttgatgtaagtatctaataggcaacccaaattttgaaagtctaaaactcagctacttttctactcccaaccccacccacacccagcaagaatcttgtttctctccagtcctcccccagctcagagcatttccttccttcattctagtttctcacaccaaaaacttagaagttatcctggaattctgtctttctctcacatcacagccacactggaagcttctactattaattctgtcattgaaatacattcagaatctgattgcatctcaccacacacactgttaccaccctgatagaaatcatgatcatctttctcttggatgatttcagttggcttcatactcatctccctgttcccagcctggcaccctttcaaacttcaacacagtaaaggaagtcaaatcacttcatctttctgctcaaatcttccaatgacttactatgttagtcacagtaaaagcctaattagatgtacttaacctttaggtagtataatacattgatataattctcatctcttaaatatatcaaagagagaaaaatctctgaaaagctaaaatagtttttaaaattaaggaaaacacagctctaaaatttaattacagcttgataaaaaatcagatgcaatttataccatatttctagatagatcacctctgtaatcacatcctaaaggctatgcttgcctcttcagagcagttttcatatgattggaagaataaaattttggaaatccctaatatatttgtttgcatttttttatgattcaatctttcatttagcaaacattttatatctcctaggacatagaaaagggaagacttatagattctatccattgaagttactagcagttcaaatacttttttatttcatgtacagggatgactaagataaatccaacctattccaactagagcttgatatgatcactaacttgactattccagattcttcctgtggtatcacaaattagaataaatgggcctatcagtcttaatttagccacaactaccttagtcaacttgcagaacttgatatttgtctgaaaacttacagagtcatcttttctataatgctgtcccatacaatatgtgctgaaattatttcttccattcctgaacatccataacatagggtttatttgcactctgggtaacataaatacacattattttaattcattcctaattttttttccagtgctaactcttatttggattataaacttcccaagggcattttctttcttggcatgcatgcatattatagcaagatgaagtttctatttctgcgcaaaaaattgtagccaggagatatttagaatgttgaaattgacatattctttttgtcaaaacaacaaatcagtaaaaacagcttttcttaagttatttggaaatgatcacaaactttttctttttttttttttaattacttttagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatagtgataaaggtacaaagaacatagagatatatctaactgctaggagcaacattaaatatgtattatagtggcttgcctcagtttaaattcaaatgagcacttgggtcaagctaaaccaaaatgaatacacttctgactgctaaaagcatatcaacaggctgccaaacacagtaaattgttctttatttaattttcatcttatagcttatctaccattatggcaaagatgtcaaaattaaatgttaatattaatgtagcattacagcaaagggagtctcattatgctctgctataaaaccacaatacaaactcacatttatatgcttctttggaaaaaatagttatttttcaagtttatctctaggaagattaaaataaaaacagtaaaactaaaaatacatataagtgttttatacacatatgtcatatttatagtcaaatagcagaaagcaatcttactaaaagtacaatcaaaagagtaaatttattggaccaaatggtggtgtagaatagaaggacacattctaaatgtcctaacaattatgcaactaacctatgtgctctctcatatatattaatgaataaaaggaaatagccatctcaaaccacataaaaactgccattgaatgagtatgaaaagaacaaagcactgtgattccatctattagataacactttttagggtcagtcttagtcatcagaaatcatgtattcagccttgactaccaggaaagcttttattattagagtatttttataacttttcctgaaattatatttgttttggccccagtaagagttcaacatgaacaatagagagttgaaattaatatgatatataacctataatgtataatttggatcactgccacaattttattgaattcataaaaatgaaacaatcttatataaatgtatataaacaaactttatacttaaaaattggaatttgggaagcaaagtaatgtaaagactatgattgttaaaactaatagatttttttaaataaacaaaaggggaaaataatgatgtcatattattctatgctaaaatattttctaactttgtttttcttttaatcttggtctaggagaaatagatgagcctcccttgagaaaaaaaggttagttgttttcacctttgataataattatttttctcttatggtaatattggttttcagcatggttcaaatatattttacttattttaatataaaggttttgtttaataattaggtcaagatttatagtcagaaaaaaaatactcaatttcttttccaatgaaggtgatctcactacttttctgttgattattttttaaatgccttattcagtagatttgtatggattcatttatacacagaccaatatgagctggaatttgaggaatgaggggagaattctgtagccttagaaatggcccagaaaatgacacccatgatttattctcaccatggtcagatttattgattttaaatgtttattcttattcttttccttttattttttttgccatcattattttgcatgttaggtgatgactatgggccaggacaacaagacggtgagggacataacagcctaggaggcaaaggcatatccagttggtatgtgtgatgtgtcactgtcatggagtggagttacctggatgtgcctggatgtgctgtagaggaattacttgcaggaatagataaggtgactgagtgaagtggtcacaacctgaatgataagaacgataaacctaggacaaaggaggacagcaatggggcaggaatttcagaagacagagattttgacaggaaggggtaggaactgcatctggaaggggcactggggagcaggtagtaccatcttgaggtacatttgttgtgagaaaacagccaacattcaagccagacttaaaacaattgcagtgttttagttactgctacacatgggcaggctgttgagggtttacccaggaagataaccctggcttctgttgctctctcctaatacctactgtggattcaaacaatgggatccaaacttacagtttcagccttccctgagaaaatgatgactaccccacactatctggggtaaaatccacttagtgtatgttaaattagaaactttggatttgtaacttacacagcaaaaaagagctaagccagtcaaactcaactatggcaaaggcatccagaaatgaaagtgtttataaagctctgtgaggagaaaggaagggtttatacacctgcaaatccagaatgagaactcaagtactcaagacagacttcagccatcaaattcaggtttagagattctagatttgtctataaacttcaagagatttatagctgatttcccatagagagtgaacatagtcaagctttaagtgagttattagtcattatctggaaataacagcttatgcacgtttattttcattggaaatggaagaagggaaaacagataaataatgtttgctcatttatacttataaactgaattccataagactattataaagccatgtttttcataaattgatatttactatttaataaaaaatcttttcttttgatttaaatttttctttgaaattattttaaaattaagcttcatatagtaattagtataaactgcaaattcatacaaagctgttttactattgtttcttaaattatttccttgattcagcaaatcaaatttttgccagaaaaactattaaatagttgtttagggtacttttaaaaaatgttagaaatgtttattagtcaaaaatagtctaagggatatatgtccttcaacacatgtgcactaatgtccttaaagattacatactcagaattaggagaattgactttaaatcacctgaatatattttcttaatagtattattcacacagttacatgaaaaaaattgacatttaagtaaaaatctcagatgctctatcttgggtacagaggctatgtaataataaaccttagttgaaagtgaattcaagaagatctatttcattgtaattattattttttatgtgtaagcttttctttcatggaagtatagaggcaatgagagctttaaagcagtaggtaatattttataaaacatttataatacatattctacattttaagtatacttttaacattattattggggagaaattctataaattattcttgtcttataagttattttactcatgtttacatttacaaatgttggtttaagaaggaatttgggggcaatgtagaatgatagtcttttaaaacatttgatttttacacatctaaatgactcttcattaatacccttctcaattcatatatattcaataatatttagtcattttttattgcctaaattatcaggctgtagcatttttttattcaactgccctatatctacctaaaacattttatttgaatacacttagttttatttgttgagttactgctattcttaacaaaataaaaattcagccagtttgttatttatggttgaagtttgcagtttttaatttggtatggaataatggtgtagtcgactaatctcagggttgcagtattgattattaaacagattattaatatggatgaaatatttgattctgctagcctgtggaatctgttgttatatataaatatagcttcagggtattacatgtagtacctagtgtctttatattcttcatgcatatttttcaacttgtcaaaattttaaaatactaagttctattactaaacacttcatgatgagaccccaaggcactgaatctttagaaaatactatattttattacatagttgtctaaaaattataagtatgaaaaccaaatactgttataaatcacattttcggaaaaaattatttgttgtgtatagtggtatactttgcacatctggaagtgtgcttttaagcaatatttttcacaccagggtatacatcatggatctgttagcacctcactttctaaggggtataaaactgcagagagatttaaaggaattgaatgtcatttgaatgttttcctaaaattgatctgcttgagagcatgcccggtttataaccgtactatttccacttcaaatataaataaatttgttgttggttctttgtggtattcaacgttacttggaaggagacaaaaaaattaagtaacattgccccaataagactgtgtgtgtgtgtgtgtgtgtgtgtgtgtgtgtgtatgtacagatgtgcataaggcttctcaatacttgtatctttaaaagtaaaatatagggttagatttattgatgaacgctgtctcattctaactgtaaaatacattaatccacagataggtgattttaaagctccattcattcgatggcattctaaaaaaaattcatttttcaggtttaataataacttatgaagatttgcaatatattaacctttagattcttagattcttatagtctaaaggttaatatattacaggatgtgaaatcacagaatatggaggaaatttaaaattttcaatatgtacacttttttccttagagaatcataatgtagctcttgggtaaaattttcgtgagagaggtggaatgaaaatatgaattcaaagagaaaagagaaagatgaaaaccttccaaatgttaagaaataattttttgataaatattttaagttgataatgacatctaaaaatattatagtgtttggagtccatcaactcagtttttaaaagggatatggcaactttatttttaaatgtcaacatttacaataatctataaattatatcacttgtaatccttcaacttatgatgaaaaattttagaacttgtaggaagggatgcagagttttgcaaaatttctaagaaatataaaagggaaaaaattgagcatgattgtaatagaaaataaacattttgctttctgggtaactcctaggtttctgagtgagagcaaagcacagaggtctaagattcacgacggtacaatgtatatccttagctaatcactaatacagaattcggacatgttttatgccttctgggattaaactcaatcaacaaatgtatttttttcaattaatctttttcaagtgttttctatgagccaagcaatgagctggtggaagagaacatgtactatttgcttaccacattcccaaagactaatgatgaacatttattaaataaaatagtaaatgacagtaatggagttttgatgtggtattgctagcatcaggatcaatgcaacatgttattttatagcttacgtaattgcaaaggtgtaaaagatcaccttacttagtaaaatgtcctgcaaataccacagttaaaaatttaatgaatacatgatcaaataaggcagtaaataagctagaatagttggggcattgtatatttgataaagaagagggtaaatctttatatgatgttattaataaattgaactgaaagcatatgaaaatgtgaataatagtaatgatatctattttttagaaatataaattaattttaattcccttaattattcataaagacccaaagttaaagttaaaaccagggccagacgcagtgacagacagacagacacacacacacacacacacacacacacacgcaaacatgcacacactcagagagaaagaaaaagggagggagagaaagagagagagcgaaaacccaaaagtcttaaagcaaagttaaaaaatatatgtttttttcagcataggtatcttagtgtttttctctatttatgttcaaaaataaaatactggtttatgactggtttattttactaataaaatactggtattaacacttttaagtgcaacttaacagatacacctatctctatctcctttttacagtttattctcacttaaacctccatctataatatatctgtatataagaataataattacagcatttatatcctttggaatatgtaattttagaagataataataggctcctaacaaggaattaggttttgtaatgtcttttcctgacatctagctttaaagttaagaaagaataatcgtagtcattcagagttatgcatatttagttttttggacaggagaaactgatctttaattttaggaccatggtggccttatgggctataggtttatctcttgccttagaggaaaacaccagaagccaatctacattatgtttaatttcctttcttgctaactactttctctttgaaataagaaattgtccttaaggataagctagacccaatatagaggatgatgttctatgagattgtacttgatgcatgtcaatggcagaggaagagattcctcacttacagcaaaacaaattacaattccccctatagtcgcatgtttaaatttccctaaagctctgcaagttgaaaagagctgcctggtaaattttaactcagttctttcgttgtgtatttttcttactttattacaatccacaatagctcttgcagtctgagcgaatgagaaagagccagaaaatttaagcatcataaatattcaagactttaggattaggccattcagaaggttgtatcatgtcatcgggagtaagatggatagacgtatgtgtgtgtcagagctttcattgcatccatctttgccagcagattcagtggtttacaccaggctgaacattaagtgtctgaaaaatacggtgcatgaaaaaaggaaggagaatggaaagatgactaaacttgttaaaattcatagcctcagaatattggttactaggtagccctagtaacattgttaagtatacatttatctttggatgtctcctctaaataaatctagatcaaagctcatctccataactgcaccatcgcatatcgctctcaggctgcatgaggagcttagagctttatcttctacctgtctttcccaagcatggagcagacctgtgatgggggtgagagggggacaaagcccagagagaatagacagtaggtatggaggttggctcaaaatgaaaaaggctgaggagggcgagatcaaaggagatttaggatccagtcacttctccaggtagttgctaagaagtaaactctgagcccactgactcaggcagctgtagtacttcgtgctactaaaagagctcatctttgtcaaggcacgcaaagtgacccaggatgaaacaaataatggtgggtcaaaccagagcctgaattaataggccaaggaaagcaagagatcaggttttggtgccaacatcagaaggaattaaaagagtctctgaggcaactcaactcaggcccaaccattttatgtagttcttctggagcaagaataatttcattggtgttatatttctacctgtacctgagatgagtaatagagaaaaggatgtgagggggaagctgctaggtctaatgtatttcagaatcttctctctgcagttctgtatgtttcctgtttcaaattcaagagaaactaatgtgctagttgactgcagatggcttaaagttttacctattttaaattatagattttcatttagaaagggtctgttgaaaaataaaataaacaacaacaaaaaaagcataacagaaagcttaccaatggttctcaactttgtgtgtcagattcaagtgatgtcttaattagaactcttttgctcatgagagaccaaaatccaactcacattggcggtggctcatgcctgtaatcctagcactttgggaggccgaggcgggcagatcacgaggtcaggaaatggaggccatcctggctaacaaggtgaaaccccgtcttcaccaaaaatacaaaaaattagccaggcgtcgtggcgggcgcttgtagtcccagctactcggaggctgaggcgggagaatggcgtgaagccacgaggcggagcctgcggtgagcccaggtggcgccactgcactccagtctgggtgacagagcgagactcaaacaaacaaacaagcaaacaaaaaaacactttttctgttcaagtgattaaaaggcataaatagagttggcttctgaaatgacttgatatagttttttttttttaatcatgttattagtaaatcctctttcttcacttctggaacctgctttccttcctctgtttcatttgtttcagtctcaggcaggcttttctctcctagcagctagtatgggaccagaaagttggggccaaaattatcttaccttagcaactcagtagaagagcctgttctcttcctcaatgcctctgcgaaagcatctggttcactcccattaatctggatttagtagcatatccctgttggagccaatcagttggacagagagatgaaatatgcactttatcaaggcctatgaaatgggcccccgcccttggaaatgaagggtgggttagcatggggaaaaaagtggttcccaaaattaagaggaatattatcaggaatactggattctagcaggaatgccacaaacgtctacatcatctaatttttgtttctaattcagaattctagattacctcccatctccgatttgctaaataacaatctgtaggggtcaagccttaaatagttgaatttgtaacatctccacaatggtattctaactcacaatcagagtgagagccattgcaacccaaaagagtaatgctataaatagggaattttatgcatcctgaggccagtgagttagacagtcaaagataaatgaataactgcataatttgtttacacacaatggctaatgtatataaatctactgttaacaaaatcccaaaacatgaatgataggatgcaaactaagttaatatatatatcactgtcgcattgacctaagccattggaataactattgatagttgatgctcatcatctgaacatatcaaaattttaaacatgacagataagcttgaatgaatgcaacaaggaggtattggtattgtttccctttctgctgttaaccagctatggtcaagtcacttcagtggctctcagttctcacacctgtaaaacaaaactgccagatttactgatgtccaggtcttttctagctatgatattttacgattctatgattaaactgtgatgccatacattgataattttatcaagagtttcatctggactagagctttgaaattcaaagcatggcccatggaccagcaatgttagcatcatatgggacctatttagaaatgcagaatctaggctccatctagacataatgaattaaaatctgccttttaagatccctaatgactcttatgcacattaaaatttgagaaacattgatcaagacagtagtttcactttggactgtggttctgaaattacctgagagtttatttaaattgtagatctctaaaaatttccttgccatgagagacaaattaataacatttgagtagtagctcaggaatatgttttaaaatctccccagataattctcatgtacagacacatcagtcttatctagcacatcatcaaatatgaaacatgctaacacagccaaaatcttactcaaatctccaaatctgcaaacttcaccattgataatctataaaaggtattatttgcaatcatttgtacttctgtctggtttatgtacacatgggaaatgatatctcatttatagatggagaaaataaaattcgaagagaaaaaatgaattaacctgagataacaaatttaatggcaaaaatgagattaggtagatatcatcttagtatatttattttgaaaatttttaaggatcattagtatacagtgttgaatctattattttttctggaaaaagttcagcttatcttaccaagtaatcaaacacgataaaataaagatccaaaataatttacatttatgggcttcaacatctctgaaagaaactgttcttaatatcttcttatcactgtatctggagtggttgcccattaagtcatacacatactaggtgcttcaagggggagagagtattcctttttatagtcttcattaatggtgagtagtacgctttccccagaaatatttgtttaccaatcaaacataaaaagttttagaaaatcaaagaatatacagatatttacggataatctggaatatttatcttaaatattaataattcagcaaacagctgtgtttggcattatttaattagccactaaatagataacaagatttgcttgttcatctgttacaattaatctgttgtgctctaataacaattggcagattcttataaagattctatgtttaagtgaataaataatttgtttttttaatattaaaatgggaaataatgtaagaaggcattttattttatctggtgcttgtgaggtatctagagaaaacataatgagaggcattctttgaaatacacaacccttataataatttaataaagagaattgtcatcttaaaagaatcaggatgattgccttgatgacagagattattcttttaacttcctgaatctgccatttgaaaatcttcaattgataacattttgaatttattaacagtttgccatattaatagagaaaaattgcatgctttaaactggccatgtaagtcttagacaaaattacaaactatctgtctactcaacagcaagctttggtatgatcataagtagataaaaacgatcataagcaaaacacatgtaatataacaaaacaatttagaaatacgtcactacaaaatcagctcattcacaggaatcactgatacaatctattttcactgatttttgttccattggttgctgctactaccagccttctcattttgaatgcctgtggcctttcttcccagttacatatggaagttgagctcagagagtctggggaaaatgtattggcctgatgattaccattggcactgtggtagacatagaccttatgtaaacattttgacagaattaaacggcctcatgaggaggaagaaaaactaatgaagtgaatcttcacttggagtttggtgaagttttagagattacaccctttgagtaattgtatgttcctatgggacattcagcacacgtcatgagaacaagaaaattctccattatacttgaaaactctaacttggactaccaagaggatcattaaaatctatccttgtcctctcaaatgtccagcataaatatatttagtaaatggctaaattttgtaatttctgcatgtagaataccataaatatagagacaagtgttataagacaaaatagaatgtagattatcctaccctaatcattaataaggaatgctagagaaatgtaataatattaaatctgcagaacaaagggaatagaaatttaaagttccttcctttaagctcggttttaaatcttgctctcaatttttttctgttgaaatagttatattttattaacattttattataggcataatatacttacttatagtttatctagtttttgtatgagcatctataaattttgaaataaagcaatgttaaaaacatgcttaatgtccttaatataattacaatttagcttttcagtgctctagaaaaaacagtacatgaaaaaatttctgaaatataaaaaactttcaattgttgcagttgtttttctgttttctcttttattgttctatttattttgagacagggtcttactctgctgcccaggcggaaatgcagtgtcaccatcatggctcactgcagcctcaacctcctgggctcaagggatcctcctgtctcagcctcccaagtagccggactacagttgtgcaccaccacacccagctcatttttatttatttatttatttatttatttatttatttatttatttatttatttattgtagagatggagtttcaccctgttgcccaggttggtcttgaattcctggattcaagcaatctgcccaactcagctttccaaattgctggaattacaggtgtgagatactgcacctggccaatcgttgcagtttataagtaactttggcatatcttatttccataagtagtaaaatcttgcaactttcccttgtatttctaacagaaatttaaaatatttagaaataaaatattttttcaaattttcaagtataatcattttagtagttaaatagtattttgaaagttgtatcataaaaaacaagtaaaatatgatccatcaccaccttctaaaatatgcaagaattgataactcataatcatggttgaatattttttcaagtagtatgcatttctcaagtggctagtatattccagtcatcatgttaggcattgaaaatttaatgtggaacaaaatagacataattcttgccctcatcaaatttagttatttagtgagagagacaaataataataatagttggcattcacatgatgcttacttgacacaaatgatgctctaaatgttttacattttaacatattttaatccccatataatcctatctggtagacactactgttaatcttattttatggatgaggaaatgaagttcacacagctagtaagtatggaaatcagatttgaattgagcagattgactcccgtgttaattatcttcaacattaagctgtattttaatggatgtcagagatgcacatatttttgtatagatcttttaatagttttatctatgtctacattttcctatcaaaatgcatgatattttaattatattagtatactatagatttataacatctttcatatgaggattattaaaataattaaaataattctttacagatcatcggaatcctgaaataaagaataatctaaaaatgtgactagtttttatttattctcaacaccataataaattattataactcctcctctgtttggcattgtactttggaaaaacagtctgtgtgaggaagatatatttcattgctatcgccattgaatgataaaccatgaaagtcagagtttaaattctctgagttccttaatgaaagaaagttgtaaatgcatttaaagcccagtatgataatgttttctttggatttcaaaagcttttagtcttggagtgagagatgaatagcgataaggatctaagaggagatactactttttcctcccttatcttcactcatacctccctaccagccaccagaaaagtgttaggggaaagtcaggagtagtaaaagaagtagaaatacacttcctacattctttgaaattaatttgcccttctcttaaatccttcagtgcccttgaaaccattactgacaccggcaactttagtggagtgctaattctttcttattaggcaaagctaccagtgactcagtagaataaagggatttccctttgttgcctcctaacacattaagataattgtaactttttttccgtgtctttttcccttcttcccttctcaaaattcaaatagaaactcatacctttaagaatttatgggcagactcacacgtggattaagatactttgacctctgtgctttctaagacacaaaacaatttttaagatttaccggttacaaatatggcttatgattccaactagcatctggtgctgagacttaacaccttttcagagacattggacatccacctaattgcaaaggacatatatgtggaggtaaataatgactgccttgcctttcttctaagtctcttgtatccaggtttggttcaggtttaagtgaagtgatcctcaaaaggtgtcatgatgtttaagtaaaattttatgctattatacattatttcatgttatattaagtggagacattcacctatctttgcaaattattaaataaccagaagctagtattaacataatatagaaaacttaattttatttgaagattgttggacaataaatttctacctttaatgactcgaatcttttaaatttgattttgcaatttatacaaatatagccttagctggaaagagcaatcaaaggtaacaaatcaggcattgcctccctatgagaaaaatacctttccaaagtctaaattagtaacatgttactgaattggacaggagcttgaatagcatcatttcctggctaaagtgtaaggagacagaactggcacgccatgtggaggctttactggattctcctgacaacagatatcaacagtcagtgacaccagtgatggaatccagtccccaaagagaacgcaaagttgcaataaaacatgcaaagaaacatttaatttctccttaagtctgaatcatcagaaataattttttgtcttcctgagcaaataaatgtaggtgtgtgtatgtctttactagttctgctgtgttttgccatgcttgcctctgtagaaatattaatatttcagttaaaaatagttgataatgtacctgtaaaacaaaaatctgcctatgtaagtttgtatactttattgtgagctctagagactttactgtgtgtgtatctttttaaaaatggttgacctctgcttgcaaaacaactgcctgcatctgcccacagcagtgaggttgtcttagtttgttctaaggctgaagtgcagaatcaggaaaataaaaaatgaggctttccctgtgagactgatctaagttgtagaactgggttgcatctactctgcttaccatagagtaaaaaataactgctctgaaataaattgccattttttagtctaattttcctttatttatttttatttttgcttaagtaaaacttattatgaagcatatccaacatgcaagtacttacctttcactttagagttacctccctttcatgtatttgggaaagggagataatacatttaccctagcatttcccttctcctgagtggtggtcttgaccctagtctttgagatttgtctttatttctttttttcaggatggtcccttgctcatttcagttactgctactacctagcactcatttcctttgtcaggatatgtctgagtacacaagagctaagaggagcaaggtagctcctgctagtacttctttcatctgttttctgatgtgcaaacttacacctaccttgcaggaaaccctactatgatcaacaaggaccgtctttctagtccccaaaaccaccacaactctgtccagtcttttctgcaaaatctaagttagagtaggaggctctgacaggattttttcaggcaagatggccttcagcactggattctatggaagagtctaacccacgtcttattctcccgtgtgagctccagaatcccttctttattcttttgaatggtcagctggtatctgtggaagacatacatgtatatatacacacatatgcacacacccctacctctaaaaaaaatattattctaaatgacaattttaaggcctccccattacatggtgaatgtagcattccatgcaatttttcaattttaaaaatttcatgccatctctatattccaattaatacctactaggagtaaggaatgatctcttaaaggcaactcccttagtacgtccaaagaccagtctaaatctttgatattttacttgctttatggacctgaattaaacaaatcaccaatcttcttcacagcatctgttggcttggagacgagggagcaagcaaaacagtattgacaggagagaatatcaagtttgttttttcagttcatttgaaatcagtttgtctctgtggatgacctaaagttttgtaaaggtcctttgctccccctgggattagacgtgccttagacctgtctagtagtaatataataggagtcacatatgtaatttaagattttctagtagccacatttaaaatagtaaaaagaaaaatataaaactaattttaatcatatatcttattgaattcaatgtatcagtcagggattaaacagagaagtagaaccagtagaagattatggagatacttttatacttttaaaaaattattacaaggaattggattatgcgattgtgggaactggccaggcatttttgaacccatatgacaggaagtcaggaagggaggatcacaggcaagttgagcctagaagctgtcaaccaaagttgtcattcacaggcagaatttctccttttgccctgggcaatctcaggcctgtttttaaggctttccaaagaaatcagagaagcccatccaaattatacaaaatctgcaaaatcatcttacttaaagtcaactaattagtgattttaattacatctgcaatatacctgcaagcgactctaggttagtattcgataaaataacttgggataatagcctagccaaactgagccaataataaaactatcacacccaatatgaccaaaatatcatttcaaaatgtaattcatataaaaattattaatgaggtattttacttatattttattctaagtttttgtaatctagtgtatattttatacttacagcacatctcaatttggattaaccatatatcatgtccttaatatgcacaaatgtctagtggctactgcattggatagtataggtctagacagtgatagtgattactctggttatcatgtaagtttagagcagtggttctcaactaggattcattttgccctgtaggagacatttggcaaagtctctggacatgtttcattgtcaagattgggaggtggatatgggggctactggcatctaaaaggtagaggctaggaatgctgctgaatatcctaaaatgcacaaaatagcccctccccaaaataatgcttcacccaattcagaatgtcaaaagtgctaatgtaagaaaccctgctgtagagtaaaatttggagactagagaagaaataaacaaaatggtgagagagacaggaagatgggcatttcctatgtcatttggagatatttccttacattttggagaattgttttcagggacaagaatgagtgccttacctgttcatatcttcatcaccatattcaaagtcacagttgagataagagtagattagtgaccctgtaaatagtaagataactgattaatgagaaaaattaggaagaaaaccttcacaatggtggttacctccttaacaggtgaatgaaagctagtagctgtcttttctgaagatatttagggtgttgccatggttgatcttaatttagtagacttttggaaaaactacaaaaatgcaaatgcagatttacaaatggagaatttaaaatgtgtacagtaattaacaccatctcagaccatctgtggaataaagttgtgataaataaataagtaaacctcattagcatttttctaagaaaaaacactatatttaagattaagtcacttttcaaaggtagcaatcatatttgtaaactctaatctcaaattcacttctatccaaattaactgtaaattcagaattaactccattttcttagccttggtaatgtatgtatactgaagctagcagaaaattgaatatatttgctaaaacctgatgtttagaaaaaaagtacaactaacttattctatgaaatgtgtcatatctgcttgcagtaattattggttaaatgtaatgccaaatgctgattataaacatagcttagagtcaatacttctgaaatatatttcctattagatagttgttacagttcatttcacaaattcttaatttaatatgtaaaaactaaatcttcctaaatctaaatgacattcttattaaggattcttaatttgtattgagagtaattgaaataaaaataattatagtttgtgaccaattttagcactgaaaatggtgacaacatagctctgtctattaaatgtttaagcttttccaaataactctaattttgagataactccaatttttcccttatttcaataaataagtgatttgtttagcaaaatgttacaaagactcttttagactccaataaacttgttagtaactgtataataatttaaactttgtggtaggtttataaagtttaggtcatagctatggcttaaattttatacattttcagagttttaaaattataaattctattttttcttagaaatacacaaagataagactgaaaaacaagagaaacctgaaaggaaaatacaaactaaaggtaaacatttcattttatgtttattcttcatttagatatacatttttgtgtattcatatgcgagaaaaaatttcatgtttagtgtttttgtaacatttttgatattaaataactaaatttactctcagttatataatgtatatcagttaatttcagttataaatgtataaataacataaataatatttaatagatggaatcaaagtaacttcaaaatgtgtaataatttttaaattatttacaattactaagagagtagctcaaatacatattgatttactgaggaaataattttttttcttttaagaagttagtgtaacaagtcagagtttatttttttttaacctgaattccttctgtcatgcaatatctttacaatctttggtgtagaaatgcagagtcattatatgacctcatggcagaggtcatgtaagaaagccccacggctctcctgcacagcctcaagaggtagatggacagtgacagcatgatgattaatatcactttcagctgaactgaatccagtaatggcaatcttgcagcagaagcaaattaagaaaggccagcattgtcttgcttatcttataagaataacttttctgtgggtgacagagatagtcataaaactttaaagaaactaataggaagcaagacattcaaaaatatattcttctaagcgtgcccaggttttcccaatggtcagtttcacatgattttgaatgagccagggcaaaaataaagatctcataataactatatttgtataatgcagacagaaaatgagataatttatttctgagataaaaatggaattttatccagtatttactatgtcataaaccagctaatgcaaaattatctgtagtaaataccacagttgcagctagtaaattttcaaataataaaagtatcaattaaattatactagcacgtgaatttatattaatacaatgccatgttgttgctgttgtttttaaaatatacttcatgtgctttctttttgggaagggctcaaatcattctacagatattatgtctttaatcctaatgtttgaattcattctagattggtcagccaattcttcaacaatcagaacattgaagctcactcagttgaaacctatttatatttgtacttaggaaactaatgtctccttactgttctctttccttttttcggttcttaattcctttgatcacagaagttggacacagctcttgagtacggattgactaagcgaaccatgactgaactggctctgtgtttctatctgctgaaggttaaacagaaactcaactggttccacaccatttgggtccctgctgtttttttcttgcagactgtgctattaatttaataacagtgctgctggagtggcggtagtaatgtagatggcaccatttgcattttggacctggctatattagaattctgatgtcaaagaccgagcagtgggctgtagagtaggtttattaaactagcaagtcttccataattaagacagtgaatttggctgaagtctaaaataaatttctcaaagactgagctggagattatcaacctgaatatatttcttgagtagaccaaatatgttttgtaaaagtaactatttcttaagaaagtgaaagtagagcttcagttgctccacactgagctggaaatcagagagagcttatgttttccacagtttttctgtgtgaatatgaacaaaagatttcactttattgcttagtttcccgtctgtaaatggggtagactaatgcctgctctttattctcaaatagttcagtgaaaataaatgttttgctttacaactgctcttgtatgtggataaatactgttttctgtatgccatgttccatgtcagttatggttgtatgtgatggatagttaggaatttaagttattatcaaagcattttgaacccttagaagaaaagatacagtatttgaaaggtagtagtagtctgtgatgattataaatgagtcaataaatatctgagaccaaaaagattcattatgctcaagctggtgtgttttgtgggatgacaaaagatattcgttatggtggaagctagatcacattctatttctctatagtttttttccccttcaagggacaatatgatattctgaaaggttttagaagcatggaactcatcgggagagccttgggagtctacacctatataattgacccatcaagaaggatgcaaaaaaaaaatcacacagaatatgtaatcccacaggatatatatttctaaaacaattctatattaatattctaactaattgattttatagtgtcaaataatgagtttcaattctgactctttttcttaagaaattagatacttttataggcaaccacattaaataattttactttatcatatcaagctaacttttatttctactttgtccctctgtttattttgttcgatattttcctcagggaagaatgcagcagtttatggagctaaagaatatgccttttaaatgataaccaggcaatgaatacttattatgtttttaggacacaagctctgacatgttagttaaggtttaccttaaactaagttaaccttggattttttcccataaaagaggtagaaatttattttattttataaatataatcagaatactgtatgtgaccttgtattggtcacatacagtacctcataaaagaggtagaaatttattttattttataaatataatcagaatactgtatgtgaccttgttctgaatttatatagtaatatagcggaacattacatttgcttagaaaaaacttccaaccataatttaacattttttgggttaccacatatcattaactaaattgtgactcatataaatggcccctggggaacaggcagaatgagttaaccacaatggagtagttttgagtaccaagcagagtgctctagtacaagttacctccaagaacgctgattccacattagggtgatggtttcaaattaaagtttttataggtcaaaatgatcttgcggaatataatcatatttaaaactatatccaacaatggatacccatggtccacatgttgaatgataagaaatgttaaccagtcttctctagcagtcaacagtctgagtttcctttgtaatcataaataactctgcccacagatgttttaaataaaaagatatatacagactaacttcaaagaattaaagagaatgttatttgtcataaataaaaggtccaagtcatgattattaaagaacatttcctttacccgtggtaaatactcagatattctaattaataaataaactaaagcatggtgtgtgattttcataaagggtgatgttaccataacctttttctacttttagaaaggtctttaattaaattatctgggttagaatccaaatttggtaacttctggctatgtgtccttgggcaagataattaatctttctttgcctttatttcatcatctgtaaaatggggataatagagttgtcataagaattaaataattatgaaatgtacttgtaaaattcttaaaataattattgactaattttaaacagtaactatcagttaattaattaatcatcttaaccacctctaactggatgagagtcccttacagttttcttatctgaattccttttttctctatctttagtatcatttgatatctgtctcatcataggctgaacaaatataagatgtgtcatcccaagttcctgtaacaaccctaaactacttttactgccttgtcagttctatatttgtgtttcccttcttaaaaatttaatattgtatgagtgtttatctactatggatgaaatactgtatataattttttatgtctaatatttcacttaatcttcatagaacaatctaacacagtagatataattccatttaaactaagaatacgtaggtttacctggattcaatcattgtgtcaagtttagtaatttgtagagccacatttttgcctgttatctctaacgtaagaacatgtggcttttccagtatatcctatatccaattttctttcttctttttgttctttggtgcctgctgagtctgtagcaccagaatttgctcatagccataggatctagaatttgtctctgaaaccctgtggttagaaccttgcttcctgctggttgacctcactgatctgcttgcatttgtacatatctatcagttcctagataccatctctgttctcttcccatcagtctgtgtgccacgtagcctgatgtgggcttacctaattctaatagcttacctgtatagtagacaccatataaagatgcatagactgtatgcatctttaaatcccctttctactattttcagtcttaacacaactgagaaatgagatgtggcagtacttatcttggtagatgtgtcagatggcttgtcataggtgtactagttttctgtggctgctgtaacaaattaccacaaactgggcccacctgaataatccaagataatctcaccatctcaagatccttgacttaatcacattgcaaagtccatatatatatgtaacattcgcagattccagagactaggatatagttatactttagagggccattatttggcctattccactgtcttttcaataaataaacttcaaatcaccagatctaattacttaaacagcatcgtggagtcaaaggattacttaaaggccccatttagaaagaagtcttgacaagcatgcatgccagtcagtcagagtttagagggactgataattaaatataaaaatacaagttttttttaaaaaacttttagattcaagggatacatgtgcatgtttgttacttgggtatgtttcataatgatggggattgagctcttctagtgtgtccatcacccaaatattcaacataatactcaataggtaatttttcaagcctcagttcccattccaatctccccattttttgagatccctagtgtctgttatttccgtctttatgtctatgtgtagcaattgtaagtgagaacatgcaatatttgattttctatttctgagttagttcacttaggataatggcctcccgctctatccatgttgctgcagaggacataattccattcttttttatgactgaatagtattccatggtgtatatataccacattttctttacccaatcagccactgatggacacttatgtttggttccatgactttgccactgcgaatagtgctgtgatgaacatgtgagtgcaggtgtcttttttatataatgattttttttcatttgagcagatacctcatagtggcattgctgggtcaaatggtagttttatttttacttctttaagatatccccatactgttttccatagaggtcgaatgaatttacatctccattaacagtgtataagtgttctctattttatgcatccatgacatctgttgtttttgactttttaatagtaaccattctgaatgatgtaagatgatatctcaatgtggttgtgagttgcatttctctgatggttactgatgttaagcaatttttcatgtttgtgaatagaaagataaaagtatttaaagatagaaaccacaaaatggcaaatattaccaagtttacagttcatggtagaaaaatagcagcattatcacaaagacttttgtatatcttcaggtatcagcatagcaaaagtaagatgtaaagttactatgcttatggaactcaggtttatgaacatttctgaaatttcaaaatttcattatttgagagatcagaacaaatcagaataactactatttttgctttttccttaggcagcaagatgagttcttttgttttttggtggtattaaaattttgttttgtttttgttttgcttttcttactatatgtgaagagcttagtcaccttgacaataggacacagtttgtgtatggccaatgtagtgccatcattcccttaagatataaattcctcattaaaaatgcatctttaatgtgcacatatcttaaataaaatcttaagaatgtcgtgaatatcctgagtattttcttaattggataatcccttagcattctatttaagccatcaactaatttaggagcccaagtggttaattaattttgatatttgaaaaggctgaaagtatagaatataaagtctctgagccttcttataaaattcccacctgactttacacaggtaactaacagacttctttcatctaatgtattcaagcccatattaacatctattgcagaaaatgtctgcacctgtctgtattctttgtcctaatgactgacatcactgtccacccaaattattcatgctaaacatctagaagccattgttgccaggggtggtactcaaccctgactgcactttagatcaccaggatagcttttaaatatgtatctatgtgcgtactccagcctggagccattaatgtttgagaagtaatgccagggtttgggcctagctgccctaatgattcaaatgagtagccagggttagaatcactgtctgttgaactcatggcttagagttcaaatatatcccacagtggtttcttttgacgagccagtgttttagataatgagtaactggatgcctttaagtggggcctgcaccctctgtttacgacagtctccaccactccctctttcaccactggggtacctgttaatttacctgtctcatctatgaaggcatttgaattttagttcctgccatagacttcttgttctctttcaacaccaaagcttgtccctgccatagacctttttgtctctttcagcagtagagctcaaccctacttagctcctccgtactataatttagtctactttctctcttctccaactgctatcttctccacaatcatctctcaattaaattgtgacagtcacttcttaactgatttcccagcattaacccctcaggtccatgctaatccagtcacttacgggcttaaatccatttgttggtgccccagtgctaagagataaaagtgacattttccaacctggcatatgatcactgctacccctacagcgttccagcttcgtagtttatcatgtcttccctgttctgctacctccttaccaagctttctcacagatacagcctcctcctccctgccacccttagcactccagaccccactgatgccccctgtactgcaggcaggctgagctgttgagtagtccctgaacaggcattgtcactgtctcataactgtgcactttttttgtatgctctcttctctccagccatcaagcccttcctgtgtagtcccttggcaaaagcctgcttatttctttgattctcatacggagtgtcagttcctttaagaagtccccactgctgttcttcactgggggcatttaagcactttgtccatgctgttccaccccagcttttgctcttccaagcactttgacaacatattttaattgtgggtatatgtcgatctaactaactgagggagggaactatgtttgtcttcatgtatgttctagggcagccttgccactcccttttatgattctgttttgttatccatgaacaaagggatatgggctcatagtcttctcaggttttcaccagctctgaatttgtatgcttatatcaaattaaaaatcattctaacatctaacagtacccaacacactcaataaatactgaaataacgatttaatttgtgaacgaagtattcttctgttttgttaatctctactggattcctacagacaactttgcatttgacattcctacagacaactttccatttagctttaattaagccactgtaatttaagtcaaatgtctgtggttagtggcaacaaacaatttcatactaaaacaaaaactttctgtaatatgtaatctgaaaacacccacactgaaacaactaaaattataatagtacagataaatatggatgatttggaaaatgcaaaaaaaaaaaaaaaaaaaaaagaggaaccgcacccccacaatccaattaactggagaaaaatagtaatgtatttctaattttcctctggctttcccccccatgtagttgtttgtttattgtatattgccttatttttttgcaattgtgaattttattggtgatattagataagatttcggcttctatttaactaatagacatgtcaatttacttgtagaacagaacaaatcagaaaagacaggaacccagtggtaaatatataactaaatatgtgaactttttccaagaaggctcctagacaataggatggcccggtaggcggcagaacagtaggtttctgctacatccacctgtattgtcaggtggttgggtgaaaaagtgacctcagaaatggagaagtttacttaacagaaatgtatactggagagacagcatatggtcagcttcagagtgggctagacagcgggaatagggtgtattctggcaggcagatagtgtaaatggaaaaagtggtcacagccactaggtgataatacacattcacttattcacagtacctactttgtgccaaacaccatactgggcactacaaattccacgatgaataagatccagttaatgataaatttgaaaaagtaaatacacaattataccacatgtagtaagtacttcacagagatgtcctcgaggagagatgtagtttggggtttggcaacctcagttgttgagtaagtctgtctgcagttttctggaaggacctcagaggaattagtggtttttggttcaggtgtggactctgaagcttaacagggaagacacaaaagctaagctgacatcagtcctcaaggaaccaggtgggaacttggttcaagggctgcaacagaagtctaattattactattattcttaacattagccttaatattaccttattgaggctggaagtccaaagtcaaggtttccacaggatgagtttttttctgagggctgtgacgaagaatctgttccatgcctctctcctggcctctggaggtttgcgggcaagctttggggccttgtagatgaagttctccaattcctgccttcatcttcaaatgatgctctccctgtgtctctgtcttttcacaggatatgcattccctctgtgcatatccttctctggacccaaatttctctttttataaggacatcagtcctattggattagggactagcctcatgacttaaacttggattgtctctgtaaaaaccttatttccaaataaagtcacattcttaggctctggggctaatgacttcaacatatatttttggggagacacaattcaacccataacaatatcatatgcacaaaaaacaaaggattgtttttaaaaagggtgattcagaataataacactgatttgtctagaactccttcagtttttgggaaacaattgcaggattggagtcataggctgacaagggatttagctgatggtgaggctcaaaagtcaaaatgcaatcaaatacattaaaatatatttaaatatcctgaagccctttataaaaatgctcttaaagcccacaaattcatttagtcttcctgtactgtataaacttttatttttgtcttctcttagctgcacttcattaactccttaaagtacaaaatatattttctttccctctctggcaatcatgaaaaataaacctggacaaggaaaccagaagagtgtgcacaaagctatgcatcacagtgtccatagtgaatgttcacttatgagaaagcgattacagttcttactatggctatgtagccccaggagaaggggaaattgtccatacatttaaattgaatttgaaaataaaactaatattttagaattataaaatatcttttgtgatttaacgcgtaagtatcagattagctttacaactttgggtaatttgcctgatcttcactttaataggtaaatgaaagtacttttattatgaaaaagaagtatgtgcattattggaaggtagatcacagataatgtgcttggagaattcggtcagcacattttggcttatgagaacaagtttatagtctgcacagaacctggaacagacatggctgcgtagttttgaaggagagtcctggtttagcaattagataactacattcttttcctggtctgtcacggactcttatgagcatattttcttatccacagacaaagaagttcagggtagttacttcttatattcctatcagctctgaaattgcatgcttatattaaagttaaaataataaattcttcctttaggaaaaatggataatataatatttaagaagatttttaactcaatattgcatttctattaagttcatgattttctcttaaaaagcatagagatcatcttgccttaccacagaactgaacttctacaaattagctaccaaaaataaaaaagaaacatacacacaaagacatacacactaaccaagagatctggccttattgtttaatggtggctgaaacagaatttttttaagggtttaaaatgaatgtgtatcatgctctttcataaaacattacaaattaaaatatagatatatatgaattttatgaagctgtttgaaatgttcacctacttaaagtctatagagtattttagcactaatacctaacaaaaaagcacaagaaatgtgaaaatgagaggaattagttaaaagaaaaatcagtaaaatttattacaggtaatgatgctcctcaaagattttttctgttaataatgaaaagatataatgcttacctgattatccatctgattttttttttttggttgggtactcaagattagtcctatgcagtagtctaaagtcaagtatgttctagagtttggttgaattgatttgctagccatcaattgaagaatgtagtagcctatacaaatcagtactttacaaattttggcattacaatttttgattttcaacctaagaacaggacgattaagtaaagaactctgataacctggctcccatgatttgaccccaagggagtgttttccctgtttaaaaaaaaaaaaaaaaaaccacagggtcaggcagattatgagctctgatatacttgagaaaaagacatagtctgcctggtgactgccagggtcaaaaacaaaaacacagagcacagcttggggagggctggaaaggggccagatgggagggtgagagatgtgcttgggtccagttgagctgaatgttctggtcagggaaaggtcagagtctgggcaagggcaggaacagcaggcccatgccaactcagatgccagacatcagggccattccaactggtggattccatttgtttttaattatcagcataccgaagggacttttgtttcttgtaaataaggatgacaaacaaattaaactctagcaggtgcaagaagcttattctgtcctgagctaaaaactgtcctggctaagatataacttgccaaatagggctggtgacaaggaggtactcttcttccatatgaaaactcctggttgtgggctctaagcagagacgctcaagcgaatgcagctgctctataggtgatttttattttagagtgattaccaaggcagttgctgattgttgcattgctgtgttgaaagtcatttcaaaacttggtatttgagcacagtcttgccaaagtttgaagtttctgtccaaggagcttcagtggctgtctgccattatgaacagctccctagggcccaagggtccagctgcttcactaagaagtgttgtgatgccatttctgagggggataataaaatgctagcatacagtacagggtctgtaaatcaacacttcaactgggaggaactggatttctccctagggtaacaggaatgaggcattaatatgctaatttcagtccgaattcagtccctttgctcttttgattttgtgttaattctcccatttatgcctttgcacacgtcaatctgaaaatcctttagtggaatggacaaccagctgtccaaggtgggtgagtcctcattccttacagagacagagacacagattaggtgttcccctgtgggtctttccaatcagggctctgaaagcacagcttatctcacacaaacttggttccccctcagagaaactttaaaagacgctttgtttttgccaagattttctcttggttttctgcttaattaatagggattcaaaggaaccaaaataaaccatttgtggtcagtatgaatagtgatttccttgccttattttgtgagctatttatattgaactgagtagcgaataaacaactaaaagaaccattaaatgtggaaaaaaataatatctcaatgttttaaggtgagtttttttctcctttttctcattaggttttgattatttgagaaatttcaataaattgtcaaaagtttcacataattggaagcaagcagtgtctattatagctctaccacatcatcatccataaatagaatttaactagacgataaaactagctcttaacatattttagaatttcacttattcaaaaatattacagagtccactatgtgactgagaccttgtgatgacttggaaatgtaaaaaaataaaataaatatgatgtagcccctaaggatttcatttactgagtagagatattaacaatatcaatattattattgaattgctgaaatataattatgtacatggtgcaattggtgaatggaataaatagagatcaaagaaaatgttacagagaaggaggcatttgaaccaagaggaaagagtgcatggaatagggaaaggaaaacgaatgaatgtgggtgtggtaattctaggtggaagacacatacaggcagagacataaaggcatcatgagggcatgtggtgtgcttgtggagctactagcatttagttataatgagaatataaagttcaaggagaaattctttgtagatgacattgggttggtaaacatggggttggtaagaaaatgtcagatcactagagcagtaaaatatttttattttgatatagcacccactatgtgacagataccatactaagcagtgaggaggcactaatatttgtaacagaggagtcaatgatatcgaattttcatgttagaaaggttaatatgagacataaaaatataaaatctaaaggttcaaaagagaagtcagggtattataatattatgataggtataataatatgcccaaaagagacatcctgcttcaacttctgaactggaaattggtctcttccccttttccctcctaatctcttactaggctaatttcttctcatttctcatactcttaaatgtcatttctgccaagggctcttcccctaacaaacagattagattaggtcatttcatacatcaacattccaccttacatattttcttcatagcagttcgactccctgcagttacccacctttgtaattatttgcttagcatccactagtcattagcttattgacatcatggcgacaggaatgaactctatcttgttgaggagagtctttagcacatagcaagtgttctttctatattcttgtataaataaatgatagttagggaaaataatattggataaaagaaaatgaggaagaggaatatcaaaaagacatgattgaaagagcgtggtgaatgaacgaaaaggaaaaatataagagaaagacaaattgggatgagtctcatgtttctagcatggataatgaataagaattatgactaaggtatggggtaagattatgacttaaattttagtcctgttgtaataattgatgagatcactgctcatattaaattaaattttatttttgttggaaagatttggtattttatagtcttattccagtatattttttaaaacatttagtgtagaatgtttctgtagacgattaacacatactgtttaagttgatagttctttgcttcaagatcagaaaattatgtctctatattttcatcctcatatttcaagcattcatccaatatcaaagccgggctcctttggcatatggcataataattttttaaaattttccaattatttcaattaaagattcggaaaagctgacgggggtattcttatctttgcaatcagacttggtttgggtactagtttgtgcttggatatgaaataaaatagaaataggaaataaatctgtaattatcttgaagtttaaacctctaactacataaaatctgaatccagttaaagaaagatttctaaaaacagaagataaattttgacatcaaagactgccgtgcaaacatctcctcatttattcctgttatttaaatgaaaactatttatctgtttcttttcagttacacacaaagaaaaagaaaaaggaaaagaaaaagtaagagaaaaagaaaaacctgaaaagaaaggtatgaagttacttttattactgtttaacacactgagtcctttcccattgacttcctactctttacattcagattttagatgaccacgcagttttacaaattagattaggattattttctcagaatagaatctgaaaaaaggaatttctggattgagagaaataaaatacttcagactgttaagaactgttgaactggaaagtggtaactttccagaaatgttgcgtcagtttttcctctggcagttttgagactgccttagccagcagtgaggatattatatcagaaatacttgtcagtttgataggtaagaaagtagatctcattattataacttgcatattttgattatctattagattgctttaatttctaattgttatttatttatgtagaatagataataagttctaattgctcaacacataaagatactttgtgaaaaccttcctctcaccttgctcccagcctactggctcccatttcatgccaaacccacatacagtagaccactcatgtgaattttacatgcatccttccagagctttattgtatgttttccagataatccatgttattttcctccctatttttacacaaaatctagtatgtcctataatctgacttttacaatttaacaatatatcctgaaatcttctcatatcactaaatattgtcctcattctctttaaaaagctgcatagtgtttaaatgagaatgttcttccactgtaatttttcctgataatctagttaattgttaaagttaatttaatttttattttattcattaagttcttcatttctaggatttctgtttgggtctttcttatgatatctatctctttactgaatttcacattcagatcatgaattatttttctccttcctttgtattttttatttgtgttctctttttttctctctgagtttccttaagattattattttgaaaggcatttcatagatttcccttttttggaggcctgttactggcgtgttattgtgttcctttgaaggtgtcatgttttcttagtttttctttcttttttttaaattttactttaagttctgggatacatgtccaggtttgttacataggtatacatgtgccatggtggtttgctgcacctatcaacctgtcatctaggttttaagccttgcgtgcattaggtatttgtcctaatgctctccctccccttgcccccaaacccctgacaagccccagtgtgtgatgttacccccgagtccatgtgttctcattgttcactcccacttatgagtgagaacatgcagtgtttggttttctgttcctgtgttagtttgctgagaatgatggcttccagcttcatccatgtctctgcaaagtatttttaactgcttactatttataagttgaaagattcaaatatggtttttagcaatgtatatatcatgtgtaactgttcacactcactgcccatttctcctaatgatatgtgtgtgtgtgtgtgtgtgtgtgtgtgtgtgttttgggtatgtatacccttcatctataacttattttcaaatatttttctgaatttgtttcacagttaatattatgctttctgtctttgtgaacggacatgtgtgagttcatgtatgtatgtatgcatgtgtgcatatgtttagattcttgaatttttaggtggttagatatgctgacattttcttgtggtctttctggctttgaatcttcattcaagaattaattcaatagccaccaatattttcctcaagtttaaaaaagattgtttttttgttttgagacagagtctcactctgccacccagactggagtgcagtggtgcaatcttggctcactgcaacctctgcctctggggttcaagagattctcatgcctcagcatgagaactacagacatgtgccaccacacccagctaatttttgtgtttttagtagagatgggtttttgccatgttggccaggctggtctcatactcctgaactcaagtgatctgctcacctcagcctcccaaagtgctgggattacaggtgtgagccacagcacccatccaaaaaagattgtttcacattttaaatttaactttaattcctcaaaaatccatctcagtgtatgatacgaagtaagattctaacttaatttttgccattgttttagggtggattgtgtctaggatagctgggccagatttcagctgatttatgcatccagagtatgcatagtctgctgaagttttttgttttgttaaacactccagttaggtagaacacattatgacatttaggaatcagataagttgaaatatgcttcaatattttttatggtatatttacacttgaaaataccaaaatctcaccaatcaccactaaaaagcttactcatgtaaccaaataccacctggaccccaataacctacagaaaaaaaagaaaatttcaattaaataattgttattttcttcatgtttattttcttattttcttatcttattttcttcatgttcaatttccatgaacttcaatatagccatctcctttctctgttctagaaataggtgaccatttcttgtctgatattgggttaagcagaattattagcactaggctctgtgtattctgactcaatgaaataatctgctatttcttgtgattttttttccaaactttacagtagctaaatgttttctgttaaaaaaaaagttaggaatttttgcccttaaattataagtgctgcagaaaaaaatgtattcaaattgaaaagcagaaataaaatgctgcattgtaagtgctcttttatttaccttatgccaattaaaggatgtttgctttttaggagatatgttattataatgtagtcctgtgaccttgtttgaatagtgccttgcttagcctagcataatgctccttttgttaacattgtctaatctattacccataatcccaagtggtagtggaggtacctgtgggcaggcctgagtggtggagaggctgaaactctggaggaggaggcacctggtctctcagcagctctgcatgtgttagggacacttgctcttcaactgaatattaggctttctgaggcttaaatcatctctccaagattctggaggacactgtttatcaactgtatttaaaaataatggatttttaaatacatattttaagcatttcttaatgatgtaagtaaagctgatgtacattattactattcttgttggaagtaggagaaatggaaatatgtggaactaattttttcctctaacaaatcagtgcatacactttgttaactgcccaattaaatctcatattttactacttaattttcgtagtttaattaccattgttattcttgaaaaaatagtatgtaaatattgaaaaatgtatgatgatttgggaaactaccaaacaacacaatttaatataattcaaatttaaaaatacacataatgacatattttttgacaaattcttatagaaaattttccctttcagtttgtcttccctgaaagctttacctgtttgaaataatgacttgagaaagagtagatctgattttcaacaagcttgctaagtcttaatgcctagactttaacattgaattcaatacaactgttattacactggtaactctttatttctgaattagacttattaatgtcatacattttcaaaatattacagattaggttttagcacttatgaaactgaggtcaaaagaaagcttggttttgaaatctattaaaaatgtgtactaatgtaaaattttctgtttaagcaactcacaaggaaaaaattgagaaaaaagaaaaaccagaaacaaagacactggcgaaaggtaacttttcaatttattatttccataactaaattctttttactctgaaagattaatttttgggtaacagatagttggatatttgtaaacttttatcatttatattaaaaagttaatttggtcttacctttaaaatttaatatctaaaagaataattaaactgaacacttaatagagaatctcataatgtgagaggaaaatgaagagctccatcatatgtggtagacagaattttgagccccataaccctcattcaccccttggtgtcatccctatggctatgttatattacatggcaaaaaaaaaaaaaaaattgcagaggcagtgaagattgttctaaaatagggaggttatcctggattatccaggtgggctcaatgtaatatcatgagtctttaaatgtagacagattcagcagagaacaaagagatttgaagtatgagtacttttgcccattggctgtcttgaaaacgtgagaagaatatgaattctgcctccaagttcaataagcattaaagccaattctttcctctagcctctagtaaaacacaaagcctaggtgacaacttgatttcagcctcgtgggccctaagcagagaattcagtagagccatgctgagccaacactttggaatcataaaaactggaagataataaatgggtgttattttaagtggctaagtttgttttaatttgttaccacagcaataaaaaaactaaaataacatatttggttcacaatttttgaccagtattataccttgaatttgattttaaaatctcaaattcagaattttctttttaaaaaattatttattttcaatatttataggtacatagttgttgtacatatttatggggtacatgtgatgttttgatacaagcatataatatataatgatcaaatcagggtaattgggatgtccatcacctcaaacatttattatttctttgcattgggaacattccaaattcactctctagttattttaaaatatacaataaattattgttaactatagtcattctattttgctactgagcaccaataacatatattgaggaaaggacagtctcttcaataaattgtactaggaaaactgtatatgtagaagaatgaaactagacctctatctctcaccatatacaaaaatcaaatcaaactgaattaaagacttaaacgtaagacctgaaactatgaaactacttgaagaaaacattggggaaacactttaggacattggtatggacaaagatttcttgagtaagacctcaaaagcataggtaaccaaagcaaaaatagacaaatagacaacttctgcaccataaatgattttcttgcatcaaaaagaaataattggctgggcacagtggctcacctctgtaataccagcactctgggaggccaaggccggtgaatcacttgaggtcaggaattcaaaaccagcctggacaacatggtgaaatcctgtctctagtaaaaattaaaaaattagccaggtgtggtggcacacacttgtaatcccagctactcagaaggctgagataggagaataccttgaaacctggacgcagaggttgcagtgagctgagattgcgccactgcactccggcctgggcaacagagtgagactgtctaaataaaaaaaaaaaaaaaagtggtcatgcataaatcttgatcaatatttttactttaaaagtttgagaactgaaagtaccataataatatgccaaatatatttattagtatatcactttaatattagatattttggcatattgaataacaaagtttttctgtattaaatttatctgccaattactagaaaaaatggattttatttggtaatttaatcttattccctacatttaaatttcttccttatcttttaaaatatacattttaggcaattagctagaagcctcaattcagtatttttaagaaactacccatttaggtaaaactcagaagcatttttaagatttagtttagctactaaatgtaaaataatgagatatttgaagcagatatattttcaataaatcttccgttagataaccaaatatcattttattaaagttaatatggatgaattgtaaactgaaacatttttagaagataacatgaatttactttcaagattaaattaaaataaataaatgtaattttattttgtttctcctgtttcataaatgcaagtgaaaataaattttgtatatatataaaatttgttttcattacatatacatgaaatcatatgtgatagatgtatgaaatctagtggacattttaaagatcatctaaattaattacctcgtttaacagatgaagaaagtgacctctagagagagagaaaaacatttttgccaggtcataaaactggtatatgatttggttaagactaaaaacccaggtgcagtcagtatacattgagtattcttcacaaaaataattaaatacaggtcttcaagcatcttttttttttcaaaaaatttgttgaatactgcattagttacttattgctttgtaaagcattaccacaaaatctgaggcttaaatcaatgcacatttattatctcacagtttctgtggatcaagaatctgggcatggcttagctcaggcctctgtttcacaatcttacaaggtggcaaacaaagtgttaactaggacttcagtctcatctttagtttcaactgaggaagcaccatttgcaagttcactatatggttgttggtgagattcagttcctcaaggactactagccaatcagttcctggctggctgttggctatggaccatcttcagttccttgacacatgagtctcatcaacatgacagctggcttcattaaacctattgagagagaaacaggaagacagaaattacaatcttatctagactaatcatggaagtcatattcaatcacctttagtatacactatgggttagctgcaaattcctagggcaacccatattgaagggaagatgattgcacaaggatatgaatgccacaagttgggagtcactgggagccatcttgagtctgcttgccataaatactttccatttaaatatttacatcattcttctgggggaggtgcacacacacacatacacatacacacacaaacatacatatatatgtgtgtatatatatgtatgcataagtatatatgtgcctgtttaaaacatatatatgtgtgtatatatgtatgcatatgtatatatgtgtctgtttaaaacatatatatgtatgtgtatatgtgtatacatgtttgtatacagtatatgctttttatttttattttatatgtgtatgtattatgttattataagaaattaatagaaagtgttctttatgtaataggtggtttctggtaaaacaaaataagataaaaagtcataagccttctatgtgacattaaagatagaaaatatcataaagtatctttgaaaggtgtgaccagttaaagtagaatctccctttgaagagctgtgatttctggaggcacttgcatagaacacagcatgtttcttgctctgttgcatactgcttgctgaaaggcagccattggttagaacacttcagggattcctcctggggaagagtagacctttaatgtctaccttgatacatatgtaggaccccatatccactgagaaatctagcctatttctgtagttcattaaaaacaacagagacaaggtagaagaaaaagaagaaaacaatgatgaaaagagaagttgagtgaggtgagccaagtttgggccaggctgtctaattgatgtggatgtcagtgtgaccttcagatgtctgtgtgtttgatgatgtggcagaggttattgctgccttggtcactttcaggaagacattttatcactttcacatcgttcatgtatatttatatctgcccttatatgtcttaaaatacagtttttgtatcatctttttaggttaatattaatacgtgtgcaattcactgtgattagaaattgggttagtcattctgattctactctttctactcctaactcatttagttgcaccatctttgataaatggctttttgatacttagatttttcaaatgtaaaataataatgaaatagtaattcctgctgtacattaaactgtggataagttctagggaaactccaagagctctagacatgcagattatgcagatataatattagaaatgtttacatacttattttgcagaattcaaagttattttgctcagtgttactcatctccacagcttccatagaggaagaggcagttacagtggcgattctttttttttaacgcaaagaaactgaagcagagaaaaaagttaagcagtttgcagttctttatggaatgagagagaaaatttgttattttctaactcccaacatgtgtagtatgtttcttgagggatactattctatttaatactttggcatcagacattctgaatctgatgcagtagctaatggatcacgctaattccaagattgaatcaaatatgctgatgtcattttttttgattaggccattttgttttccatttgacaaaagtcatgaataaaatgccttcctaaataaaactgggtgatttgaatacccatggcaatactttttgtttttttcattccttaataaatttcatcacttaaattattttagggaaaaatcaggaaaaatattttggcacaaaattgaagaatgtgtactcaaaagtaaatagaagttgggtgttgctttagtttcatgatattttctttattatagccacatcattgtttagttgtcactcatttttttctactatgaggcaaagttatctatttccagagtgaatgtgattgaagagtgtctaaaatagtagaaaatattttattatttttatacttaaagtcaatgattataatgagttggctatatatgtggttctacctcttagaaaataatcattgcccacttataaattataatggcattaaaaagaaatctgaatttcacacgtctatagttccatactataaagttaaggttaaatcaactgtaacttacaaggagtagatagctgtcatttagagtaagcaaatataacaatttcatacaaattagtataaacaaaaaaaaaagttggcaagtttaacaggtttagacaagtttatttctaaacacatatttacataatgcagtctctatatcactatattatacatatgatctgagtatagtggaatatttactctctccatcaaaattgctaatccagtatacatttatcctctgttttctctgaaagaagcattgtgctagacactatggtgatacaaaaataataatagaattcctgcccctaagcactgtctgtctggtagggaagacagatagatcaaactatctatatttcaagatatataataaagaataaaatgtataatttaataaaaattcagaaaaatggaagctcatgggaagacattattaattcaaatgggagagccatttttttgcatgtgaattgaccatgaagaaatttaatcccagcactttgggaggccgaggcgggtggatcgcctgaggtcaggagttcaagaccagcctggccaacatggtgaaaccccatctctactaaaaatacaaaaattagctgatgttggtggtgcacacctgaaatcccagctactcgggaggctgatgcaggagaattgcttgaacccgggaggcagaggttgcagtgagccaagattgcaccattgcactccagcctggcaacagagccaagagtctatctaaacaaaaaaacaaaaagacaaaaataaataaaaaagaaataaagaaatttaaatatgtggaaaaatatagaaaatatagagaatgcagtctgacaacagttgacacatggaaaaatacataaaatattcaaaagaaagaaagcagtccagtagaggaataaatttttggaaaagtgctgtaacatgggagataggaggaagccagatattgcacggttttaattttgctgtgctaaaatttattcaggtagttttattattatgctgatttttagagctccagcaactagctgtgagcccaggtcaacatagactctctagaagtgttttttaggtgaatgagttgcatgagattgaggtgctgttgaccactccagtgaaactttctttccagacagacactaataaacattccagtgtggaattctggaatgatttcaatttaaagtcatccgcagaaagctgctggtttcagtcacagaaacgtatgagtttactgcaggaaagagcagaaaccagcaaaggaggtttagaaatgatttataggaagaagaaaatcccctgagtgtagttacagaagccacaaagatgttgaaagtttatggacatgtgaaaccccatctctactaacaatacaaaattaactgggcttggtgataggcgcgtgtaatcccagctacttgggaggctgaggcaggagaattccttgaaactgagaggcagaggttgcagtgagccgagatcgtgccactgcactacagcctggatgacaaagcaagacttcatctcaaaaaaaaaaaaaagtttatagagtaattgagtaatatttgtatgagaattttatgattaaacaatattgaataatgtgtgtatcataattccccttcttaaaaattctcaatacacttcagctttgagaaagtccaagctaaacgaccaggttagcttattgttgccaaatgaatttggccatgagaatattctccaatacctaatacagtatcaacatcttcctgtaaatatctgaagtatctgagaaacagtgttttgggaagtgctggcgtagtcaattaagtgcaataccacagatgatttttggtttgcaagctaaccagcatctggcattatcattttcattctctcaatgggaccttctgatattatcttggcttagcctgaaatcatcatttagggtaccaaagtcaagaaacttgattacattttttcattaaattcttttttttttttttttttttttttttgagacagagttttgctcttgttgcccaagttgtggtgcaatggcgcaatctcggctcactgcaacctccgcttccctggttcaaatgattctcctgcctcagcctcctgagtagctgggattacaggcatgcaccaccacgcccagctaatttttgcatttttagtagagatggggtttcaccctgttagccaggatggtcttgatctgctgacctcatgacccgcccgccttggtctcccaaagtgctgggattacaggcatgagccgccatgcccggccttcatcaaattctttaacatgagtgacaataaaggctacacagtgcattagcaaatgacatagaggattccaacattgcagtagagttgctgtggtgtatagtggttatgtgtagtcacatacaaaaaggaatgtccaatattcagcatctattatgaacaattttccacaaattatgtgctacattattactgctttttaaaagatgcttgaatgatccacagactagttatttgcatcacagttccctcttccaaaatacggataatatcaaattaagaatatatgtgtgtaatatatatatgttctaatttatatatctattcatatatatttttatttatagccctttgaatttcccatgatatgtttaagggctttaaaaactagtagaattatcgctgacttaagataaacaggagccaatatctgaatttcttcactttcagtttttctaaggccaaatcattagactataggtctttcagttatcttctaatggatttcattgttttatttctgttagtcaacaccaatgcgataattttacacttgcattactaattgttgtctttaaaaaagactttgttggcatttcagtttcttgaatgacccttaagatctttcagttatcaagcaaaatgatcatgtgcttataaaaggagactacttcactgggctgtttggtatggaaattgtctttcacagaaattcctgtacatccatcccctgcatgctacaaatgcctccttgttgacatgctaagttactattgccttaaaaaatagtgttttcatgtacaaattaaaagccataacacttttagtagtctatctaatatagcacttcataaactgtataaaactctggtaagtcacaagtgtttatgttaagaacagtatttttcattgttttcctgaaaaatactgttcttaacataaacacttgtgacttacctttcttccctctttcttttccaattttccttaatgacatagtacagatgaaacattatgtttgtaaataaacaaaagtatttcaacatcttttaactttatacagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaaggtaaacattcagagcaggaggctgccggaggttctaagagaatattgggcaagaagcacatgcagtgaaattaaaagttgaaaaagaccaaaatcagacttcaaatgggggtaaaagacattaaagtaaatatatcagaaaagaaatacagtaaattgggaattaatatttatttataaaaatactaaaatgtgttcacagatctaaaggggcattttgaagtatttttaaaaggggtttggaggtagcatccgaaatcatataaagattggggataaatgttgaatttttgagatatggaatgtctattaagaggtggaataaagattgtatgtgtcatactctttggaggaaagtggtcccccaaaatgacagcaattcctaaggagtttgtgaaggggtacatgttggaatcatatagagtaaatatcataaaaactatccatacattactgttgcattggcaagagcacatcatttagaatatacatccaattattaaatttatttaataggcaagatgttatagagaagacagttctcaagattctttttcagtttccattgactaaatttctaactttagaaagctctgaatgtgacatatttcgccattcttcagcaagagtgatgtcaaacttacatccccactttgcaaaaatatatcacttcaatggaggtggcatataaacctgaatttttattttatggaaggttgctatgtgaatatacagagctgaaggtttaggagggcaactaagggtcttatcgtaccacatctctggcccttattgaatgtttcttttcctaagtccattcctgactccagtttgctgtataatcctgagactcctttacagaatacggggatctaacatgtagagactattcctgtaattggtgtttcttggagacattgcaaaaccaaatttttctttactttgtagcacttttgactaatgttatctaaggactgtatcaaagaattggtttctattagattttagtttaagaaatcttacaattttattacagagcaggctatttggaggatgaaactgaaattaatttttcctcataaggcacaagaaatgaaatttgcaatgcactcgtactgtattttcatcttttttctcttgaatttgcatttgtaaactttgattcacatgtagtatttgtcaactctgatttatatgacaaaagatacatattttaaaaatatatattttaaaaaggaaagattttttctttttttagtgatctacaaacctttaaatttagataattttaatttattattttaagatataagtcatattaaaacttaggagctctaaaactttttccaattttcaaggtgattatatcaccatgaaaaaaatttaaaagttaattattacttccatcaaaattatgtcattaatgaaatattttggtagacaaaaaggatgaagtaagtaaagagaaaatacgttgaatataatattttactgtggtaaaaaaacagcagaaataatctttggattcactggtatgattacttagatcctgaaatcctttacactttagattgctgttcaaaaagaaaaataatcacatgaaatcagtgaaaacctacaaagtacattctaatttttaaccataaatacagagtgtaaaaattgatgccagttatatttggaaatgtcaaaatacttatctaacaactaggaatgtgaatgtattttttgatgttaatttttcatatctttggggatttgggagccacattttattgataaaaactcatcaccggaacactttaaaataatgtttattttccaggccacaaatattgtatttcatttctatcagtaatcagatttattaaagacagcattatattaccatattccttttcagtctactatttttatttctacacaaagagttatttatctattaaaaggacattcaaatatcatttagagtttaaaacaaaagcacaaatgtgattttatcagctaaataattgcaattgctaaagcaagtctcagtattgagaacaattgccatcaattatataaatgtatcattaggtaagtattcaaaacttaacctctaatggcagatcagacatataaatatgtcattttatttttcattttttgttactaagcaaagatttaattaagagcatttttaaattaaagaaaactaattacattatgattttagctaagcaagataaagatatagttttttttaatttctgaggctttggttttgaaaattttatatgatgacttagttgagttagctcaactaagctaactgttgagttagctttttgggcaagagaatactcattcacatagttaagttagacctaatatgtttgaggcattcttttcatatagatttctaaatacttctttttaaagaaataaggctcataggtcctttactcacttggaaacagattttcacatgggacacatatttattagtaattatttaattacatagtatacatatgaatatattcaatgtagttactctcaatattgtatatggaaataatacatctctttttctgcttaaagcattagggataagatgcatatgtatatacacacctaccataaacacacacacacacacagacacacacacacacccatcaaataatctagtttttatgaacccatctaaatctgtttgtagagtaggaagagttggcatagtcagacattgctccctagttttctgatgacctctaggaggtctgtggggaaggagaaacgaattttccagctgccacacactttgctccttcactcattctttcttttaaaacaactatttgatatttgtggcaggcagagaaagtatagctaatgtgaatctgttatagagtactggaccacatgtgccccatcctcattacaggtttcttaaaaattttttgttgttcttgacattctgcacccagaatgtattttccctttgttactattccacagggaacaccaactaggtatcatttgaatgacatctatcactgcttcctgagaatcaagaaggagagaaatggacagcatgtgttattccaagaaggatgtttatttggggaaaaagtacttacaatgatgagcaaattaacattatataaattattatctcagaactatgaaagttagaatggcaggacaatttagattttctttgtgaaaaattttctgctataatatttaagttgggtttaaagaaacatttttagaacacaaatctttcaaaatcaggaaggcttggtttttctgtattcttagataggttaagcagataaactggagacttcccaacacatacctacctagaattcttatacgttgttaaggtcattgccaaggacaggtggaaatgggcatcctaacttaaaatatttgaaaattcctatcagctttgataggaataaaaacatctttctcatattcctattgatatattggtgccattagaatacaagatcacagcactatttacatataacaaaaccttctaagtgttgtaacaaataattttctaagttaaaaaacatcctctgaattcataagaaatttcctttttgcaattagaagttcattgggctgttggtgtattaattaaatgaatgatttttggatctaggaaatataagaaatataagtaaggtacagttgtcccacagtatctgtgggggataggtttcaggattccctgcaggtaccaaaatccacagatgttcaagtcttttatataaaagggactaatatttgcatataacctatacacatcctcttgtatacattaaatcatctctagattaccaatactacctaatgtatttaataaatgctttgtaaatactggttatactgtattgtttagtaaataatgataaggaaaaaaagtctgtatatgttcagtacagacccaaccatggtagctgtaactatatatatatatatatatatatatttttttttttttttttgagccagaatctcactatgttgcccaggctggagtgcagtggcacaatctcagctcactgcaacctctgcctcccgggttcaagcagttctcctgcctcagcctccggagtagctgggattacaggtgccctccaccatgcccagctaatttttgtagttttagtagagatggggtttcactatgctggctaggctggccttgaactcctgacctcaaatgatcctcccgcctcagcctccgaaagttctgggattacaggcgtgtggtttgttgaatgctccaatgtggaacccagggaaatggagggctgactgtactttgataatatttcaacatacaagctgaaaagtttcattacattgtcagcattcagctaaagaagactctctgaagcgtgaagattttaattaattcagtacactcttcaacatgttatgtatataactatcccatcacaacatggggcagataatatttcatttggaggggatgttatattaaaaatactccctgcattctaaacttccaacatacataaaaacaaacactcttatttgctgtcatgggagtctatagtgcctctaagagtaattattttgggaaaaaggaatgaaaggttttagatcagtgattctgtaaatgcagtctaattagattcatctaaggagtttgtataaaatgcatattcctagggtccagatccatggcattttaattttttttggatgatggagcccaaaaatctgtattttgacaactcctctctctttctcgtgtttaagttgccctttgagaactactcctagagtataggcagaacaaatctaaaaagagtacagtcacttaaggtactgaaataaagggaacatactgccgatttcagaaagtccacactggtctgacttcaaacttttcatttaagggaaatgtactttttcatcttgctttgtcttagagtcaaattgccagttctacagttttgttcaggaaaacaatctcatgtctagaaaagagaaaataccttctaccttaaccttatgtctttcccaatcatagggttcccaggtcctgggatcagaaactccagctattactgccagtacatcaaagggcaaatcaatgcatggaatgacctgaggactagcctccttcccattccctacctctcctgtgggaaaatgtgctccaatttcaacaactaaaatacatctaaatttttggaactttatgagttttggcctgcccttatttaggtattaatgaaaaagattatatttttatatcttcttcaataactatatttattttttaaagacctaacagaatttcataataaaatggattcctctaaaaatgctgttactactctaaaaagaacgagatttacaaaaatccttagaggtgtatctgtttagtaacaagctttgttatttcatatgtttgatatgcataatttggagcaattaagaatgtaacatgttgcttaaattcaataaactctcttggtcctaaagctgccttcggatttggtggattaataaaatgcatatttcaggaatattgaaatgtaaattatttcataatatgtatgctttaaagcagatacggtaaagattcatcaattgagctttgagttggattgacctcaggagaatctaaagttctgtgaggatttaaagttaagtgcaatgtctttaatctagagggaatagaaaaaaaaccaactcctgaagaccaggtctgcccaaaatgatgtttacatactatgttttttttgtttgtttgtttactttcaccataggccataaactagtcaagatcataagatgatcttaagaagattactcatttgattagtttaacaacaatatcatttggttctgttactctgttcttgatttactctcccaattaaagagcatttttattcagaggccacctaacaggttgcaaagaggttagttctcctgatagtcttttggaaaagacattctgctgctccatagagacaattagcagaagggctggaactgagtatttgataaaacactccaagttggaaacaatttcctcttgtgaaacttctgtttcattattgaaagtttataaaatgacaaatgggaaaaattgctttaatatgatgacttttgtaatcaattatttgacaaaataggtttttattttgaaaacaaccactataagattaccctgaactagtgcttttcaatttttgaggttatttttgtatggaagaaatgaagcattatatttgtcgtctttctttccttctgtattttcatataagtgcaaattattttttttacagaaaatattgtagtaaccaaaatagaattgtgctattttgtttgctttgttaaattatttctctgtagaaaaatgaagtgttgatgacattttttcattgctctttttctttctactctgtcagatcagtatgcattctgtcgatatatgattgacatatttgtccatggggatttaaaaccaggtattccaagcaattcttgtacttgtctgttttaatagtctttgtttctaagattgtgggctttttatgtacctaactgtattttcattttttaaaaattgcataatgcatgtgtagatctagaataaaaccaataaaaagcggtaataactggcattaaggtcttaattttactttcagtcactgcatggcctattgcaaatgaagtcagttgaaatgtaaaatatgtgctaatatctctctatataaggaatgctaaaatctttaataatgtcttgaagtgaagcagtgaatcatcttattttattcttggtaaacttagaagaaaagacccacgacaatgaaaatatctttcttttcttagtagtgaacacaattcatattaaaatcatcacatttcaaatatttatactttgttttccaaaactttaaaattttctcccttatgcatgaacttggtttagccactccaaagaactattgttggagatagataatcttggaattaatattcaaaacaatggggaaggattttgagttaaaggaatatatctaccttgtcttgtatctttaattgttgcccagagtataaaaaggtattttttactaacatctgaactaagcatgagtaacttgattgcttgtactatgccttttgcagatttaaaaactgacagaactatgttcatgtttgggaaaacttttccaagaagacagtattgttaaggaaggagctcatttatattagaataaatgaagctaattgcttaaagacagctatatttttattttcttaactatttttgtgaaagcctttcaaaaatatataattataatttatgtgtatgtcatcaaagagacatctcatttctaaaacaaataggtaacacatctaggctctagaaaactagacaatgagaacctttgcactccggaaaatgttgttgatcccagtaatttattctagttaaataatttcctcctcctccccttttccttcttctacattttcagtaagaaatttaaatgagggggaaaatcactaaatatatattataatttataaatatatattatatataataattatatatattatatattaatatattatattaatattaataatattaatgatatatattattaataatatattaataatatcgatgtttgtgtatagtatcatagcataattggaaataaaccttcaggaaggtagtgtgatatggtggaaagacaaggctttggacagaaatacagtgataattcttaactccatccttttctagtattaggtcttgagcaaataattgaactctacctcatttttagtgttcttacatttaaaataaagatcacagtcacaaccttgcattgttgacaaatcatctagtgactacaaacaaaatgttataactttaatttgttcatttcaccactgcctgcctggtgagttccctacatgaagagaacctctcaacacttacaagtttcagtctatatatatcaaaaattcaatgttagggctgggtgtggtggcttatacctgtcatcacagcactttaggaagctgaggcaggaggatcacttcagcccaggagtttgagaccagcctgggcaacatatggagaccacatctgtacaaattttttatttttttattttttttgagacagagcctcactctcgtcactcaggctggagtgcaatggtgtgatctcggctcactgcaacctctgcctcctgggttcaagcgattctcctgcctcagcctcctgagtagctgggattacaggcccctgccaacatactcggctaatttttgtatttttagtagagacggggtttcaccatgttagccaggctggtctcaaactcctgaccttaggttatctgcccgactcggcctcccaaggtgctgggattacaggcatgagccactgcaactggcaaaaaaaattataaaaattatctgggcatggcggtatgcacccattgtcccagctacttggtagggtgaggtgggaggactgcttgggcccaggaggttggggctgcaggggtgtgtgagctatgatggcactatcacattccattctgggctacagggtgagaccctgtctcaaaataaataaataatttaaaagttcaatctggccgggccaggtgggtcatgcctataatgcaagcattttgggaggctgaggcgggcggatcacctgaggtcaggagtttgagaccagcctggccaacatggtgaaaccccgtctctactaaaaatacaaaaattagccaggtttggtggtgggtgcctgtaatcccagccacttgggaggctgaggcaggagaattgcttgaacctgggagagagaatttgcagtgagccgagatctcgccactgtactccagcctgggccacagagcaagactccatctcaaaaaaacaaaaagttcaattttaggtcaaaggagtgctaaccatttgttcacctgtgttggttcaagaaattcatactctacacataatttttgtaaagtcaactaggtgtttacttacatatgagatgagacgaatctatgttgttgatgagcatgaattaataaatgactaacatgcattattttcttcatattctattagttttaaaatttctttacttgaagaaaattatctgttttctgtcccactgaaatcattcatagtagttatttgttgatcataaaatataattcctaagaaagtctcaagacacagagaaccatgcactaagaaattcagcgagggatgctagtagtttaatagtcgcaataccaatcatttctttctgaaaaatctaacaacagagtaaggttagaaggaataataaaatcatctatgcatgaattaaagatgattttgttaacgaccgcacagagagagcccttctaaaggcatatgcaaacatactctaaaaagtcctaagttcagacctacaacattatagagtattccaacccctgaagataattcctagttctataggattagatttctttgtaccattaattgacttactaattgaattcttaatttatttcatctacctacattcattattttgaaggtttaagaaatgaaagaaatacttgaaaagcgagtatttcttgtccaggagttgaaaaggaagaagggagagaaggaaagcctatgtaatatgcctgttgtttcatttaataaactatatgatgttatgtaaatgtacctaaacaaaattcaggaatattatctttgtcagtgtggcaatacaaaacatggagtgagaaagcattaaatatgacttgcatttttgaaaataaggaatgagaaacacagatttaatctgggcatattaatttagagacaatgtaagtggtgagacattgactctgactggcaattatagaataagacaattcttgccaagtttattgctctgcatgtatccactacttataaaacatttgcgcttccatctgtttctgtttgggattagtgtaacacctgtattgtttagctagagttcactattaattattggtaatgagtttttaaaactataatttgatttttccctctgggattcagtttttcctttgtactgtcacaccctcaaaagtaacccaaattgcagttctaatttgaaaacgcttgctgatgaaatgtgctgacactatgacataagtcccaagttttgccttttatcccatcaaataaaatgcttctaagatattcttaaaatttttagctaagatttcgtctataaacctgaagattaattgaattgctctttctgattttctgttgtgaatggtgaatatgcactatcctagggtcagggataatcctcacttcaattatagggaccatcttaataaaccagtataaattataaagatctgctcatttggttgtattgaatcaaaattctcttgtactgacttactctatattaagttgaaacatgaagaaaattatatttaaatctaggaagtgaatgcatgctatcaacactggtcctatgggcaactggcatagacctgtatgtacattttgtaattttaggtatattatgaacaccgaagatctcccctctccagagatactttctccatttaatgacctaacatcttcatattgagatctttggttgtgccgatggtcagcgttatacaggatgtgttttaataactcataacctgccttagggaagacagagagaggagagtcggggagagattgagacagaaagaaagagattgattcgtcttatggtagctgtcttgaaactgattaacctccactttttttcctagggcttaaagtagtctacttgtcacttactcataagagaactattaaaactggtcaagacagacattatttgcaacatcaaaacacaatttatgggtttttttctttttctttttttggaaattgatagtacggatggtcaaggtatattccgccagatttatttatctttatcaaccttccagtaattccaatttccttttcaattttgtgtggcttagcacatttttcttaagtgacagctatactgataattttattcatttaggtagactatttttaagaaaacacatcaggatcttgcttggcattttcatattccttcttcaccaacttctatctgggcttaataaattgcatgggtttctgggcagagtcacccaagttaaagagacaaatttctgtaaggaagaaatcacatggttcacagacctctttatattcactaaagataaagaaaccaatttaaatgtccactacaagtaccagggctagtgtgcttgtgcttagtaattttaataattttttttagctttcatctctgtaactattatgattaaagtttaatacaagttaaagtttatcccttagaagttattccactattaaaatttcagctactgtctgacttttacttgagccaagaattatgtcacggtaatttattctgctttttgtgtcatttgttttctttaaattgagggtactcacctatcaaaatcttctctgattgtaataaggcattctttggcagcctgcattccaattcaatgggttttaagtccatagctagaaagagcctcaaggaataagttagtactctcattttattaagatccttttcttgaactttagtggtgcttaactatatttttggttaaatctcgctgagaagaggtcaaatgtaattgcattatagtcactgttatttaatggtttaatgtatttcagagctcactgcttgtattagacaagactaggtaccatttagctttgctttagacttctgaaaaaaatcctgctccaaggtaggcatagttccataaaaacatattcactctaattccaatcatttaattattttcacacaacaaaagtttcgggaattttaatgtttattcagtaagtagttgttgaatcctctcagcaagctggtggtccagaaaagaggtaagctaagacataaataattgtattaaaaaggataacttgataagtatacaatgaagacatagaaaatatacattctaatctcagtataccaggaatgagtaattttctctatcaacctcttggagttttaattattaaaaaaaattatttagtttttctaatagtttacaggagtagaaataaagggaaagtgaaagttttgataagaatttaaatatagtaaaacaaaatgtttctatcttatattccctgttttcaaagatgtatatacttcaaatgggaaatatcttcagaaagaaacaaacagctcatcagttatcatctatgagccttcagtgtattcatcttgcagataccaatttcaaattttgaatatatctttaataagttctattatatattatcacttctggtttttctagaatgtgcatcatcaaaatgtagtactttaatttttataatccttgatggtccataattttgttgaaaagaaaatgtcatcttcatttcataataaaacatttccttccttccttccttccttccttccttctttcgttccttctttattttttttttttgagatgtagtctcactctgtcgccaggctggagtgcagtggtgccatctcggctcactgcaacctctgcctcccgggttcaagcaattctcctgcctcagccttgcgagtagctgggactacaggtgcacgccaccgtgcccatctaattttttttctatttttagtagagacgggatttcaccatgttggccaggatggccttgatctcttgacctcgtgatccgcccacctcggcctctcaaagtgctgggattacaggcgtgagccactgtgcctgggcaggttttcatttttgtatttacaaacatagattacaataatgcattcaattatttttaaattcacattgtccatttcttttggatgcctgcctttctctttctttagcatttgtgcagttagaaaccacagattttggcacatgaattttataaagaaagagtactgtgacatgctcttttagcaaaatgaaatggttcaggttcttgtcacaaaatataacaggataaattccttcctgttaaagggctaactagatgagaatacagtcgtgtcctcttatccatgattttgctatttgcagtttcagtaacccacagtcaaccacagtctgaaaatatcaaatggaaaattcctgaaataaacaactcacaagttttaaattggacaccattctgagtagcatgtcatgttatcacgctctattccaccaagtatgtgaatcatccctttgtccgatgtatccacgctctctaagctacctgtctgtgagacacttattaggtatctcggttttcagatcaagaaaacacagcatacatagaattcagcattattcattgtttcaggtatctactggatatcttggaatacattttttatggataagagggaactactatagtatatttccttttttctctttgaaatgcattgttcactcattgattctatagtttaagaaaattcattgtcttatgaagactcatagtctgagatttcacttgtataatcaatttcaattttaccctaatcattagagtctagcttactgctctctgtctttctgcattcatcttctgattcatttaataattttgaaatatcttcctctgtcacttttcttctatttgaagttatggatggaaaaaataattctgaattataaactgtgttcagtgaaacaaagtaggctgtaaaaatggtgtctcaaaaaaaaaaagatgtctccaggcttcttttatatcttcttgaatgatgatgtaatacttcagtcaacactataaacaatcatagtgatgatggggcaataatgatatattttacagttgcatcatctttctaggcaatttcattattctgcttcttcattgttttagttttaagcattgttaggaacgattgatgagtaatgatgaaacagttcctatgttgatgaaatagaaaatgcttaatataagaaaaaaaagatcatgaagtttccataaagtgccttacatgtttaaaattgtccaatgctgtcacatggtaattacaagatataatgggttttgttctgtttaagaaataggtaaatttccttttgtttcttggaagacctataagaaaacaaataagtcaagaaatattaatttttataaacagaactgcttaacaaaagaaactaaaaaaactctgattgactccagtggaccctgatagtgtaatgagaaccaatgggaaaaatataaactcggtggtcacgcaagccaagatttaaatccttcacttgtgttttttgtttttttgaatctcagtttatttataagatttattacttaagattgtttaaatgattaaaagatatatatgtacatgttctcccaaatcccttttttgctttctcttttattatgaatatttattgcaaaaaaaatagtactcgtagtgtgaaagaccaaagaagatggtatggaagacataacaattgaaatagaccttgagatattggtaggatatgtctgtgtgaaatttagaataaaaatttacaaggctaaggtgataatattaaagcacagaatcacaaaatgttaagtgatttctgtgagtaccagttgctaaatatttactctccaccaggctatggaaatcttatataatcctaatacaaacttaaaaggagtatattatcatccatgttttacagatgaaagaattgagacacaaagagcttaagtggtttgccaaggtggcacaaagcagcagacaggagattcaaatccaagactgccgaattccacagtcttcagtattatctttataccaaatctatctgtttcccagacatagatagggaattgcaaatgaggtcactttggttagtactcaggaaatctagaaaaaaaaaaaaaaaacaagattggaaatgttgtacaagatcgtttggagagaatgaaattaaaaagatcaacaaggaaaagtccaacgaaaggaaataaagcctgatcatagaatatgtgatggagaaaattaagatacttttagagctatcacagagatagagtcatgggatttatagatatcaaaagataggaaagtaaaagattatttagaagctgttggtctgtaaaaactaaaaggataccttaagaagggagtataggaatacagtggggtcaatgctcactggactggacagggccgggagaagtgggagactttgaactcaccacatattattcaagccacagatggtatctagctgcaaaagggaagtatgtgaagattctagtccaaatatcatttgtttagcatctgccaaataccaagggtcattaccatttttttgcatacttatctcattaattctcacagcaaactgtgacatctatatagtgcaatgataattcacagcacttctaactgaagtaagcagctagataatcaagtgtggagttttggagaaaggtcagaggtgaagaaggggtcactaggacagtgagtaaaataagttagagtataaatattaaatatcttctgcatgctcagcagtcccaggctcagcatagtagaggatataagaatactaaaaggtgatccctgactggagcaagtgaaatgagtaattatttaaaagagaaaaaataaatagtagaataagtttagacttaggcattagattgtataatacgaactctaaatgttttaagattcagaggagaaacatctgtgattcctgctgtcaaaaaagatggagtggatctagaacttgaaagatggataatatttgactaagtgctgagaaatatattgggattgctttgtttgtatgtgaatgaaggagaaaatgaatgcgaacattatagtgcatgtgaaattgatgtgtttataagacaatgaggatatcagactgaaaagaggataaactaaaattggcaaacatcagacaataatacgttgtatatgttttgatgacagattatagaacacttggtcaatcagaaagaggtgatatttggcataaagggaagtctttgaaggactttaagcagaacaatgaaggaaagcagcatttcatgaagcatgatgggtagtagtctgtttatgggatcggaaatgagaaaaaaattgtagaatatggccaaaactggtgtgtctaaagcatagaattgaaggaaggaagggtaaactttaggaagccattattcatgggtggtgatgagcactatgtgtgacttaagaaattaatgttgcaactcaaaattctacaaagtatcctgacaattttatttcacatatgtggtggatacttaaatgagatctagacttaaaggaggaccaacagtgacatgtgcatgactatccactaaaaatataatgcagtaaggaagctgctagaacttgacctgtttataacctgaaatggagcaatatatctttctttcctcctttggctgagtcctttttttttgtatttctggtcaaagtgcatttacagcacatggctctctgagtgttggctcttatttactgcttgagcacatatataatgactattacaagtagaattttgataatgacagaaaaatattttttcagaaccacatcaacaaataacataccagactcattttgcccatagtagccatctgatgtctcctagcctttgttctactatctactgcataacatgggtaataatattacataatttgtagtgttatgaggatcatatggacaaattctgtagtccctgcagaatttaggcaaatgtggtttgtcttctgaattctaggaacagtactagtaagttcctagtagatgtagatatagcaataaacaaaatatgtatggtacctgccctcatgaagccaaggtagaatttatgtagaacttattgctagccatcaagcatacacaaacatccagaaaaaaattattattattaaagtagaggaatgattaatatgattaatgcctatagttgtagatctgcttatatttttgataaggttatgtaattggccctattaaatatgataaaaataaaatgctctatttggtttatacaaacttgaaatgtgattctgtgagacagaacattatgccaagtgcttcaggtaatgtttacaacattaactcttttagttgaaggatcaacgggaatacaataaaagtgtcttattataattgaattaaaattatcagctaaacggcaacttctatagtataatgaatttattgaataagactgcaaaaatagattggcatctttacacagaggagatattctagatctccaaattgagggaaaatacccgataagcctatcatcaatcttactattcaacagtggttaaaaaaaaaaaaagaagttacaccaagagaacccaaaacccaagatgttataagacgtttagatatacaacatttttctaagagtaaaatctttcagaaaatatgtttggatccatttcatttaccgtaatttaagtcatcttatgcctctgttggaactgcacttgtatgccctttaaatttaataatggaagattttgactatttattagactcactacagtctggaaaaatggagcttcttcttaatttgctatgaatgaaagcccaggtccttgggttcctcagttacctgataacaaaaccactagtgatacaacattcacagaatgagctgcacaaggatttcaggagcaaataaaagagaaaatggttgaagccatggaatgaataggagagaaaaaaattaaatagaataattagtgtcataaaaagaattaattatataagaaaaacttcaaatgaacatgggcaagttacttaactttctgagcctctttcctcatctataaaatgagataactttatagggttaatgtatattttaagcaatgagcatatacatacacataaaaccctcttgactataataaccataataagcattatttaagtgtttggtgtggatggtggttcccatatatagcagaattgtgattttctacccatttctaatagctttctgatttaatattcacgtagcattattattctctccctagaacatctttttctgctgcttatatataccttcaataaatatttgtctttaaatctccactgcctcataccttgccagaaacctgatatgtttgttgaattaagttcagggtgtagaatatttatttcaatgaaaaaaaatttgatgatcatcccagagcagcaatttttattcatttgtagaaataatcttgttattttaaaagatgacagatttctaaacattgcaaatagacctgtgtaaagatttcttaaaggagttattggttatatctctagagacagaagctcagaattaacaaagacaggtttgctgcatgcatgagtagactgcaggcagcatacagaattaggctacaatgagagaagaaatgagagcgagcctaggcttaattatggaagcacacagttcctggacttgccataccctcatgagagttgctttctgattatatgaagtctatggaagctattcaagataaatgtatcagattgtcatatttgtcaaaatcaatccattaaacattctagtcactgtaagtaactggaatacacacagaaatagatccatgtacttctgagtggaggtttcctctgaagctgttaccactctctcagtcagtttcattgtgataaaatgcttcaggtttttggagaaggctagtgaataagactactttgcccttaatacagtgttcatattactttacatcctctatgtccagaaaagaaaacaaaatgaaggcttaagctttttcatttttcttacaattttagaattttgtctcctagtcttgcgaaagaggaggcaggttctgtaggtatatctttgctttgagagaactttccttaaagtggcttttttggtctagctttgtcactattaatggcatggacttgctgtcagacaagaataaattccttctcaggtaacccactgggactattaaaagcatgttctaatatagtctgaaaaggaagaaataatacagagtaatttgaattgctgcatgagaaacaaggaaaattaaggtttaatcaaagaattattgaaataattatgtgttatttattaatgcaccatgtattttaataatcttatctgttagtttatatgcacaagtgaagattgaaaaagaactctagaaaattacatgaatatattcttccagtgctgttctaaggtttatttgtgtggcctagtggatacaaaatagagaataggactctttctaaccatttccataaatgcatagttcttaccccttttcttaagcggacatatttttaaatatggaaataataaatatgcccatacctaaaattttgatataaataattggctattttcagagagagctatttgataaacaatatctcttttctatagctttttttttctgcagaggatgcttttgtatttgcaaaagatgaagacaaaaatgaattttgcaatattaacattaacgttactgattgtagcattgatgattatactgattgtactgattatagactattcaacccgttgctcaacagtttttagtcaattctatgacttttattctagcttagtatatctcatattttggtttctaaagtatcatacattaagacataataatactgttattcttgcatagcactaataattgttccacaattgaaagacagtatatttttctgtttacatcttcatcaacatctgagttgctatgctcaaagttgttctattaatcaatctcagcagttattgaatctctagtatgtacttaatgctagcagtcataacaagagtttcaaaccagaaggagataacaatccagtcagagattatgaataaaacaatgaataatataaggcagctgtgggagaaaaatagaagaaggtgctaattaagcactaaatcatatgatgcagattatattctctacaaaattccagagagagggccacagtggttagaacaggccttatcaaggcgtgttttatcaatgcttatcttcagctttattgtggttgttattattaattgcttgcaatgagtttagtattgtttcctatttatttggccatttttttcatcccaaataggggaggaagtggtaataaaattagatgtagtttttaaaaattaataatactggccgggcgcagtggctcacgcctgtaatctcagcgccttgggaagacaaggcgggtggatcacaaggtcaggagaccgagaccatcctggctaacacggtgaaaccccgtctctactaaaaatacaaaaaattagcctggcatggtggcacacgcctgtagtcccagctactaggaaggctgaggcaggagaatggcgtgaacctgggaggcggagcttgtagtgagccgagatcgtgccacttcactccagtctgggcgacagggcgagactcggtctcaaataataataataataataataataataataataataataataataataataataaatgagaaatcaatccagggtaaaaactgaacaaaacattgcaccatatagatgtgatctgtaccactgtgttctcttccaaattagaccattcatacttgtgtctgtccttagttattcacacgtgattattgatattctgtcttacaaatgcccactgccctatttgattctgtatttctgctttgtgattaacatgctgctttcctgagggaaaaagtgtcacctataaaccactttctattgtaaccatccacagtgtttgggtaatgagctcttgtttagtagaaaagacttgtttgcacaattccaattccaatttcttataggaagtgagtgcaaatagatatgaaaaaagtacaatattgtcatattgaaactccctgttagaaacaaattgatgatttaatattctcttatatattggttgcattaagatgtagaccttttccattttctataattcatgacaatgtttacattaataatgattttctcccaaaggaatattatttttatgtgattataaatagcctcttggcagacactggataagcagtgtgtactgttttaaatgacaacatagtatcaattatacacaatataaagcaggaagagagattggatgacttccaaatgtgtcattcaagtgagaatatatttgtgaatttaattgttgtgttaagcctattaaataacaattattaacatgcttccattttatcctctatctacaaaatatttcagtttatgttacatgcctgtagttgaaaatgtgtgaagttttctcatctttattaaagcaccctgtagaaaattttctgctaaagtaaaacctcaagttcttttttctccttctgaggtaaactccaaaaccagatttctttttaattggctgtatagctctgctttacgcttttcatgtctctttgaatttcttgtgaacacagaatatttgaatgtgtaggagccaaaaaacagaaaaaaacgaaagacattttcccacaggtggaaacaaagcggaagggaggtattacagttgcaacattccttccttttgccaaatatcaagtagtatggaaatagtttaacagagtgattaaaaagtgccaaattgattttattttctaggaattagatctctaaataacagagaagcaaccctttttcacatgccatgtgatagcttttaaaaattatccccttgcatttaaggataatgagaaaggaaatttacaaagagcctggcctagcgtgctaagtggaattggaggaaaactcaggtagttctcaagatattgttctgcttctactctttaaggatttttgaagttttggagattgtttgtcagagatgatcacgatgacaacatgaggacaataaaagtagatgtaacacgtgtggtactgagtgctaatggtatgtcaggtactgtgctaagttctaggtatggatcatcttatgtatttctcacaaagccctgtgaagtgggttataacctcttcaactcagaaattaggaaattgaaccaggggaaattatagaattttttcaaatggctatatattttctccaggacttagggaggattacaaatatgttttcaaaaacagagggtccctgccacttaggttttttttttttttttcctttttcttcactctgtttcctaagtactataatttaagacaaatatataatcactgtttcccttataatttaaatatgacatacacacccaaaccttgtcaatataattgacaaagcagataattggctgatagcttttagctgcctttgttggttggtgagtgaaaggaatctggcatagaaaccacaagcagagttgtctgtgatctcatacttcacagcacaaatggtttatcaccaaaattgttgagagagtcttggatatggtttacttttaaatttcgtgagtatccattaagctgactgtaaggcctgataaaatatcatccagttccatgattagatttttaagtgtaaattgtattcttaatggttagagtgacaacaaattgagatgaaagagaacacagagtaaatttatctctggagttgttggtgggtcttaaggttgtttaaaatgaaaacaacagattctaggagtctgggaattgatttagcaatcaactatgccagctgctctctgtcaataacctttttagtagaatcctaaaatcaaacaaccagcaaagataggagataggaggcattatttattttctatgtttaggtagtttacaaaaatgtcaagcctcctatctcttgagaagcaaatttgttactctatttataaattattttaatacattttgtaaatgtaatcattttacctctgggaaccatttttcctcttatttcttctcctttctggttgcccctcacattcccaaaaatcaataattaaatgtgactcgattttcagtcttttagtgagtcattaatacatgttggatctctggaaagtaatactgaatataaaacctaaactattacattttaacttgagaggctatgacgtattcaatgtacccatattcaggaatatgcattgtgaaaacttcgttggtaaacaaccgccttatgagaactgatatctcttctgtattcatagcagggatcgattaaattaaatgaataaagttattatttatttattagtgagtcagtatgttaacatgtgagaggtgaagggcatgccgagggatataaattaagcgtgagattttagcttgaagttttacttaaagttttgtgttttttcttgaaagtcattcttttttttttttttttggaaacggagtgtcactctgttatgaaagtcagtcatttttaatgatatttaattatggacctaaacaatttatacataaatctaatattttaaatatttgccataaagaaaaatggatttctaatgaaatgaatgatatttattctatagccacttctaccattcaacacctcagagaataggcatctctattttgataaaaaatgttaaatatttttgacattgaaaaaagatatctcagaaacttgagttcattataactttgaatattgcgttaccataactgatggttgaaaatatgtgttctttgtattttaagttatcctcaaataaaacaagggttaaaatgcccctcaataatgtcttcctactgtactatggaatattacatttaaattgttttctttattattctaaaattatataaactagaattctgaaacataatatggcaatataatatctatctgtaattaattgaaattgttttgcacttttctaaaattgtatcttatgttttgttcattccctgtcccctatgctcttttgaaaatgcctgcaaatgcaagctcaaagacaggatactgttgtataagagcactgcactgggactccgcatacttgggtcctagttgtaagtcagttggatgaatttggcaagtcatccattttgtttgtgtttcaatgttctcagtgaactctgctggcgctaaaacactcttcaagtttaatatgtgagtgcagaattcattaggctgaaagataacacaatagataattgacatagtctttccacttgtggggaattatagatattcagaatatattacaagtgctatatgttagtagagctgtttaaataatgaagctatctttcttcatcttgaagctttagttcactttttcccactaatcatggaaaaatgtataactttctttgaaagattagtgttctactcataaattagtaaacttcccccagaaagaaaataaatactttggtctagaactataaatgattggggaaaaaaaccacaaatatataagttaaagttttgttgtatatctttggtactatttcacattttaccaagcactctaaaaatactataattcagtctgttcacattaaaacactccagaagcagtaaaacagagtgacatttagaattattcatttgtttactcactcatttaagcaataattttcacttttaataatgctctttcctttactaaatatgtattgcctaatatggtccatattttggctttaagttgtttattgtctactgaagatttaaaaaaacaaacaaacttgtaaataaacaaatgtattgagaaccacagaagcagtggataaagcatacactgggtcctctgagagcataaagtgttttcaggggaatgggtagaggggagtccaagaagggctaaaagagctaagctttgaggattgactgaaattagccaagttctaggcagttttatcactgaaaatttgaaatcccatgtattgaacatttcactggatgattccatggcaagttaggacattgcatgctgggtacattaaatagatttattatttttatttgagaatttaatccatccactttgcctcattaatctctttccctatcagctttggtctttgtactaaaataaaaacgcaattcgtatttacctatttacctatatcttctgtcttcaccatctcccattttccttacctatacgcaaatatgattttctgtggagttgatagaaatattgttcagataactaaaagaaattatttttaaaaaatgaagacttagtaattctgaaagtttaaaaaatatcccagttggtactctatctagaactgcagaaattggtcagctaacatggagactggtctttaagtactgggcctcttctgtgggatatatcaagtccattcaacgtctaactaaggttaaacagaaaatgaccatgtaaaaaatgtgtgatttttctttcccttaggaagtgaatacctatagatttgtcaatggttatgagtcatttattgtaacaggtaaaataattggcatttatcttgactgtccaaatagttgattaaataggaaaataaaatggaggtaaaaaatttaatcttatattaggttttttttttttggtgaacatttttctttttttttattattatactttaagttttagggtacatgtgcacattgtgcaggttagttacatacgtatacatgtgcatgctggtgcgctgcacccactaactcgtcatctagcgttaggtatatctcccaatgctatcccttccccctcccccgaccccacaacagtccccagagtgtgatattccccttcctgtgtccatgtgatctcatcgttcaattcccacctatgagtgagaatatgcggtgtttggttttttgttcttgcgatagtttactgagaatgatgatttccaatttcatccatgtccctacaaaggacatgaactcatcattttttatggtgcatagtattccatggtgtatatgtgccacattttcttaatccagtctatcattgttggacatttgggttggttccaagtctttgctactgtgaataatgccacaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctccccagcacctgttgtttcctgactttttaatgattgccattctaactggtgtgagatggtatctcattgtggttttgatttgtatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtagttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataagttgtaaggaaggcatccagtttcagctttctacatatggctagccagttttcccagcaccatttattaaatagggaatcctttccccattgcttgtttttctcaggtttgtcaaagatcagatagttatagatatgcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgtaggctcttttttggttccatatgaactttaaagtagttttttccaattctgtgaagaaagtcattggtagcttgatggggatggcattgaatctgtaaattaccttgggtagtatggccattttcaggatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttggtctgagacaatggggttttctagatatacaatcatgtcatctgcaaacagggacaatttcacttcctcttttcctaattgaataccatttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacggcccatcaatacctaatttattgagagtttttagcatgacgggttgctgaatttcgttgaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcctggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagatcctgttattggtctattcagagattcaacttcttcctggtttagtcttgggagagtgtatgtgttgaggaatttatccatttcttctagattttctagtttatttgtgtagaggtgtttgtagtattctctgatggtagtttgtatttctgtgggatcggtggtgatatcccctttatcattttttattgcgtctatttgattcttctctctttttttctttattagtcttgctagtggtctatcaattttgttgatcctttcaaaaaaccagctcctggattcattaattttttgaagggttttttgtatctctatttccttcagttctgctctgattttagttatttcttgccttctgctagcttttgaatatgtttgctcttgcttttctagttcttttaattgtgatgttagggtgtcaattttggatctttcctgctttctcttaaatttccctctacacactgctttgaatgcgtcccagagattctggtatgttgtgtctttgttctcgttggtttcaaagaacatctttattactgccttcatttcgttatgtacccagtagtcattcaggagcaggttgttcagtttccatgtagttgagcggttttgagtgagattcttaatcctgagttctagtttgattgtactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctttagatgtctattaggtcggcttggtgcagagctgagttcaattcctgggtatccttgttgactttctgtctgttgatctgtctaatgttgacagtggggtgttaaagtctcccattattaatgtgtgggagtctaagtctctttgtaggtcactcaggacttgctttatgaatcttggtactcctgtattgggtgcatatatatttaggatagttagctccctttaccattatgtaatggccttctttgtctcttttgatctttgttggtttaaagtctgttttatcagagactaggattgcaatccctgcctttttttgttttccatttgcttggtagatcttcctccatccttttattttgagcctatgtgtgtctctgcatatgagatgggtttcctgaatacagcacactgatgggtcttgactctatccaatttgccagtctgtgtcttttaattggagcatttagtccattgacatttaaagttaatattgttatgtgtgaatttgatcctatcattatgatgttagctggttattttgctcgttagttgatgcagtttcttcctagtctcgatggtctttacgttttggcatgattttgcagtggctggtactggttgttcctttccatatttagctcttccttcaggagctcttttagggcaggcctggtggtgacaaaatctctcagcatctgcttgtctgtaaagtattttatttctcgttcgcttatgaagcttagtttggctggatatgaaattctgggttgaaaattcttttctttaagaatgttgaatattggcccctactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggccttctctgtatttcctgaatctgaacgttggcctgccttgctagattggggaagttctcctggataatatcctgcagtgtgttttccaacttggttccattctccccatcactttcaggtacaccaatcagacgtagatttggtcttttcacatagtcccatatttcttggaggctttgctcacttctttttattcttttttctctaaacttcccttctcgcttcatttcattcatttcatcttccattgctgataccctttcttccagttgatcgcatcggctcctgaggcttctgcattcttcatgtagttctcaagccttggttttcagctccatcagctcctttaagcacttctctgtattggttattctagttatacattcttctaaatttttttcaaagttttcaacttctttgcgtttggtttgaatgtcctcctgtagctcagagtaatttgatcgtctgaagccttcttctctcagcttgtcaaagtcattctccatccagctttgttccattgctggtgaggaactgcgttcctttggaggaggagaggcgctctggtttttagagtttccagtttttctgttctgttttttccccatctttgtggttttatctactgttggtctttgatgatggtgatgtacagatgggtttttggtgtggatgtcctttctgtttgttagttttccttctaacagacaggaccctcagctgcaggtctgttggaataccctgccgtgtgaggtgtcagtgtgcccctgctggggggttgcctcccagttaggctgctcgggggtcaggggtcagggacccacttgagaaggcagtctgcccgttctctgcccgttctcagatctccagctgcgtgctgggagagccactgctctcttcaaagctgtcagacagggacatttaagtctgcagaggttactgctgtctttttgtttgtctgtgccctgcccccagaggtggagcctacagaggcagtcaggcctccttgagctgtggtgggctccacccagttcgagcttcccggctgctttgttttcctaagaaagcctgggcaatggcgggcgcccctcccccagccttgctgccgccttacagtttgatctcagactgctgtgctagcaatcagcgagattccgtgggcgtaggaccctccgagccaggtgtgggatataatcttgtggtgcgccgttttttaagcctgtcggaaaagcgcagtattcgggtgggagtgacccgattttccaggtgctgtccgtcacccctttctttgactcggaaggggaactccctgaccccttgcacttcccgactgaggcaatgcctccccctgctttggcttgcgcacggtgcgcgcacccactgacctgcgcccactgtctggcattccctagtgagatgaacccggtacctcagatggaaatgcagaaatcacccgtcttctgcgtcgctcacgctgggagctgtagactggagctgttcctattcggccatcttggctcatattaggtttgttctcaatgcatgacctttgttagactatttatccttccggagaccattttttgtctatcttaaaaattagggtattagaatggctgatttcaaaagtcttttacattcttaaactctatgattctatgcatctatttttgttatatcccaaacatcaggtattctgtcacagacagggtacaaggataaatggaacaatgatatgatctgaatttatcatatttcttttctttagttggccattccatggaaaattatttccacttcataaattggaggtgagaaagaaaaaaacactaatattacctttatcatttttaatcaaaagaatgcatgaaatatgtatttggctgctattcttgctttccatcaaagtgaatacgaaaatatgtaataacacgtggaaatatattagggaagcttttaatcaggaagcaaagaaaccgttccagtggaaacattttggcctggaggatgtcctttgatctaagaagtttaagctgttggtgttttaaacaccttatagtagggtcacatagccaattcatgttaaataattcatttgcttaaaccttttctaaaattgtgaaaaaaaacccttgagagttaattaacaataagatgtattattgggatgaccaaataaaccatctctggcttcttcactggtgatcttctatacaagtactccagcaaagtgaaaactacataatgcaagaggcaataaagactaagcaaatgagttcataagttgctgagtgaatggaaaattttctgcccttattatggcactgtacttgtttgttcccagatactcaagtcaaattataaaagtcatcatccttgatgtatttttctcacttgccacatcaaattcattaagtcttattaggtctactttaaaacgtactgtgaatttatccacttctctacaacttctgattttcattgaccatacatttaagatcactacccattactccgaaagtcattccttataacatttccctgataaacttttatagggtactcaattccttttaacttatttagttgctatttttttgtctctgctcactggagtctccatgaattcggggatttttttctatattgttcactgctataactccatgtcctagaaaagggtctggtactgagtaggcactcaataagtatttcttgcatgaatgaatgagtttacactactcctatgtagtccaagccagcttgggttatttcagtagtctccagctgatctgatacagctaatatccttttctttacaacattatttttgttcacacagcagccagtgatcttttaaaatcctatcatgctaaagcagttcaaaggcttactattgcccttaggacaaatccaaagtcacatgagcagcctaaaatgttctacgtgtgttcatgtgatttgcacaaaactccatatagtttagtggggtcctgctcttcctttactatccagtttaacatagtctctttctccagtcattctctgcctcactgctctatgcttgccattcatttacgaaatctgaaatattgacttgcttttgtatctcccatctccttccatcactagtgtaagctccatgatatggccctatcttcaccattgtccctcagtaatttcatttgtactattatctccacaaacactcacaacatcccagccaacacagatgttattattcttattttaccttgaaacaacagacctaagttaggtgataattgcctgtttcctgtctgtcccctcacaagaccaagtctcttcaaggcacttttacgtatcttgtccatcatatacattattgtatcctcagaggaagtcctatatatgttgtatgttaatgactcaagaaatacatactaataaaagaagagaaaatagaaaaaaatacacactaaaagatttaataaataaaagaataagggtacggaatagacatctgaaatcccagtccctagacctgtgcaacataccatatccagaacaaaaggcttagcatcataaattttaaaagtgcctctctaatattaaagatgaacctttgtcgttaagcctttgccactaactgaaagagcaaattattagttgtagaaaattgagagtctgaaaaagtactgagctcatactgttctggaacagaacaaggcagaagttgtagtgctgagaacgtttttgttttctttctttcttccttccttattttctcattgaatctctgtctctctacgcatctgccttctctgtctgtgttttccattctctgcctttctctcttgtcctctggctctggctctggctcactggctctgtctttgttttttcatccaggcctctttcacactgctgtatctttctttgtataggactttatggttgccttggggttgagaagcccctggaaggaagaaaagaaacgcaaagtacagtggtgacatttagcaacacacaaatggaaggtataaggatgtctgtttgaagtaaaaacatcctgtgcctgcccacctcacacaaactcctgaacttcttcagattattcccagttggagaggtctttgtttaataggcaaatttgaacatctctgattattatatgagtggcaattcaattatttttaatagatggggttgggaaagggaggagtggttagcaccccatatctctagggtctcctctttccatccctaagtggtccaaaagtacaagacagaagcaagtgatagtaaggaagcatgaaggtcaaggtgtccctattaacacacaaccttagcacaatcacatgtctcagcctaaaatataaaaccatcttttcatttaattttagtatttgttaaattccaaactttcaaaatattccacatcttacaaaagtagtctaggaaacttataccaatacataagtaatattattgctttaataaacttgactatcatttccttattaaactcacatcttctcactttacttttagtcatagatttacaaatgccttctatgaacctgaaagaacaaattgacacagggatttgtaatgatttcatatattgtgtgtttttaatgtaaaggaattttaactcaatggttacttggaggtcctcatacctttccagtcccaggatttattgccattcattgtttgcaggattggggtccttccaaaatgttcagagttctctggatgtaactctccgtacttccaggaaaatccaatgagggtctatgacataaaatctctattagatggtagagaaaaaaacagccttaacatttgttacaagacagagggagtaggcttcagttgttcagaaatggttttcaatcagggaatctcgttcataaagaaactagatagattaaacttcagtgtagtgaattgcttttttccatcatgcaatcataattcagctcatagcctcctaccttgacaagatttttagtaatctcattcatcatttctaggaaagtaaagaaaacatcagtaacttagatcattagaatgaatgcacactgtacactagccccaaaagaatttgactaaatcaaaaacaaccaaattgacttgtatggaaaagaactcagaacaataaagtattagcaatttgccaacctaccattcaggtattatggaaataagccagcccaaatcactcaaggaacagaaatgaagccaacttactgtgtttgaatgtcagagggattttcaggtaatagcttgtaaaatgaagggcacctttagagttcgaatgtaaatttcaacagcctaaatctttccttcagagaataacaatcttcaggaattccaaaagaatatattcctaataaaattataagcctcttttctacaaatgagttctgctatttctgtcatgttcaattttctttgtttttgtttttcttcaaaagtcagcttcaaatcttcttgtgaaattagatgggatttaaattgtaaatacattatcgggaaaagaattaatattttgagtatctgccatgcactgggtgcttcatcacttaatctctataacacccctacaactatccacattttataaacaccttaactgaagcttggagatgttatgagattttcaaatgtacacagcttctaagtgacagatctgaagctatcgcttaatacccatgtgactcctaagcatgcagtctttatactaaacaactctgattttgttgtagagctgtattataaatataatatcacatttaatataattcattatgtattattatatatgttatataatgtattcattcacctaacaaaacgatttgtgatttcaataagattctctgacattactgattatatgagtcaggaccaaagtcgtgtgtcatgttcaagtatgacccatctgatttgttttggtgcaccctatcacaacaaaaacttgtcctgagttagtaattccctgccagggctagtatcactgtcaccatggagacaggcagccagctggcttctcctttctttttttaatttttttttgcttgtggtcctactttcccattgttacccattgtgtccactgccttacaaccatgccatcagccatgttagagagcagaataaaaagagcattatagttgtgcagaatttctgatatcaactgcatattgcactttatgccgcagaagcaccagtttgtgtgttctaataaatatatatatattggcatccaggcttttttttttttttaatttaccacataccttccacctggaatccctccgtcttccccatccttccttacctggcaggctccttttaggctgttaacctactctctttcaagactctttctgcagtatatcctttgtatatacgattttccttcaacacactatcatgtaatgatctgtctagaggtctgtttcagccagtatgttgggaacttcttgaaggcagggttggggtttaataattcttcggtgctggtatataataagtatgcaataaagttgttttaaataaagtaataactttatatttccttcagataaatctaaatataggtaatagtgtaaattatgtgaaatttacagggaaataattttatatatagtataataagttcctcaataactcaagactataaaagactataattatacacccactactattcaccgaggtatatgacagggtagaaagcagctgagactcaacaggcaccattctatgaagatatcgatctatcttagtatttagaaacaattgatgtatatttatggacactcatattttaaaagtttggtcatttaactgactccttctttgtccttgtagcttattttcaaagctacaaaataccaccgtaccttaaaattattttttcaagaatggccctcaaacaaggttggggaatagatctttccaagtatatatccctttgacccaccgagaaagtagaaacctagagtagaggcttcactcctctgtccctcgtcagctatagtcatggactcctgatagatgacccttctgttaagcataggcaatctgagaggaactttaagaattgcaacttgggaacctgcattgaaatccaattccacttattagcagctgagaagcctaaactctggttaacctcagttttaaaaactataaaatgagactaatatgcacatcccaaagagcttgtgaagattaaatgacttaatgcaggaaaaccatttggatcattcttggcacatagtaaacactatgtaattgttagctagggaaagaaagataatgtggatcaaccttctttttagtgttcccagccttattttttctttgctaatgaaaaaataaacttccatgttatattatgtttaagtcaatctttacttccataatgaaagaaattaacaatattatgaatggatatttttctagacatacggcctgtaagttatgaaacagtatgtttggcttctatacatacttaaacatgctcagtaatcaacctgtatgggtgtaacagctacaagaaccatatatgatgaacagagctccatgtggcatgagggcctaggcccgaaatgtggtgtttgtgcaactctaattactttgcttgctaaaccatattacaccatagataactaattttggtgaattctaaaaaaggaaaactttcagtaaggcaggtctgctgacatttgataatatctagttgtcagtgagattttagaagttacacatgcccatgttgcatgttgatttctggataaaaaacacacagcagaagtttatggaatgaaaagtagtgataaaatgttttgcaagcaatttatatgggatcatatgatagctaatgttgagagttcatggcctggatggtattggttaattaaagaaatcacttgggataaagaagtacttggaaatgattgtgggttttctttctttctctctctctctcttttttttttttttttttttttgcagttcataataagctcagacagagacttgagagaagctttcaaagttctataaaactgaatatattttctctttggctcattatttacttaactacaggtcatttattatggtagggaaaaatgtatctgttcaatatcaaaggcctatgaatttcaaccttcttttattgcctatattatatcatttgagaatttttagttaaatggaaaaaatagtgattaattttatattaagattccccctcagcttctgagattttagtttccataacttagtgtgtatattaaaaataaattgcttaatttgagtacatgtacattttccattaatgaagtccagtagatatatttaacattgcatatccatctatggaaaataatatattcagaaatggctctgaagataactgaatccgcgaaggtgtcttcttaaagatctcccttaataatagctttctttttgcataataatatgatttatacttggcttggtattatgaattatgcatgtaggggacagatctagctttttagttgtggatattagatttgttaatacttttttttttccaattcctacttctacattgtgtaggacaaagcccagccattccacctcccttaccgacagaacaagcttccagacccactccggcatcacctgcccttgaaggcaagtacttttttttttcttaaagatctctattgtagataaaatagaatgtagaggaacagcaacaacaaaaatagtcacaaagaaacagcaaaatccaatattttcttaaatacttttagtatgtctaaactatacttttcctaaaattgcaatttgcttcttttagaaaaccaaaaatgtccccttaagattctatattggtgaccctcagcttccagaaggatgcccactctagcactttgggaatcaagcaaaaaaatatagggacaaatagataaggctatgccttgcaactctgggagttttaccacaacttgatcaatttagtctctgaagaggctggtgccagatttgctgggtttgaatctgagctccaccttttcctagctttgtaaatttggaaagttatttaaattaactcttcatgagttttgccatctctaagatgatataagcagagcactgatctcctagcgttattgtgaggattgaaatatatatatacacacacactcacacacacacaaatactgttttatgtatatgtatagtttataagtactatatacaactggtggttaatactactaataattcttgaaaatatgatgtctcaagatcagctttgtaataaattttgctggaacgttaaagtcatttctttaagtcttcattcatttcttaaacttttattaaatcccaaacatgggatcatttcagatattgtccaaaatactggggattcagagatgaatagaaaacagttccttctctgtcaagactcaatttgcctatataaaacaccagtaattaaagctaaatcattaattttttacaacagtacaaatggaggtcttcctcagatcacagccaccctagaaaggggtagaaacacctagctcagtcccaaattggaaaagatcttctgtgtgcaatgtggacactccagcctgcttgttcaagatcttcccactcagctcaacaactgcccattggctttggccatcccttgagactaagtgatgacactcatgaggattcatccaggaagaggttactattgtatatcacttacctagagagtaaacaagtgatttacaaacaaccagtccaaaaaaaaaaaaacagaaagaaaatagaccaaaaaaatcagaattacatttattttggcatttggactataatagttcacatgacttaagagaatttgacacaaaactatctcactcgccaaaatgttcattggacaagacaacccctataaataatagcgttgccttaatttttcatgggattctaattctgttgttgtttccagatggacataaagcaacgaattcagatttcccaacttgagggagactttgatagtcagattattcaagtgtttgatgccaagttatctcctagcagaggctcataaaacaccaagtagcaaatattttgcttagcaatctgtcacttggaaaaggatgtgtcatttgttaagtaggacgcttaggttctgttattgtatttatttatttatttatttatttatttattatttattttttttttttcttgagacggagtcttgctctgctgcccaggctggaagtgcagtggcaccatctcggctcactgcaagctccgcctcccgggttcacgccattctcctgcctcagcctcccgagtagctgggactacaggcgcccgccaccatgcctggctaattttttgtatttttagtagagacggggtttcaccgtgttagccaggatggtctcaatctcctgacctcgtgatccaccctccttggcctcccaaagtgctgggattacaggcatgagctcctgttattttatttaaagagcaatgtaatttgacagttcatcccagaacctagtaataggctgtggtgaataaaataacaaggtttgaggatcacaagcctttgtcagtgtcttctctgaaagcttgaaggctgctaaccctgagcagctcggggagtctatattatcaggcaatgctgagatcatgggctttgtcagggcttgcagatgtgctgcctatgacttcgttaacataattgattaggagctaggacatatttagtattaatcaggctgtttttagtgaggctgattatgccagtcctcttgatgcactattttagtctggaacttccttagaaccaagctgcaaaaagaaaaaaaaaaaaaggctttatgtaaaaaggaggaactttcatgtggcactaaagtatgctgttatatttgaggaatacaattatatcaggtcaaaatgtaggagaatgtacatatttcaattttaatgttttttaaaagtagagctcatatagagactagattattaaatttgttcacaggagactagaaacaaataaaacttcattagtagaaatctaaaaaaaatgtggctctgtatgggtaaaagaatactacaaatctgtaaagccaatactacacgtctttaaagcccataaaagccttctttgtgctttcatagcatttaagaaacaaaacttgcacagtacttactttgttctgggaagtatctgtgtacttcttgtctcagtccacttatttagtgccttgaaattggtcttgcctttcttggatttctgtgttgtccccacattgcgtgctttgtctgccataatgaagcttttattactttgaattttttgatacaaagggactaattatatattaaatcatttatttcctttgactcttattttatgttttagaatttgtttggccaggaaaaattggctacaataggttttgaaaagatcttgtacaataaccacttcacatcatcattgtggtcattgttgtaaatttgtatttaattatggatataactgaaactaatttaaaatgaacctaatgtaaatataatattaattctcatcttttaagcaattttgaattcccgtgtctattgggagctcttactagggctgaaacgcctacaagttcaaagggacactgtagttatccatttctttcaaaaattgggctgacttatgtgaggtttttcctcaaatcaaatagtatcttataatattaacattataggtgattttagctcttagcatgaaaggtcctttatcatcaaatgtttttcagcatctctgctaacctgttacctcaagaactgtatttctcagaatcctcagcggttaaacagaacaacttcaggcaatgttgcccgccctcttcccgattaccaaggaaggcagaaaagttgtttcataaaatccttgtataagcaaaattaccatatatgattccattcatctttaatcaacaataccagataatttctttcccactactttcacccacatgtaattattgggcatttagtataaaattaccaggactcctctgttgtggcaaagatgtggaaggaagaagttaagttatacttaaattacttttaatatttcattaaacagctgcaatttacatgaatgaagtcgaatagagaaaggtgaattactatcaagtaccctatatcttgttgaataaatatataactagtacttagtcttgcaattataaataatattataaatgctaacacttgtatgtgaacaagagaactctagagagaagaccagagtcctgcccaatctcagctttgatactaatgagttgcatggtctttgacaaatcaattgacttcttagggcctcaatttcttcacctatgaaccaaacttaaatagtctctaaagtccctctatgcttttatacccaaagatttcacacctgtatttttcaggctggtagattggtaataaactgccagaagaacagagtgaaccctacatagctttgcccagtggttaaatagcaactgtagatatgatagagatgttaaagttgttgggacaatggataatactatgaagcattatttactgaaacacaaaaataagttacataaatcataaaggctgtaaaaggaggaagatgagatataaatgaggcaaggttatcaagtgaaacctcaagtctttcattgagccataaagagtaagttagttgaatttgtatagatacagaggagaaaagaacattatataaaatttattataggataattttttaccataggatgcatctgaagacaatattctacaggagctagtaaggttttatttacaattctattaaaccaagaactttattaccttagctcctcagtgagatatatcctgagaagtaaaaaaataaaataaaataataaaatagaaatttggcctcaatttttatttcattaactccatgacacaatagattttattgaacttcaggtcaatataatatttttctttgttttgtggagaaataaagtcatatcttttggtgatttttaataggattgccctttagttacaaattatgataaaatatataaaccaaactacttttaccacctatttaacttaaagagttgctaataacaatatagcacattttctagcacagttagatactcaaccattggttgctgttaatattttttacatcaggaaatttcttatacatataaaaaccattaattttatggtagctctttattggtatccacagaagctagtaaggtgattgctttcatgacattggtcagtatacataaaactctaatataatttttcaatacaggactggaaccatatcttggaatgttttgtatacacagctaaagcttttacatgtcctgatagactgtgtggtactgcttaagcaattgagcagagagtagtatgattaactttgttttcaagattatgtgtcaactatagaaaggatgaattggtgagtggtgagcttaagagttgggagtataagacaaatttaggagaatactgcccatgggaaaacttatgctacttttcttttaaacaatcacattttactctcaaaacaactacaagtagtgaatatgatttatgtcattttaaagagaagatcggagaaatcaagtaaattgcctaagataacacagctctaaaaatggtataactggaattgaaagccaggtgtctcctaccaaggctcagtctatttccattatcctaaaatggcaattaagtgttagagctgagtataattgctaaagttcttatctgatttggttaattgaatggcattaagaataagaacaggttttgagagataataatgagttacatttggggcttgctgggtgtattggggtccctggaacacttgcatgagtgattaaaagagtttaatgaatatagtacttttaaaggtttgcagggttatggtggagccccaagagctagccaaagtaggaagcctttatcactcctatgcctgaagaggcaagagaatagaatggtttagacatccagaaagccttatagctttagggaagagatgtccaatcagaacatctgaaggtcatgtccttcagtaggggaccacaaccaccaaccaacactctgtaaaatgatgtatgtaaaattctcagtgagcctgggaggaaactagagaatagatgcccagatctctctctttgtcttactgtattatctctggatgttgctctcataggccaaaacagcccacattcagaggacatggggcttgattaatgtaacccataagggtcggggtggagagggacctggagagaacatggagaccacatgtcaggcaggatgctgagcttgatccacataagtggtaatctgcagtggacaactgaatatatgagtcaggagtttacaaatgagggagatatagatattgaagtcataagttagccctggcacagcatttcttggaatatgttatgagaaactctagttctatgatattatttgttaaaaacagttttcatgacaaaacacttttgggcagcttaatatattatattttttcttttgcatttacaatgcacacacacatatatcaaaggatccaaaaattctgtatgttaaggaaatctgtttaacttttttaaaccagtgttcccctttttttttaatcacagaaatatttctatttctgataatactcatcaatttcctaaagagcaaatgatctcaaaaacactgtcatacaaaggttagcttcaaacataactaaagagcaggtcagccatgaatctgaggctgtttagaacacagcatagacccaagaaaggaaatgtagaacacattgatttagtcagcattctccagagaaacaaaaccagtaggagacatctatctctctatctatttattgagaaaatattatttatgttaaaggattggctgatgcagctgcaggggctagtaagtccaaaatctgcagggcatgcaggcagtctgagggcccagggaatagtttgttttgcagtcttgagtctgaaggcagtctgaaagaagacttccttcctccttgggggacttcagtcttttctctttaaggccttcaactgattagacaaggcccatcccacattacagagggtaatctgctttattcaaagtctatgatttaaatgtgaattacatctaaaaactacctttgtagaaacatctagacttatctttgatcaaataagtgttaccaaagcctacccgaattgatgcataaaattagctatcacaaatatcattagaatacaaactgataaagccaaagatgagagaatatgaaagagaaaagggtataacaggccccagtgctccagagagatggataacacaaagactggccaggaaaatttacatttgtcaattagaaaattatgctcatctactcttgactctaaattttctctctgctacatataaatgaggatgcagtagtcatgagtttgaactaaaggatcaactgtaagatttttattagttcccttaatctctgaaagactgggtttcctcatctgccagatgatatttactagtaggatttagtagtgctttcggaagaaaaaagaattttggagagaaagctgtgatggcggaggcttgggaaactagattacgaatggaatctttagaatattttgttttggatcatatgatgttgactatttgagatatttcaataaagatttaaacatattttcaattttttcttagaattttagactcttgttttttatttttttaactgaaacactgtactagggcttggcctgaggtaacataggtatctttcagttaatatgttaaaacaagtataattcagcttagtgtcatggaaaagtaggtaagtattaataactgttgagtaaattttcttaaaaacacaaaaacaaataggtgacaaagcatcaaaagaaaaaaaaaggaaaatgaaaagggaaagaaatgagagttccccatgaattatgagctataaatatattttaatagacaagaaacttgtatctctaaacttacaactttcttcttttgttatattggttttgatttcctgttattgattattaaaaagaccttttgtgaaaacaattaactttttctcactgtcctatccataagaggaagcagttttgtttttcttaccctctacagctgccaagatagataggggcatctgtctgtcttgactgttcagtatcaagaggtatttactctgaagaccaggaatgttcccccatgatgcgggaaacaggaaaagggccttctgttgagatcagggccagtttcctgcttcacagccctttcctaactgttaatgctagtataaaagaaatggttttttacttgcattttgacttgtaaaagaccaaagaagaaggatgacacagtttgtgaatttgagcgaatttgatctaatctctttcttgttatggaattctaagtgaaacttccttgtgtcagcaaattttctcataaaacattttataaaaaagaatgtttcctccaatgctcttgcttacaagtaccaatttttccttataaaacatttgtttgcgatctggtctgtttgacataaatatttcttcctattataccagcttgttacaattccaaatggcgtcatcctttccctctctagaatgagtgagaaaagtggctgcatcttcaagaccaagtgtattttacatagatggagtaaacagtcttggaaattgctcatttaataaaggataaggaatgctgtaatccccaacactttgggaggccaaggtgggtggatcgcttcagctcaggagttaaagaccagcctgggcaacatggcgaaaccctatctctacaaaaaatataaaaattagccgggcatggaggcatatgcctgtagtcccagctactcaggaagatgaggtgggaggatcacttgagcctgggaaacagaggttgcagtgagccgagatcccacgactgcactctagcctgggtaacaaagtgaggccctgtctcaaaaaaagaaaaaaaaaatgcctgcttcaattaaatgagaattttatataaaaacatttgtaatttactagaataaaacttatattaagaagtagaagacataatgtgttactagtttgttttaatccataagagacggtaaaatctctcatgtagtgcatcagttcaaataagcctgaactcagcatattgaaatgattacaacttaaaaagttgtggtctttatatgggcacttgcttctattttaagaatggatatccattaggcaaatttaaaaaattgaaaggcttcatttgaaaatcagacttacacatgtgtcccatatactagtaattttttattttaaagtcaaatcatattttaaaatagctattgggtcttattaatttatttaataaatcaagtccaaaactgttataaaaatagcagtatctttgaaatagtactttaaggtaatgtatgttttggttttgagttgcaaccaactttttcttgtactgataatttagtcatgaaaagaaaaagctcaattttctaacgtttctaggcatccttgacattttaaatgtaatgaaatattcttgcaatccatttccaattacagaaaaatgtagaaaaacatatagataaaatatggaaacagtaattttatgtaagtaacatgatattgtaaatgaaaagttgttagaaaagaaacttatatttatgttttctttactatttctacaagacactttaggaaagcttacaataaaacatcttgagtaagcaatgattctgcataaaaatttaaaagagttttttaggaatttccaaaagtcagcaacaccaaacaaacaaacaaaagcatttgtaatttatggagttatctaaagagataagtgcatgtgaattgagcttctcctctgagtccaagtcagtaaactttgagcatttgccttctgaaatgcaaaagcactgagtggaaaaataaaatatagcatctccttttccttctcccgtctcgctcctcttttcttctctctttgtttctctaacacacacagacacacacacacacacacacacacacacacacagtggttgccttttttgtttcactctatatagaaagtgagaaagaacagacatggcacccctcagctatataaacacaacccattttaaataaatgcaatcactcatgtaaaaagctttatcattttcaaaaggtttgggagaaatctaccttatccattttaaatgctaagtttaattaacatagaaacatttttgcaatttgaaatgtattgaataatctttctcgttacctttccttttgcatactaaattcagaaatatgaaaaaaaaatcgtgaagtcaaataactttggttgtgagacagttgaaagataagtttggcattgatgaagtaaaaggtggcacttcttttctgcccatgactcaatcagcttgaaagtttttcacagagtatatctatctcaagcttcattatccatgttgcaggagagaaacagggtttgtgatcatctttagatttaaattttgttctgtcacttacatcagcattcctcaacctttttggcaccaggaacctggttcctggaagacaattttcccggggacaggggtgagaggagggatggtttcaggatgaaactgttccacttcagatcatcaggcattagattctcataaggagcatgcaacctagatcccttgcatgtgcagttcacaagagggtttgctctcctatgagaatctaatgcagctgctgatccgacaggaggcggagctcaggcagtaatgctcatttgcactctgctcacctcctgctgtgcaccctagttcctaacagggcactgaccaatactggcttgcagcacaggggttggggaccctgactcatatgacctgtgaagttggccacattcgtcatctttcctgagcccatttcctcacaggttataagatgtgtagacttttacctgagaatgaagtatattctagtgcatacaagctcatgtgctttattctaatagtataatttcttattgtcttgaaattactgtggttccaacccaaactaaaacatatttttttaccttgtttgaccatgtaaaataaagtgattattaaaatcctttcatcacacctttcggaggctcaaagggaaaaaggtagtatgatatcattttttaacatttttccgtcagttattgagtacaggtggtatttggttacatgagtaaattttttagtggtgatttgtgagattttggtgcacccatcatccgagaagtatacactgcaccgtatttgtagtcttttgtccctcgtccccctcccactcttcccccaagtccgcaaagttcattgtatcattcttatgtctttgtgtccttatagcttagctcccacaaattagtgagaacacccgatgtttggttttccattcctgagttacttcacttagaataatagtctccaatctcatccaggtcactgcaaatgctgttaattcattcctttttatggctgagttgtattccatcatgtatatatatacatacacacacacacacacacacacaccacagtttctttatccactcattgactgatgggcatttggtttggtttcacaattttgtaattgtgaattgtgctgctataaacatgcgtgttcaatctttttcaaataatggcttcttttcctttgggtagatactcagtagtgggattgctggatcaaatggtagttctacttttagttcttcaaagaatctccacactgttttccatagtggctgtactagtttacatccccaccagcagtgtagaagtgttccctaatcaccacatacatgccactactgtttttttattttttttattatggccattcttgcaggagtaaggtggtgtttcattgtggttttgatttgcatttccttgatcattagtgatgttgagcattttttcatatttttgttggccatttgtatatcttcttttgagaattgtctattcatgtccttagcccactttttgatgagattgtctgttttttttcttactgtcttgtttgagtttgttgtagattctggatattagtcctttgtcagatgtatagattgtgaagattttctcccactctgtgggttgtctgtttactctgccaactgttccttttgctgtgcaaaagctctttagtttaattaggtcccagctatttatctttgtttttattgcatttgcttttgggttattggtcatgaaatctttgcctaaggcaatgaatgtctagaagggtttttccaatgttatcttctagaatttttatagtttcatgtcttaggtttaaatcctttatccatcttgggttgatttctgtataaggtgagagatgaagatccagtttcattctcctacatgtggctagccaattatcccagcaccatttgttgaaaagggtgtcctttccctactttatgtttttgtttgctttttcgaagatcagttggctgtaagtattcgggtttatttatgggttctctattttgttccattgatctatgtgcctatttttataacagtaccatgatattttggtgactatggccttatagtatagttggaaatcaggtagtgtgatgcgtccagatttgtactttttgcttagtcttgttttggttatgtgggctcttttgtggttccatatgaattttagaattgttttttctaactctgcgaagaattacggtggtattttgttggggattgcattgaatttgcagattgcttttggcagtatggtcattttcccaagattgattatatccatccataagcgtgggatgtgtttccatttgtttgtgttgtctataattgctttcagcagtgttttgtagttttccttgtagaggtctttcgactccttggttaggcatattcctaactatcttacgttttttttttgcaactattgtaaaaggaattgagctcttgatttaattttctgcttggttgttgctgatgtatagaagaactgctgatatgtgtacattaatcttgtatctggaaactgtgctgaattattttatcagttctaggagctttctagaggagtctttaggtttttcaaggtaaaagatcatatcgtcagcaaatagtgacagtttgacttcctctttcccgatctgaatgctctttatttctttctcttgtctaattgctctggctaggacttctagtactatgttgaagagaagtggtgagagtggacatccttgtcttgttccagctctcagagggaatgctttcaacttttacccattcaatatatgttggctgtgggtttttcatggaaagcttttattacattaaggtatgtcccttgaatgctgattttgctgagagttttaatcacaaagtgatgctggattttgtctcatgctttttctgcatcaattgagatgatcatatgattttcgtttttaattctgtttatgtggtgtattgaatttattgacttgcatatgttaaaccatcccttcatccctggtatgaaacccacttgatcatggtggattatctttttgatatgttattggattccgttagctagtattttgttaaggattttaacatttatgttcatcaaggatattggtctgtagttttcatttttcattatgtcctttcctgattttggtattcaggtaatactgacttcataaaatgaattggggagaattccttatttctctatcttgtggaatagtgtcaaaagtattggcaccaattcttcttggaatgtctggtagaattctgtgaatccaactggtcctggacttttttttgttggtaatttttaaattatgatttcagtcttgctgcttgttattggtctgcttagggtatctaattcttcctgatttaaactaggagggatgtatttttctaggaatttatccatctcttctaggtttttagtttatgtgggtaaaggtgttcataatagccttgagtgatcttttttatttcagtggtgtcaattgtaatgtctcctgtttcatttcttagtgaagttatttgtattttctctcttctcttcttggttaatcttgctaatggtctatcaattttatttatcttttcaaagaaccagctttttatttcatttatcttttgtatttttttgttgttgtttcaattttatttatttctgctctgatcttggttatttctttcttctgctgggtttgggtttggtttgctcttgtttctctagttctatgaggtgtgaccttagaagtcaatttttgcttttttagtctttttgatgtaggcatttagggccatgaactttcctctcagcactgcctttgctgaatcccagaggttttggtaggttggttattattgtcattcagttcaaataatttttaaatttccttcttgattttgtttttgagccagtgctcatttgggagcaggttatttaatttccatgtatttgcatggttttgaagattccttttgcagttgatttccagttttattccactgtggtctgagagagtgcttgatataatttcagttttcttaaatttattgaggctcattttatggcctaccatatgatctatcttggagaaagttccgtgcactattgaatagaatgtgtattctgtggttgttggatgaaatgttctgtatatatctgttaagtccagttgttccaagatatagtttaaatccattgtttctttgttgattttctgtcttgatgatcagtttagtgctgtcagtggagtattaaagtcccccactatttttgtgttgctatctatctaatttcttaggtctgttagtaattgttttataactttgggagctccagtgttaggtgcatatatatttaggattgcaatattttcctgttggacaagaccttttaccattatataatgtccctctttgtctctttttactgctgttggtttaaggtttttcttgtctgtttttcttgtctgatataagaatagctacctctgcttgcttttggtgtctatttgcatgaaatgcctttttctacccctttcctttaagtttatgtgtgtccttaagtcttaggtgagtctcctaaaggcagcagatagttggttggtgatttcttagccattctgtggttctgtatcttttaagtggagcatttaggccgtttacattcaatgttagtattgaaatgggaggcaccattgcattcattgtgctctttgttgcctgtgtactttggttattttgtttttgctttttaacttctatttttgtcttatagggcctatgtgatttatgctttaaagaggttctgttttgatgtgtttccaggatttgtttcaagatttagagctccttttagcagttcttgtactggtggcttggtaatggcgaattctctcagtatttgtttgtctgaaaaagacttcatctttccttcatatatgatgcttagtttcactggatacaaaattcttggctgatgattgttctgtttgaggaggctgaagatagggccccaatcccttctggcttgtaaggtttctgctcagaaatctgttgttaatctgataggtttttcctttagaggttacctggtgcttctctcacagctcttaagattgtttccttcatcttaactttggataacctgatgacaatgtgcctaggtgatgatctttttgcaatgaatttcccaggtgttctttgtgcttcttgtatttggatgtctaagtctctagcaaggctggagtagttttccttgattattcccccaaatatgttttacaagatttcagaattctcttattcctcaggaaaaccgattattcttagatttggtcatttaacataatcccagacttcttggaagctttgttcatattttcttattcactgttctttgtctttattggattgggttaattcaaagaccttgtcttagagctctgaatttctttcttttaattgttcgattctattgctgagattttccagagcatttcacatttctaaaagtgtgtccaaagtttcctgaattgttgattttttttaatcgatctgtttccttgaatatttctcccttcacttcttgtattgttttttggatttccttgcactgggcttcacctttctctggtgcctccctgattagcttaataacctaactcctgaattctttttcaggtaaatcagagatttcttcttggtttgaatcctttgctggtgaactagtatgatttttggggtgtgctgagaagccttgttttgtcatattaccagcgttggttttctggttccttctcatttgggtaggctctgtcagagtgaaggtctagggctgaaggctgttgttcagattcttttgtcccctagggtgttctcttgatgtagtactctcccccttttcctatggatgtggcttcctgtgagccaaactgcagtgattgttgtctctcttctgggtctagccacccagcgcgtctacccggctctgggctggtactggggttgtctgcacagagtcctgttatgtgaaccatctgtgggtctctcagccacgaataccagtgcctattctggtggaggtggcaggggagtgcaatggactctgtgagggttcttagcttttgtggtttaatgctctattattgtgctggttggcctcctgcaccaaagtgcaggaggtggtgctttccagagagcatcagctgcagtagtatggagagggaccagtagtgggcgtggccttttgtcttctgctacctgggtgggtagggaaggaccatcaaacgggggcagggctaggaatgtctgggctcagactctccttgggtgggtcttgctgtagctgctgtgggggatgggggtgagattcccaggtcactggagttgtgtaagtaggaggattatggctgtctctgctgagtcatgcaggttgacagggaagtcggggaaagccagcagtcacaggcctcacccagctcccaagctaaccaaagggccagtctcactcccaccatgtcccccgccaacagcccaagtctgtttccaggtggagggcgagatgggcttgaaaacttgcccgaggctacccaccttccagctgcaaaagaaaagggcttggttcttcccctgcctgtggagtctgcacaccagatttgcaccctccccggagttctggccaggaggcttctcaccccattcaaattgttacaaagttcagctagagattttcttctccctgtggttttaccccctgctcttctgaccaccctcctgatgaatccctgtggtgccaggcaggaatggcctgctaggggacccagcgagctctcagtgtctttctgctgcttcctctgcccctgcattttgctcaactctccaaattgactcagctcctgataaagttggaaatttctcctgcaaacagcccatcattttctacagtgggggtgtgtattcgggagaagagggtctccctttcccacttccacagttggggcactctcggtatttgaggtgactcccaggtcctgcagaagcagtctgcttccttcagagggtctgtgggtcctcttgggattgctgatttgttcttgcagttgatctggagctaacattcacaacgaccttttttttttttttttgaaactgatctcactctgtggcccagactagagtgcagtggccacaatcttgggtcactgcctgtagtatggtatcttgaagaagtttgaatttaaacagataagacctagagtcctttacaacatttatttcatgaatgatatagcttcactgagttctcaactgcatctgcaagacatgagctatgactgtacctcagttccttcagctggcatttataataacacgtgctatccagagttcatgctgggccccacaggcccttttagattcagtctgaggttacaacccccaggagtagctttccactccactcagccatggggagttgcatgtctctcttgattcccacatgcttcacgtctactgtttctcaaagtccttattgtaattatgaactttcttacttactgctgtcacacctagtattactggaaggaggtttttaaaactccaaacacaggcaaagggttttggcataagactagataagcatttgttgatttatgtgaataaattgtatgactaaaggtctcgggtagtcactggaaagtgctgtagaattgctgcttgttagttgtttgttgttaacagttgataatgagaagagcagacttctgagaataattcagctatcactaaagaaaagtcaaggcaaaaaaaaaaatggattcagagcctgaaaggccagcttagttatgccacataactcaagtgaagtccttaatttaaaaagcttttctgtcatagcaacctaattacaatgtgaagggaggtactcttaccatgttgctataaagttgcgtgccttccagagtcccaaataaaattccgaggaaatttttggaaaaaaaaatagaagaagaatatttgttctgaattatttttttccctaagtcttctccctttcaatttgatcacaaaatccaatgagacacttgaccacctagcaacagccaaagtttttcttaaaccatcactcagaattgtataacttctctgcttaaacctctcactggcttcctatgttactcacagggaaatggaaaattcataccagtaaaaagattctaggagatctgccctactacatcttggctgcagcactcaacactcccctcctgagtcctctactctggcctcactaggcctagctcttctttttttttttttttttttttttttgagatggaatctggctctgttgcccagactggagtgcagtggcacaatctcagctcactgcaagctccacctcctgggttcacgccgttcttctgcttcagcctccggagcagctggggctacaggtgcccaccaccacgccacctggctaattttttctttttaggtaattcatttatttatttattttcttttattattatactttaagttttagggtacacgtgcacattgtgcaggttagttacatatgtacacatgtgccacgctggtgcgctgcacccactaacttgtcatctagcattaggtatatctcccaatgctatccctccccactccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaagaacatgaactcatcattttttatggcttcatagtattccatggagtatatgtgccacattttcttaatccggtctatcattgttggacatttgggttggttccaagtctttgctatcgtgaataatgccgcaataaacatacgtgtgcatgtgtctttatagcagcatgatttatagtcctttgggtatatatccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtagttgcctgttcactctgatggtagtttcttttgctgtgcagaagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacatacactctcccaagactaaaccaggaagaagttgaatctctgaatagaccaataacaggatctgaaattgtggcagtaatcaatagcttaccaaccaaaaagagtccaggaccagatggattcacagccaaattctaccagaggtacaaggaggaactggtaccattccttctgaaactattccaatcaatagaaaaagagggaatcctccccaactcattttatgaggccagcatcattctgataccaaagcctggcagagacacaaccaaaaaagagaattttagaccaatatccttgatgaacattgatggaaaaatcctcaataaaatactggcaaaacaaatccatcagcacatcaaaaagcttatccaccatgatcaagtgggcttcatccctggaatgcaaggctggttcaacatacgcaaatcaataaatgtaatccagcatataaacagagccaaagacaaaaaccacataattatctcaatagatgcagaaaaggcctttgacaaattcaacaacccttcttgctaaaaactctcaataaattaggtattgatgggccgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaatggtattcaattaggaaaagaggaagtcaaattgtccctctttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatgctcatgggcaggaagaatcaatatcatgaaaatggccatactgcccaaggtaatttacagattcaatgccatccccatcaagctaccaatgactttcttcacagaattggaaaaaactactttaaagttcatatgggaccaaaaaagagcctacatcgccaagtcaatcctaagccaaaagaacaaagctggaggcatcacactacctgacttcaaactatactacaaggctacagtaaccaaaacagcatggtactggtaccaaaacagagatatagatcaatagaacagaacagagccctcagaaataacgccgcatatctataactatctgatctttgacaaacctgagaaaaacaagcaatggggaaaggattccctatttaataaatggtgctgggaaaactggctagccatatgtagaaagctgaaactggatgccttccttacaccttatacaaaaatcaattcaagatggattaaagacttaaacgtttgacccctggctaattttttgtatttttagtcgtgacgggatttccccttgttagccaggatggtctcgatctcctgacctcgtgatccacctgcctcagcctcccaaagtgctgagattacaggtgtgagccaccgtgcccagccaggcctggctcttctttgaatttatctagcctgctgtcatttcaggatctctgcaggtatttttcctctgctgaaaagtcttctccctaatagcccaaagctcttccacttttttcaataatctttccaattgcccattcagaaaggtttaccctgatccaccttttaaaaaccaagccacctcctatggtctcaggctttaattttcaaaacaaagctttctttttttttttcctaatctttatcatcacttgtccaaaaaaatatatataatatgtatatgtatatatatattatatacatacatattcattttaagcctctaaaatggacttttctcttgctttaaacaattttaagccatatcaaaaccagacaacatgccatcgatatttgcaactctttttaggttacccattcccaggaaaattagaaaataaatgcaagatgatgcatatttcacttggtaaataaggaataaacaggtgaaaggggactcaaacacattctactcatttctctgccttttatggttgaagacagaagatacaacattcatctatagttgcataaggtaatgactactaattatagcaaaattgagacttgaatccacttcattgcagtacagtacccttcataacatgtttctgtcttgcttatgggtatttttttccctttagtttcttaatacaaaatattctagacataccctccctggatatagaaaaataagaataaagttgcatttactcaaagagatcagtaaatgtcacacctaaaaaattacctaaaaagattatatgtggtcagatttttattatttgtaaaatatagtaatagcttgtcattattatcattatttttctacatctactctgttccaggcattttagcccagttatctccatttctcacaagtaagcaaggtagactttttttttttttcttttttttttttttttgagacggagtctcgctctgtggcccaggcgggagtgcagtggcgcaatctcggctcactgcaagctccgcctccagggttcacgccattctcctgcctcagcctcccgagtagctgggactacaggcgcccaccatcacgcccggctaatttttttttgtatttttagtagagacggggtttcaccgtgttagccaggatggtctcgatcccctgacctcgtgatccgcccgcctcggcctcccaaagtgctgggattacaagcgtgaggtagattttattagctccacttttcaaatgaggaaaatgaaattcggtgtgccatagcacattgcccaaggtcacacaactaggaagagtcatggacagaattcagcccaaggtcatcagtgccagcacctgtgctttctctcgtgctccacacccctctgtagataacaatgggacaactctaataatcactcgtgtaattgaacttatcttcagcttatgtaaaattttccatggtcatattgtgagctgggttccaggccaatctctgccactctaagaaaacaaggtgacagtgatgaggtatgttggaatgcattgttattaaagaaacaagttcttatttacttaactggaaccaggaatacatcagttctggccacagtgttagaataaaagcactcatctgatacacagaattaggataatctctacactagaagggcaaagaggggaggaacaaaacataagacaaaaataaaacattttgcatttgtttcctcgtggaaacagcatcttagaaagctttgcaattgtaattaaatattgtgtattgtctggctttgagatggcataaaaaacatttaaaagcaagagaaaagcccattgtgagggcttagaaagtaagaagtaagtcgtttaatttttctttcatctgatgttaatttatgcagaagctaataacatatttgtggctcagagctgctcattgtagggaagatttctttcccaaccacactcttctgtgatccctgccagaatacagccatcatttcagggcttattatacttttgtcagggaaaggtaatattctgatactttcacatcctgtagatacatttaatttttaatcttctgaacatcaatgggcttaaatgctctaattcttctctagctgttacaaacaaaatggcaaaccaatgagaaagagatggaagaggaaattttttatgtgtgttcaaagtcaggtagacagaaagggaagagtactcttggctgttgaggaagaaaaagtcaggggcaaggaagttttcataaaagaaacatgggttatttttatatccaagtaggatataatcaaattgttatgtttttataagtgaaaaatttaattccattgctaccaaatcacctatataacagagacaatagtgcttgaggaaatgtagaatcttgagaagttgacattttaaatgaaattcagcatgaataaagtaagtctcataatgacagcttaaaggtctaattcataaaaatgttattaaaggacattaatctgcattttgtggacttctgctcttattcatgactctcacagtgtatgactgtaatcacaagcagagtgtataataggagcattaattcaatttggacgaagacaagaatactgtatcaccacaataaaattccagctatattaatttgaagggtagaatttgttgcacaagagcattgtctaaaagaaaattgaaaaataaatgaatgccttccatattctgggttcaaatatctactttctttgtgaagttcggtgtaagattgactaattggcacaagctttttaatgaaatatttattcatcaaccttatgaaacttggagacttggatactgagttctgatcttatggttagtatggcattagtgtttagcttgagcttagaaatatttacaagtcatttgtattttaattaacccctttgctgatacatgacatcagaggtgatgcttagcaaatggctattcaattgtctggcatatacatttatttagagaagatgtaaaattcactactacataaaatttctcccagagaagctgaaagtagtgatacttgaaagtatcttcattcagaattttaaatatgatctacatgtttaatatgcataaacctttagaaaagaagaagtggaaatcaattggtttatttctatctctgaaactatcaaaatttgacttcttgactttctacttctgattggatgagctgtaatagtatgctgtagacacttttagacaaagtgtgaatacatttttccctgagacattagattatctctagaaatcatgaaaggggttctttataaattatatgtctaacattgaaagaaagtgttgtctttgatcttgtaggtaaaaaagctctatacctatgggaatgagttaattcctctatttaataagatgcagtcattagtagacaacttaaggattcattctagaactacatattgaatttctttagcataataatgatcttataatagttctgggtaacggaagtctttgaatgtacctgtacctgagatgagagacaactgacaaagagaaaggaatttcaaatataaggtaaatagcactgctaattgaagataaaaatcagtacatttacaacattaaccgtagctattattgtcccaaatctaaaaccactgaacattcaatttcaacaactatgtattagtacaggactttgttatctaaaatgattatgcttaccagaaaagtgtccagggatgtccacctgctatgtggctatgcctgggcagcacgtgaattctctgtctttgctccctcagaccaaggctgtctcagatttatgaaacagggctcttccacgaagtttagaagtaccacaaacagtttgatgtggcatccagacttactgcaacctctgggtgcaaagattgaacagccttgttgatacaaccactcagaaaggaccgtggaagttatgtttccaacacactgccagacacttgtcatcaggcttaaatgcctgttggcaagagccagatatgaaaaacagctacatcaaaagatacctttttaatggtctaatatattatttctaatgaaattaaatgtataaaagaaaacaaatattaattcttctagtttatctgcagtatattttccaagaaatatattttaattttatatatcaatacttttaggcactagataaacaattgtttggttcagaaagttcaaactatcacattcattatttgtaaacagtattagcagtctacaacgttacacatttactgtgagccaggcactttacacagtgttttgtaaacattaactttgagggaggtattattatttgataaatgaggaaaataagacttagtgggattaaattacttgctcagtcacaaagctagctggaggcagaactgacttaacaaaaatccttcatttcaaccttggttttgctttcatactaaatttccctaaaggaaatattttaaatgtattctctagaaaaagaaggggaaaagaagaaggctgagaagaaagttacttctgaaacaaaaaagaaaggtaggaaatttaaaagccatgtaccacataaatcaattagtgtccatgcataatactactggtaaatctattattttctaggaaagaaattcccttaataaatgcattgtcattgttattagtgaacactcttaacatgtctagatattccaaataaaattaaaattgtcaatttttaaaaagagaattcaatcctaaacactttttgaaaattactactgtgattattttttctttcttaagagcagctgcttaattctctctaattcactactttactttaactatatatgtgaatatgatggttactatttaactaattcagtctaattttaaaagtcattttatgtagagggcagaaaatacttgattggtttgttttacacatatatatatattttaattggttgttttcaaataatttatctgatgtcccaagtgaacttcagagatttcagaacttttgacatggttctggtgacctcatagctcagagaacattcaatatattcttttcaatatatgttaggaaagctgttaaataataccataattaataatgccatttaatgttttcactgttattaaataatttttgcctttggcaaaaaaaaaaaaaaaattctgtttcctgaagagaaattatacctaagccactagtctgttatgaaggtgctaccttattcatatttgacatgacttatggctgatttaagatttctctatacaagataaattagatgcctcactggtagtcatgcatgccctgaaatatttgcaagttaaacaggtaaaggcttataactttcttattttaccagcagaaaaagaagatatcaaaaagaaaagtgagaaggaaactgccattgatgtggaaaaaaaaggtattgcactttctttgtttccttagatggattacgttcaggatgtttgcttcatgaaagactcctcatgcaacatacacaaattgcacacagttacttatatctacccaagacgtgaaggtcaaagcaaaacttgcactagacaaagttaaacaggcaaagaagactttattcaaggctattgcaataggacagagagactggaattgagtctgaactcaattcccccccaaaaaaacgcaggaatgtttgtaatggctggtatggggaatcacaggacatctgtttttgcatattggcttttccccctcaaaacgtaaactttcagtcttatatctgcatggtaagaagtagtttcacaatgtggagcgaggagtccaaggaagttaggctcctactcttccacagaaacttagagatggggcactatctttcttgatgattacatttcaaagggatggctctcagttccttgagaaaggctttatgggttgtgaaactgaaaagtggcttgtaaatgtcccagctactagagtggccaagacaggagcattgcttgagcccaggaggttgaggctgtagtgagcaccataattgcactactgcactccagcctgggtagcagaggaagaccctgtctcctcatccccctacaaaaaaaaaaaaaaaaaaaaaaaaaatctgtatctcaataaagtagagaaagaatttacaatgacaagttttccagttttctgaagtaaatgctctaagaaaagggagattaggagctgctgaaggtcagaaagaaacctattaaagtttaatcaaggtgaggaccaccttggtcaagatacaatgaacttgagaagagatacatagtaataacaataccacattgcaaagataagaagctgagaaagaataatgcaccctattaagaaataaggttattcaactatttgacagtttcgatttttgctttaaattttgttctgtttctattcttgttcaaacatgaatattggcttcgattcaggttaggcttaagtttacatggaaaagacaatcatctcaagtattatggtttggtgataagcattctcacctgaaagatttcctccactgatgtcagtgatgcttaaaattctaccattagaaccattccattcctttgagttatgaaggaatcgtcccctattaaaatgcagatcttctagggcttgtgtatatggggtaaaaacctaattcctctcagctattaagaacttaaagtaaatgagatttccagatctttcctgtgtaatagtaagctaaaaattgtaccccagaacatgaggtggtaggtaagcttaaacgaagaagattgaaaacttcagggtggggaaccgtctggggagggcaggctgggttagacggcattttagtgaaaatctttccttttctaagtagtaataatgtatgtggaaaaaatgatggtggtgaggaccctaaaaagaagagcatacataggatgtcaactatataaagattatgattagcaagcagcaaatagaaatgcgtagaaatatctggcatcatgctataaatggggtagaaaaaatgtaaaatattaagaattgcatgattatgtggcccatgaaatgagcaagaaggatcagccagacattctgtgtgtccaagagttgattgcccattcctttgcatccaaatttccattattaaggctgtattattgtagtctattgttctattaaatattcactcattttcttttaaaactttcttattttctgatgaaatatgtattttatcataagaagggaaaaacagttctgactctatgaatctgagaaactgcttgcttagagcagtggatttgtgaaaattacatgattgaggggtaaagataaaccaagatacttcttccttgccatcaattttactaaaagagttgcagaagaaaattttgagttgtaattttcaagcatttttcatatgcacgcaaatgcaaaatctgaaaacgtgtttttggcaaaactcaatggttttgtgtgtgtttgtgtgtgctcatgcgtatgtgtgtgtgcatgtgtgtttggcttggttttagctttttgagggaaatgatgaaacttgtttatgtgcaatggttcatgggaaaatctgatactcccctgccactgggagacctgtgttattagcccagcagtcatgtcaaagtgaggttgtgcaccactggcaagagaacggattatgcccatatcacttcctacaaggacagtgctcagccaccgaagcagagaccaaactgagtaattgctcagcacatctaggcaggactattcagctagtgttgtctttcttggagccagttttctgtttgtatgcttgtcatttttacttttgattacacaaaattccattgatttttccaaatcagttcaacttcctgataaaagataggcagagtttatttgtttacaatccctcaacccccaaatactcaaaacagtgtgtgcatgtgtgtgtgtgtgtgtttgtgtttgtgtgtgtctgtgtcagagagagagagagagagacagagagattgagtttcagttagtgctagtttttaactcgtttctttttagggtttaataattctttatattttcatgtgacagcaatatggtttacaaacagcaggtttcaagcttattatgaaagtagtaaaattttacagagataatgagagaaattgagaataacctgaaatcttgaagagctgggggacaaaggtcatttcttcctaaagtagaggaacatggcagagcatatgatctcactactgtagccccaaatagcaaatttataaggcataagatatgcctacatgcttatttaatatatgagtgttattgtgatattttattatatttatgttaatgttaatattatttatattataaaatatatgcatttagttatatgttatatgttatattattattttattttattcccttatattgtattattatgccgacatgacaaacctaaggcttaaactctattcagtgataaatgggcttctaccgtatgacactggtaaatcacactttgccagtgatctctggggaagttgtaggtggatgggctttatatgatacaaaattgccaacccattaattaataggggttgaaactgagcaattggtatattggggttaattataacactcctttatttagtgtatatttgaaatcatccatggcaaaaaattaaataaatacctgccaattaaaaacattatgtaaaattaaaaaaaaatcatcttggtatttttgcaatgttataaggtacattttcacttgaagaaataccatgaaaaaagcaatcaacaaaagaaataaagactttaaaaacatctctctaggtttgtattagacttcagtgctagaaacactaaacactgtagttggcactgctagaagacattctatacagggaactgagtacctacaatgttattgaaggactaaaataactgaaatcaaataatcaaaatttggattattaagcatcagggcagatcaacaggttaggagactgctttgttcaccagcactgtcttctcacaaccacaaagactagatcctggaaatgttgaggcaagcctcagcagattactaacatcttcatttgccaaatcattcatctgctctgccaaaccatttctgctttcagtctggtggaacttgatatgtctccagaactctggctgcaagtgagtctgtaagatgcattccaattttctcaagtgaaagtggagtgaaatggaagttgaaagaggctatcaatagtatctataaaaatgatactttcaggaatgtccaagatgataaaattcatacaataagagatggtttttgaacacctacactttatagtgatgaaacctatctttgagttcccccaaaagatgaaaaggatgacacaactaagcaatatgatcaaatttggcaattccaagtgttcacaaggcacacttacctgaagtttatgttgctcttcaccttcactgtagataaaagaagcatggatattctttctctcttccaccacaaggtgatatttttgaagaaataacgtttcacctacttgattagattataatatttgaacaattaacaagttgacttgtctcataacaaaacaattataacctgggcaaaatatatagacacacaagagaaacaggccaaagctaagatgacccattgctcttgggttggccttttcatagttacaattgtaaacttttaggagttaaatttgtcatcatcttatatgtttataaacttattaactgtgaaaataattttgacaaaataactattgataatggtataaaatcatatttaattatcacactttccaataggatttttttttcaggaattatctgtatagaactataaattacaagaaggatattaaaaccacatagcttttctgaaataagctactagaaaaaaatgaatgtgttcattcattcatgcatgcatgcatcttgaaggaaatatttaaaaaatgcctactatatgccaagctttgtactaggtgctgagtacacagaagtggataaacagacaagatctgccctaatggagcttacagtttgacaagggaggcacacagtgaataaagacaaaatgtccacaagttcaactctgagtaagggcagtggagaaaataaacttaaggcaatgatagaatataatgcgttggggtggggaagttatttaaatagataagattattagagcaggcctctctgagagacagcatttaaattgagatctgatgtattgaaaggactcagccattgattgctggatcattgtgtgatgtatatatatatatatatatattatatatatatatatatatttatgatgtgtgggggaaggggagtgtggtttgtactaggagtcagaatatgcaggaacatgtataggtgtttggactttattaaaagtgtaatggaagagattgagctgaagttttaaatatgggaatctttatagattatagttgatgctcttggaatagatgagactaaaaagagacagtgtgtcaaaagaaaaagggaatacaatccaggatcaagacctggggaagtccaacacctacaaattcaatggtggaaaataaagcaagagaggctgaaagaaattgccagagatattaaaggaaaagttaagagcttggtattatagatgtttcagaaatagatgtttcaagaagcaaaagttatcaactttgtgaatgtcacttacaagtttgttttacgagggcagaagacacaagggcagtcagtggagtgaaagataaagtcaggttggaatgggaggtgcaaaaatggagactaaagtgtagattttgcggggaagggggaaggattacggctgtaggaggagtaaagtcttttgtgttttgtctagttttgctttaatagttcaatctagtgcccgatgtacataaacagaatgtaggagattgatgctcagagggacagaatatataagcagaaatcgaaaagataattgagaaattatactttgatgagtatttggtgaaaactactcttttttttttttggagataataccacaggtgctgtgatatttaaaaagttgatgttttcaaattatgactaggattctatgcagattgccttaaaagagaggcatgcatttgtaagatatacaatatatgattaggtggctctggtgataaaactaaaactccaataataaatacattctgagataaaagcctcaattttagaaaaagatatatccaaaatgtcttttgtgctcactgaggaaagtttgtgaaatgtattttaacaaagctctttaaggatcattcatttacaataccccattagagctttacactgaaacatctttgtggtggtgaattggtcaggtaagatttgtctagtatagaactcataaagaatttgtgctgtttaagggatacattcgtatctatttccatcaaattttttcaattactgtatgtggcaaataatattctgcacaaactaaaacctttggctatttgctttctctctacaaaatctgcttttctcattgagaaattgcaaagagtcctttacagaagcttattgctttgaatataccattaaatattattgtctaccaggcattagaatattatgtattttacttttgaatcttttgtaacaagttgttctagctcaaaataatatatatggcagactacagatcacttaaatttctacatttacatgtaactaaaagaaacctattttaaatatttatgtgtacatttataattggacaaaataacatatagtatctttcatatgtattcatgttaagttttagtttaaaagaacatccttccattttctagacttgtatattgagaagattatagctttttttctgatcacccacatctttctccttatttgaaaagcacttggttttagaaagttatcttttttctggagttttgcaaatatgtatttgggcaagatttaacaaatgcatccaattggtattgttagacattgaaatctagataaattttttcaggatatttgatagtaatccaggagttactatcaagttataaatgtagataattcatacacttttgagtgatattggggcagttgtattattttatattccagataaaattttttaaaattcattcagataagtaaaaaatggaaaatctagtacacattagacctggtttaatcagtatttcccagccttgacttagtgaggctccacaattacaaggcaatagtagattcctttcaagttagccttttgttccacaacagattaggttgtaaatctgcgttcagatgacagcgtcttgactgtgttaaaaacactggctatgctcgaagggctttgaaggaaagagagtatattttcaagtgttttataatcatggaacttaggtaagacaatagttgtttaaacatttgagaataagagattttccaacagtggaaagtcttctgacttgttacttactatgatatcttgttacttactatgatattagctctggaagctaatctgttttagagaaagtaagatggagttaccactataacttattgtgggaatatctgagataacttttcacatattcacttttggtttgaacaatacaaaagtgagcttgggctgaatgcaaaaatgaggtaaggacatgggcattttaaaataaatattagaaactcagaaggagcgaaggttcatgttaaaaatatttaggcctgaaaagaggactagtatacatgcgactatttttaatctttttaatgcttattttggggacttggggctaccctctctgaggacaaaaacaagatcacctctgaacttgagaggtgtgttatattatattattatattatatttatttttttgagacagagtcttgctctgtcaccaggctggagtgcagtggcgcgatctcggcttactgcaacctccacctcccgtgttcatgcagttttcctgcctcggcctccctagtagctgggactacaggcacatgccaccatgcttggctaattttttgtagttttagtagagacggggtttcaccgtgttagccagggtggtctcaatctcctgaccttgtgatgtgcgcgcctcggcctcccaaagtgctgggattacacgtatgagccactgcgcccagtctgttttattgttattattattattatattttgagacagggtcttgttctgtctacctggctttaatgcagtagtgtaatctcgcctcactgctgcctcaacctcctgggatcaagagatactctcacctcagcctcctgtgtagctgggaccatgggcacgtgccaccatgcctggctaattttgtttatttttgtagaggtgaggtctcactgtgatgcccaggctagtctcaaactgctggactaaagtgatcttcctgcctgcatctcccaaagtgctgggattacaggcatgagtcactgcacccagccttgtattatcttttattaagttctttcaacagggagaattgaaatgcatataaagaagaatcagtaaatatcagtaaatagaccacatatttcttctctgtacgcattgatatatcaagaatttttagcaggtcttgcacacgttagataaattattttaaattccagttcatatttattaataggataaattattttctgaaaaaagttaaataaaataatgtaattatacagtagtctcttgcaaatatcataaattttcctgggaaaatgacacagagtggcataagaaatggaatgtcagttagacaccagttattttttaatctgttaatctcaatttaaaaatatggagagattttgatcaatttgttagacaataatgtgacagtgtggcctgagttttccttgtgacttgagatacatatttaataatgcagatgtgaaatatccaggcaaattttgtcgttatatatcctaaaagtctataagattttcctttcagtgcaagtaaagctttaaaaacatcaaagtgatatctccctcaactgcagcctctctagggatcccaaaagcgtatttttgaaacaacagcaaattctgccagtatagattcattttatcagcagcattttaaagtaatcataacaacagttattaaatctgttttctcatttaatcataacaactctgtaaggtaaccattataatccactttttatagaaagagaaacccagcattggaataggtaaattacttgcccatcatcaccagtaagtagagtgaagtcagtatgaaagtcaccaaataaagcttcactgtcttttgggacccaaaagcactttgtcttctaattctaggaaacaatggtggtagactgctttagtgtctttttttttcctccctctttttcttttttgctaatttccttcagatgatattgcagacagtggtaaacatgtaggaaaaaatgcagaagagatcctgtaggtctgactcttacttttcttgtagaaattatgctttccttcattcattcactcaaaaaatatttaataatcccataatacatgcaaggaaatctgcttaatgttggacatagatcagtgtaatagacatagatcttgtctccaaggacttcagcaaacaaataagtaaaaattataccatgagcactataatagggtaaatacaaggcctcacgcaaaaatcaaggcagaagtatagaaattacttctcttttgtggtaggtgagtgactattagagatctagaacagggacaccaccgacctatgtaattaggtatttgaccaagacacatataatatttatttttaatcaggatagagactggaacacatacacttttaacagtggtgtatcactgaagatacttgatcttgcaagtggcagatgatctcaaagaaggaatttattagtttatccaactactattctggagtaaactggctttgagtttagcttgatgcagaggtcacacaatatcatcaggagatttacctctctctgcttttggactctactcccttgggattggcctatgtagctgtaaattggccataggtgctgccctatatcctctcttgttcatgtcctgctagggacttgggaaagcgggtaggggtggaatagatcagtgtcctgaaaggtcaaataaaaacttgagcagtatcagtcttcataggcccattcctgaactaacctttgtggtgtgggtgaaagaataatctgattggtttattttaggccacgggtcctatccttccagcagagaaattacataaactttgtccaaaacattcgagctgaaattggattgggtgatgattccctagattaggtttaaaaaatgatgagatggactagctacaacattgaaaaagaaatataagtactctcttcaagaagtcatttctagatggtgaaaatctaggtgatatgatttctttatttttatttagagaataacacaagggagaaattttagtgtcatctatggaggggatacttaagtattttagaaaaccaacccaacatagaataaagcagtgtgatcaacaaaagcaagcaaaattgcaggtttcattcactaaaatattatgtgtagtaaagaattaaatccttcccctctactttgtagttttagaattacacttggataatagtctttaattttaataaagatattttaaaataaaccagattatattcaggagagagtagctcagaaatgtggatgtgtaatatggaaatcaggaaacagagaacatcaaagccatgtttctaactttgatctactctcctatttaggtgtagacttactttttattatccctaagaatgaggactccatggtggaagttagaagtagacaatgtgggatgtttaagattatatggggaatcttttaagtcagtgaacactgccatttgaagttttcaaacagagaaagagtgggtatctttcttgaatttgtggaggtaatcctgtaagaagaaggattacattacatttaagaagacttacaagatgctattttttcaaaattaaacatctagctaaatgaaactaatgtctagattatttaaattttgaagtgaagttattattattattgttatcattgtattaaatttagccacttgtcttactcttctagaaggttagttattaaaaaaaaaaaacaaaaggcgtggtcaagagtttattccaggaagtgaggccatagtaaatgttcactatatataacctgagctgacaccatctcttctgactgcctattccagcaaaaaacatcactgtgaatcttatcatagaatgttttattgatatctgcataaaccaagggcactaaaaaaataaaatttattacacatgtggaataatgattaattgtcctcagggcaaagaaatatcttgagacatctcagtagaaaaaccccaaagacaataagcctaaggtaggaaagaaagtttaataattatttataatgcaaaaaatagggaaaaatggtttctagaccataaaataagaattgtggttattttttagaaagtttgtttgttgtaagtagttaaaggagccttgaggagcacatgtaataaattacctctgcaattaagaacagtatttttcaaaaaataattaatgtcagtataaacaattaagtaattttgttagtcacttgcacatatccggttagctatattaattttggaatataaggtcaaaaatgatgaagtagctaatgctaacagatgaagtagttaatgctaaaatacaccagaaggaaaggcatataaaataattgccttgaaagataccatgctgatgtagaggtgaaaatatatgttatacaaatctgaggagaaagaagaaaatacaccatggcttgaacatgtgatataagcctatcagcggaatgtggtaaaccacttgggctgtcttccctctaaaaatatgtatagacactaacattcccaggaatttgtactacttactattgctccactattccacacatgcagcaggggctcagtggacgtttgtgaaatcaatcctaagttagcttttgaaagaatgcctggtgattccattatgttttagaaatagaatcctaatagttcactctctcttttctgagactactctctccaaactgttccttttttaaaactcctttacctttttacccttcttctctatcagccaaattatttgcttcctttttttctcagaaaataaaaattagaagagatctctcacaagctctgaccatcaaatccaaccatgtacttcatctgtctcatctgtctccttacattctctgccttcttggcagaagacaatgcaatacagtggtttcaatgttcatacttctatgaaaaatccttccactggtgcacagtatgccttccccacctgctaactaaggagcatcactcctgcaattctctcctctgcaaattcattttgatttctaaggtcattctcagcagcataaaatgtgctatgtcatatgtgtgcatatgtatctgtgtgtgtgtagatagatgatagatagatagatagatagatgatagatagatagatatgtatattatataaatatcctgttattgacagcacatccttctcaggttgctgcctgatttctcagatcccctttacagctaaactcctcataagcattgtctacattctccttccggtctctcatccccgctgtacttaggctttcaactccaccacagttcttgtcaactctccacattaccatgtccaaaggtgaactccttctcaagagcatttcacagcctatctctttcttcactcaccctcttagacaacattctttccttttaagttctctggtcactctcttgttttcttttgctggcttcctccctttctttctggaatcccaaattggaagcactctagggctcaattctctctttctctatcctcactaccttggtgatctcatagtttcataaatttaaaaccattcttataataatgactctcaaatgtatgtctccaactggggcctctcactgaactccaaaatcacaccttcatctatccaattgcctattcaccatctccatttaaatatccagtagacttcttgaagttaatatgtttttttgaacaaacaacaacacccctcatctacacatacacacacacacacacacacacacacacacacacacacacacctctacctctgaatgtggctctatgctcagtattttcctcttattagaagattactacacccttttttccccaggcttaaatctctctagccactgctgactccattatttctcttccttaattcattattaaatcctctcactttcacctttgaaatatgtttagtagctgaactttcctcactacctttatgaaccacctcagttctggtaccatagcctcttacctctaaagtcaagttcatagtgtaacaacaatatgaaaacccctgaaaatttcagcagctttgaaaaatgagaacgttttttcttcttcatgcacaagttgggaaacctgctgtactcatcatagccacttaggcacccaggttgatggatgctctgccttcatctgtttccacctttacagaggcttccacttcactcagaataaaatctaaagtctccacaaaggtgtaaaaggctattcatcaactgaagggcgacgataacacctgggcagcttttctcatgcagcaaagccattaactgaggtcctaatcacacatgcttgccatttgtaatcatttgttatttgacgaaatttcttccatttccaatagaactcacggtttcagcatttagatttcaaaagtatatgcacaatttaatttcctattgcaactgaattttagcttcactcaaattttatcaaaatgacaagaccaattagcgtatgaaatatttaactagcaagttaaaaaaaaaacgcagacagaaagctaattgatgcatgagttgttttttcttgtttatagagggcctatgaaaacataatgcatatgaaaagagccgtgacttcaactttgctgtaaaatggtctctatagaaaggatttagccttgatgagaaggcatggatgtgtgaatgtcattgtggaagaagtaggccagaataaccaattagggacagaaaagggcagttaggcaggaaggagttaaagactgcaggttagaaaacagttttttattcagtttgatgccttggtaacatgaggcataaagtttccatatgtgccttcgaatgtggccaggtagggtatataaatacgatgattaaaaactcatagtcttgcctactgaaagactgaatcaacaaaaaatgacaatggacagttataattttcctctggcatttctctttccttcttattctgctcatttggtgaatggcccttcccctaaactctaaccatgtaggctcaaatggggtttcaagttactgtcattgttccacctgtcactttccccatgagtgtgggcccatgacccaagttaggccagagtgctgtccataggctttaagtaaaaaggaaaaaaggaagatgatttatttttatagatggtaatttgagtgagtgcaagaaatgctattggccgtatttacatccttgatgtggtagctaatcttgaaaataatgctgccccataaaataagacaaaaaaacatattaaggtagaagtttaaaggtatttcaagactatgattcatgtatccctggaaagtactattcccctgacctcctgacattacattacatgatttaattaattcctcattttgtctaagttagtttatgtttgtattttgtaattttcaaactaaatgtttattactcaaataaacatccatacagatttagaatagttatagcaactttaaaactcttgaataatgagagtgagataacaaactaaataaaacattttatgtttgatataactcaccttgctgcacgacttcttataggaggaaaataacttctctgataaatgtttaaatatacctattttggtagctggtttagagagtgaataaatatgtatttatttaatgagacttaggaagaaaaatatatttgtcaattcagcatttacttgccagaaaacattatgttaatgtaaatttcaaaatttttataactaaaagcaggggtaactttcattggttttatcttatgaataaaataggaaacaaaattcaaatgcttcttttaattttattctgagctttaacttctgttttttaaaatgtttaatgtgaaaagatggcattttatagctggagtataaaattaacaacatgtttattcctccaaactattaataaacacagcgagacagcccaagacaaattagacacagctacccataacgctgttacatttatctgctttgctagtaattatagttagaaaaaatccactatcctttgtgctacatagtaatccataatttattcctgttacacctttttactaattttttcctaatagccccttgaaggaaacacacaaccttattattattatctgtatctacagcagatttaggaggttttaaaacctgttatagttgtcattgaggataagtagaggggtttgcaatctagaatttaaccttaggtaataagtactgaagactttttttgttaggcctaagtcttgttacataaacttgccccattttatttaaccactttgacctaaattactacttgtataaattgtgagcagcaatgattccattcaataattttttaaatgtgtggaattcccactattttgtaggggaacttttatgtgtttgattcatcatgattaatttagtccaaattagtttttaaaatatgtattagattgcttttcttggaattccaatgggaggaatgttggattcagagttatgaagggtattatcatggctctctctctgaatctctcttttcccatctcccataacttttcccatctcccttaactaagctttcctgcttagttaaagttttggataaaaactctataccttgtaacaagattgcttctgtaaatgtcaggcttacaaagtcattaaatgctgaaccccaaggaaaaaacatgctgaactcaaaattctaaggaaattttctgattggccaaacttgggtaacatgttagatgtgtgggcagaactgaatacagttacgtcccagcgactggttccaagatgcctcaggaataccaaaatccaaggatgttcaggtctcttataaaaaatgagataatatttgcatataacctacgcacatcctcccaaatgttttaaattatctttagattacctacaatatataatacaaaatatatgttatgtaaatagttgttattctgtattggtttttaatttatgtatatatttttattgttgtgttatttttattgttttcttggaaatatttcttttttttgagatgtgacctttctctgtaggctgaagtgcagtggtgctattatggctcactacaacttcaaacccctaggctcaagcagtcctcctggctcagtcccctgagttgctgggactagaggagtgggccgccacactgggccaatttttttttttttttttttgtagagaaagggtctcactctgttgaccaggctggtatcaaactcctaaacttaagcaggtctcctgcctacaccttccaaagttctaggattataggtaggagccactgcacctggccccaaatattcctgatctgcaaaaaatggtggcgctcacctatgcaaagcctattgatgcagagttggccatctgtatataattacttctatggctgagtcctcctgaaaaagtcaaaagaggttaggtgggaagaggatgaggaaaagttcaggtcgagtatgaagagagaacagcagagacagtgggaaatgaaattgggaagaaagatcctgatattcctatcaggtagctgatataattaagtttgtgggcacaactggataatttacacttcatttgacaggtaaatgtgtaaaggaaacagattgacaaaatcatatctttgcctaaaaagtattaatctgccaatatactgtcaaaggcaagagaccaagagaaatagtagttagaaagttatatcaataaatattacagagctcaagtcaattacaacaatgctggtgacaggtaaggagggcctaatccaacgtggcagattgagaggagagagccacggaaagcattataaaggaaattcacccagtatatagcaactgagcttctaaggaaggaaaagaaaacatgtatcagtatttatttaaatggctttttagcagataaatttcctcagagaattttgtgatctctgctgtttcctctcttttaactggaagaagaatgttgttagaaaaaagaaagaatcagagggaaatagataccgttctgtcatgatgactttttaaaaacatactgttttcatatgagcacttcagttggctggttcagttgttgttaaacaatattttggggaacccaaaaaccattttccttttggcatttaacaacaattaaaaattttttccattaatttataatgtggttcctttgttacttaagtaatctttaggctagagaaaaaaaagtgagtccattctgtttttttcgacactgagtatctagcacctagtataatgccagtatgaagcagatgctgaatccacccattgaataaacaaaggaagcatcttccatcacatgagatgtatttttagttttatatccttcaaaaaggatttgcctcccatctgtgaatttctgcatttactttgtctttattcacttttgctcactgtggtcatgtagagaaaaactaaatattgtattcccagtctcctctgctgtatgtggagtcttaattagcttttcaaacacattgcagataaaacctattaatcctctgaccttcactgaattcaaaagtttttgtgttaattgttttgagagaataatagacagttttgctgtttttttttaaaaaaatccttgcatctctgccaggaaaacagtagaaccagaaagagcatttgaaaggctgcttgtatttcagctgccatcttttaccactagtgcatgtcagaggacagtcatttctaaactttatgaaagtcatttgttttcttacagctttataaaataagcttttaaaatgatttctatccaaaaatagcaaaaatagcaattagatcatttaagatgattgtaattttgtttattaaagccctaagtggaaaaggaacttacatttattgtccacctattaaattacgagcactttgcttgcattaactccttaaaacttcaggatcccctttttcctgtggtttgaccatttgtgtcaatattcacttttgtttacaaggtttcaatcactccactgggtactgacgaaaaactgatgaaaattgtcaccctcatttcacagaagtgcacacattcatttgttttcgagagtaaaaatttctactgctgatgtaggaaggaattaggacttgaaatctgttttctctgattctaaaacgattgtcaaagtttcaatgaccattagcacttgggaggcaggaggtactcagtagtatcacccaaggttaaggtgacatacacaccagttttctcctgtagcattgacataattattcatcacactttcttttattctcagagatgtccagtgtggatgattgtgctccatctcagaagcttttaaaattatgtatttgcgagtgctgtgggagaccaaggtgaaaagatcacttgagactaggagtttgagaccagcctgggcaacatagtgagacccgccccctgtctataaacaattaaaaaattaacctggggctgtggcacatgcctgtagtcctagctactttggaggctgaggcaggggcatcatttgaacccaggaaatagaggctgcagtaagttatcacaccactgtactccagcctaggtgccagagtgagaccctgtctctaaaacaaaaaataaattttaaaaaattatgcatgtgtaaaggctaaagcaactccatcatggaaactaattcactatgctgacttctgcttaaccccagttcctctcagatttctattttcaagtacttaccataaatcctgcttataggcaaattccttctgaaacatctataccctttctctatggtatagaagccctggctctgggggttaacagtgcggggatccaccacctctcagctacccgagacatggcttctgcttgtaaatccctaggaaatgcttctttcagagaaactggatctatcagtttctttttttagcctctcagctcccatggcctttgggagtaggttcacatagatagacctgctcatcttgaaacagcatctctagaggtttagaataccagaatctctcttcccatcagcgattatgattcagtcgtcctggtgcaaggataagaaagacaactgtattttaaaaatgatccttgggtgattctcttctgccaggtaagcaaaacactcatcaaggctcataaaaaaagcagccatgagcagtgaaacagaatgctttgctgggagtcgggagcttggacctgaggtctaaccctgccactggatgcacaaccctcatcgtttcaggcttctgctttttctttataaaccgagaagatggaatggagtcagtggctttatgttggggttgggggttgagtgtagaggaaagagtaccttgcaaagtctcaaagtatgagactttgtcaaactataacaagattctgagattcttgtagccacctatctccatgggagctgagggtgagtgaagaggtacttgttcttttggaaaatcactgcttttagggtgccagtgtttgggatgaaagtatgttgtatggtatcattgcctatgttggagcaggaaaaaagaaagaatggaaacttaggtagatggtcctgaatttttatttctaaatcaaaacattaaaaaaagtttggatttagcaactacttgattcagtaacttgcttttcagctgcttagtttaaccacacacacacacacatacacacacacacagcatgaaacaacagctgaagacgtatttgatgatgtgagcacaaatggatttttttagtctttttcctactgagttgctggagggcaacagtgcgaacatccacccttccttgccagctggtgtgtattcctaaaccagggaaataacggtcacacttaccctacctattatgacaagctacctctgggtcaaaattattacagcatgttcttattagtgtctgaatcccactttcatttgtgtgttatacttacccagtcctggatgagtaattttaattgtgagagccaaataagcaaaatgtggagttagcccttgacaaaaatagccactgttacaaacgtgatttaagggctgaaatggttcagatcatcatccctggtgtctttgcttaacaaaagcagctaggaggggttattggtctcagaggtggaatatagctgctctgctctgtcagaaggaaagtgctcctttggctacttcttctttgtccacagggcaaatactgtgatatgagaaaccggagagatgggatgtatcattggcagcttggccctgaaggctttagggcagtatttttctctttctgcccctagccagctgtctttttgcacaggttgaatgcatgtgctctgcctttgacattgtgcatttaaatgccagcttgtgcaatttacagtacaaaagggcaaggatacgtgggggaatgaggaaaaaagaaacctcttttctcttctcattggctgacctttgtgatttcgctttataaaggcattgaaagagcccctttgaccatatttctgatcttcaaaacaatcacagaaatagccctttataatgttatttatatacattgctaccagtcttcctgcattagaatataaagaataatttgtatccctggaactgaacacggaaagccattcctatctcagttagctgaaagtaaaaccaaattgcactctgtgattttggtaatagggatcaaaaaattttatattgtaggattttaggccaataatacctgaatctgaaaggtagacttaatatgcttccctcaaattaatttagaaaatttcaaatttggagagatcataacataataattttatgagacagatataaaaggagatgcaggactgagagtgaccttggtggtatgcaaatcctcattcttgagaaatgatttgtatagacttaatgattctcttattctccttaggtattccttcattgattcatttgttcacttattgagtcctttcattagaaagatgcttttctgggtactaaagaataatggtggctgggcgtggtggctcacgcctgtaatcccacaactttgggagacggaggcaggtggatcacctaaggtcaggagctcaagtccagcctggccaatatggtgaagccccatctctattaaaaatacaaaaaattagctaggcttggtggcagatgcctgtaatcctagctacttgagaaactgaggcgagagaatcgcttggacccgggagacggaggtttcagcgagctgagattatgccgctgcactccagcctgagtgcaacagagcaagactctgtcaactaaaaaaaaagaaaaaaagaggaaaagaataatggtgacaaggagacaaagtttttgcatttatagaacttcatagtccagtgaaggagacaaatcataaagggcatgtagtatgatatccgagaatgatacttgctatgaagaattgagagggcaagtggatagagaatatggaaggtgctatgttttcactgggtggtctgggaagggctgtctaaggagatgctatctgaacagagacttggatgaagaaaggagtgagctgcacacacatttgtgaaaatagtttcatacagtaaaaatgcaaccttcacacagaagaaatgcaaaaaccccaatgatcagggaacaggaaaagaagcagtggaatagaatagcatgagtgaggagcaggtggtaggaggtgaagttaaccgagttgtggagatctggatcacaaaagatattatcctgagtgaggtctgatgctttcaaagggcctgagtacagatcattttaagcaattataaaagtgaaaacaattagaattaacataaacacatttctcgtgtgttttgttggctggaaaatttgtttagttgcctcttgctctgtccccttaactttagtgacactgctgtcactgaattttgcatatgaaattctcttcagaaaaggataagactagtgccatctggtggtcgtagttgtgaacgtcatactccatcctggagtatttgcaaaaccaaaaacatttaggcccagcagtgctaaaactttcaataatacttatcctcctaggtaaatatgtctattgagcacatataaaactagaatatggaaactcgactaaagtattcgctgatgttgttctgtgctttgaggaatcttttagtttagcccagtagttatttttgtctatacagtatatgcaatgcagttcacatagtaggcaataaataaattgctattaaattgaaattagcctaatgtctacttatcactgaggtaccattgacctttattaggtcttctttcttaggtctctacaacagtagtattcttgaatccagagagagaccacatcattttctttttattgtgatatttgtggttatgattatttggctagtacacttactatttttatatagtgtttgcctaataaatataaatttacatatgggatagaaagaactatgttttaacattacatgggtgtttatcttaagggctacctgcttagactgtctggctttgagccttgcctcagtcacctgcaagttctatggatgagccttagtttccttctctggaaagactctaatggttctaacgttacagcgatcttgtcaaggttaaatgagaaaatctaggtaagctgtctagcccagtacttggaatattacaagtatccaatacatggtaaatatttttataatttgtatgtgtttggtatgtagcatttgataagctaaaggtcaaatcatgtctcatgggaaaattaaatataaataagtaactagtttgtaaggatagttcagcctgatcactcaataagcatttagttgaattccttatttgtagtaagcactgttctgaaatatccatcatacatttatattaccaagaagtatgcaaagctacaaaaggacaagcctctgagtgtttaataattgtgttcacagagcctagagtggcatctggcacagagtagatgctcaattaatatttgctgaatgaatgaattagaaaggactccttaaatataaatattatctagttttacttcttattcatgtaattatttaataaaatttgatatgttaaagtttctgtatatagatgtaagtaaaactgaaacgatattcaaaattgtattatcattacatttttacctaggagaatgaaatcagtaataatcctagggtactcattttccagcaataatcaaaagattcttatattactaattgtgagcagaatacttaaagagagaaattttggcaaaactattatgcgaatcactaaatttgcatatagtggtttttcccctaaaatgtaatgtgtgttttaagacttaactctcagaatggcaattccattttcctgcttccaagttcttgattgggaactctttattattacacatatattttctattcagctaaaacctccacaacatacagaataaaagatttgatttttcctgactgaaagaaaagctgatatttgtatatatgcatttgttatttatcaaatgaactctaggacaatgtcaactgcttactaatatccaatatattccatggacagcctccctcaagcaatgaatctcagaatatcatggcaatgtgaaaattcctataactcacatatttctatatatcctatggagtacgttctcgttaaacatgaggtaacacttattctgtgttttaatgacatttcagtggtttctagaatttttttaaaaaaatctcaatagaaaggatttagtaaccttaaggttaaccttgatcaatatttcggaaagtattattaattggaacctaaaaggaatgctaaatgcaaagatgtggcataggttcatcaaaattaaagaagtcatgtaaaattaaccttaattcttcatcagatagcgaacttgaagatcagagaaattgtgcaggcttgatgcatgtgtagcaaagcatttgaaaaggtgccttctgatgtgtgattaaaaggtaagaaaatgggctgaatgcaagagaaaactagttaccccttgaacctttactaaccaacacttagtaatggataactcttaatctggtagagatgtctaatggtgagtagggggcttcatcctcttctgagagtctctggatttagtcattactaaaaagattttgcatttgacactgttgactatctctttatctgtaagaagcctattcatgatttgtcaatggtttttgacatgtctgttataataggcaagcacatcttcaaagccaatgaaatttgttacaattttatgtgaaaaaataccttcaagaatgccttttgggaaactatattcacttgccaactggctgtattaaacaccactctttctcttgtcaagtgctttttcttacaatgccctatttattcctggagaattcacttttatcaggctatgaagtcatcaattcaagctcactataaagaaccaaagcttcaccttaagtgcttaaaatactcctaagtaattttgagtaatggtcaattctacaccctttagaaacaccattttaattattttttataaccagtactttctggtatttcaccaaggtgtgatttcagatgtaattctaattaaagtaacaatttgattgtttgatgccagaaagtccagacatataaaagtctctgaaattgaagtgtttttgataattgttttgggagcaatcacaggacattgagtccaagattcagactgagagactgagatgctgatgtcattggcattactgctactgttgccccaacactgggaatttgttgagaacagaaagatgaaaccattaaatgaccttttcacagaatcacattacatggattccaaactttctaaagagtgttaacttttcaaatcaagaagtactatgatatcttgatttcttatattgcttttccctcgttttctccatgctattttctttttaatgtgattttttcattgtccaccacattcctccttaagtaatcatgtttagttctatgtttgaacacagagaattattgaacattttagatattttttggggattccaatctgctggaagctgtcaaggtctaaattagctagttactaatgaaccgaacataatttttctttatttttttcttatgattttatcacatgatgagaattattctggtcgttttaggatttaccattattatttagaatttttttaaaaattgatattgttttagttaatttttaaactttttaccacaaaatatttattcatagaagttactaaaagctacatatccgagtttggtaagttcccagctgagcctacagtctgttgataaagagatgtaaccaatgatgatcaggcatcttgcttacagaacattaagagacccagaagagtattcataatctcaccaggcagctataccacaatgaaattctaaatctaggaagaaaaataggacatttcttaaaatgtgatgatggtcttccagcactatccaattaaacttcctatattggtagaaatatcttatgtctgtactgttgcatgtggcagccactagccacaggtggctctttagctgttgaaatatgactagttattgagaagtcaaattttcagttttatttaactttaaattatttaattttgcatttaaacagcttaatacagttattggctgccatattggacagcactgcctaatctttaaatttaccatgttctccccagctcccacccatttcccttgttttccaataatatagacttgggaagtaaattgtggttttagttaaggcaaggttcaggtcctgtgttcgtctaataactacataagattccatggtgtgctggttagctatattttggggagataaaaatagtactgcgttatagtgtttgctgatttccgtggtgtacgtaattccaccaaggccaatttgaagctaacaacatgaaattaaccagccagaaggatttctgaaaatttaactatctggtctcataagctggtaaaaactgtctctaatatacctatactctttaaaagtcccaaatccttcccatgttttcttaaatgttgctaaggtttacatgccctagatcacttctctctgtgagttctgctcttacttacttggttcagctcatggactggcttcttaattctctgtatgctggccttttgtttttttccataaaagcacttttctttagtttccataaaatccattttcagaaaccagttgtgcaaagcatagaatttttttaaaaagatacctgcagatggtagaggggatggggaaagttcttactatgtggcaatattaataaatacagattaagtattgggtatctttgctatttaatatcctcaggctactcttcactgccctttcccaggttccctcccactgcacgtcatctctctgactcctctttggtgccttccttctgccatagcttgttctcacatcctgagttttggatttcccccagaaattccaaactttccaactaggtcatacaaagcaattcagttctcttcagcctctattcgcaaactctccttttgatattcacactcatcctgttgcttgaaggaccctttatttgccataatcaatcttccttagaaagtagttattcaggctgggtgcggtggctcatgcttctaatcccagcattttgggaagccgaggcaggcggatcatgaggtcaggagttcgagacccgccctgccaacacggagaaagctcgtctctactaaaaatacaaaaattagctgggcgtggtggcgggcacctgtaaccccagctactcgtgaggctgaggttggataatcgcttgaacccaggaggtggaggttgcagtgagccgatatcccaccactgcactccagcctgggcaacagagcgagactctgactcaaaaaaaaaaaaaaagaaagaaagttattcatacatgtaacaaaacttattgaataacagctacacaccaggcactcttctgcttgtaaatatcaaatttggccgttcattatattagtattgggtataataattttcaaaatgcctagcacactgctgatgtatgttggcaatcaataggtgtcattttgttatgtatttgtgaagcaaaatttagaaatatattaacacactaagggacagaaataaaggctacaacctttggaaagattcagactttcatctctgtcttccttttaattacacattctatttcaccctcaaagctgactcttaaatactaatatttgtgatgtccagatatgtataaacagtgatgtaatccactatcattttagtaaaactgtgtataaatcactgtacatttaattaataccacatgtattttcactgaccctatgtttatttgttgctgttgctgtcataaattccctagtcacttattgtggatacacaataaatatatacttaaaatacttttagtttcaataagtgaagagaaaatacaataaatgttatagaaatgattaacattacattttggttcattttgtttcttcgttgatcactttttgttttgctgtaaactatttggtaatttttgtgagtgcagtgagtaatattttattgtcctgatgctaggtgcttgcaaaaggggagaaaatgcatggtgttctgttttactttatgtgattgggcatagaaatgtcttaccaatttgatctcttatatctgcccacagctcttggactccgcagcctttgtcttagttcaggtcatcattactctagtctggagcagtactgtatcctccttcacaatatgtactttacaccaaatattctgcatcaatgatttcactgacggcatgtctgattatttcactctccacttaaacctgccaaagctttactttgtccctaggataaagtcttaattgaagagtttcaatgtctttcctgatctttctctggcttcatctcttgataactctttcatcgccctttgctccatccatataaaagtccatccaattgtttaaagtcaacccactctctcttacaattatgattatttcagagccttctttgttcaaatccttatcctcctctctccacctcccctttgtttgaataccagttgttactttcataaaatatcaccccttactggtcttctggatggacaggtgtcttgtttcaatgaatttcataaaatctctatcccttataatagcacatggcatacaatactgggtatttgtttctcactagactctgagttttgggtgtgtgtgtgtgtgtgtgtgtgtgtaaattacattatctgttttaactgacagagcaaggcacattttgtgaagtgaatgtcatgcttgtgttcaaaattaaggagaattaataactgcaatacataagcagaagaatctgtttctttgctaacattcaaaagtaggaagaatgaatacctttgcaagtggctattatgttcaaagtattatggttggtactttacatatgtcacctcatttaatcctcacagcaatatgagcctttgaaaacttaagcatgctcaaggaaaatatgaaatggcaaagccaagattcaaagcgtgacctttctgactgcaatatttatgttcttttcactaatccatattgcttttgagaatctgtgaaagctgtgttgctgactactacccattttgtgggctaaattgaagaatatatgtcaaagagccttgtaaactgtaaatattctacataagtactgtgaactttataggttttcaagacacatctgttaaataaatcactaagtgactatatgatattattattgtagttagtgtgaaagagaagcaaggaatacttattatttccatttccaggagtaacatcacccagtctatgttcctcattaatgagtgttgcattaaagaaaagttctatcatcacatatgtttaggaatcagtgccctaacttagattggtttctctactgcagaatttcagtctggtatatgttaagtatattgtaaagtcttaggagggtaacattttgtatgcagtgctctccagtgttatttgaccctgagctgcttttgtggagaagagcatctatctggactagtattctatgggttccactttaaagtgctatatatcactcgtaaaatgatttttcttgtcagagattattactcttaaagatatgctcttccatgtaaatttaaacaaggaattcgaatgggtacttctgggacggtagagtatggaaattaatttatatacgtatgttgccaaacaattcttttttttttttttgagaaaaagtctcactcttgtcccccaggctggagtgcaatggcgcgatctctgctcactgcaacctctgcgtcctgggttcaagcaattctcctgcctcagcctcctgagtagctgggattacaggtgcccgccaccttgcccagctaatttttgtatttttagtagagacagggtttctccatgttgaccaggctggtctcaaactcctgacctcaggtgatccacccacctcggcctcccaaagtgttgggattacaggcatgagccaccgtgcctggcccaaaacaattattgtcaagttacttctctaagacataggtatgagaattttgtactttatattagaaaatataaaatatgaccttattcaagtgcttaattagtaccatgtatagtgagatgcttcaatgaaattcagagattttgatgatgaagtattgtgagcacagtgttgggatgaacaagataaatagcactaaacacatggtattgaatacttactatttgccaggacctcctataagcattttcaatgcattcattcattgtatttcaatgtactgattagtaccagcataaaaccaggtaccattgttaatacattttaaagccatatttgggaaactgaggaagagagctgttgaatgattcaccaatgccacacaattagaaattggtggagcaagatttaaacccagaccaggcacctctaggacttatgctcttaatgtgtttacaatattgctacttcctaggtggtttattgtggtgaggtctttgtggaaaaataatttcttattacaaaagtgtttcatgttttgctataattttcaaggtttataacaattttgaatcaagcaattataaaaggcagagaccttacttttaccttccttaagattaatttttacaaaaaaaaatattgccatgcttttttcccttgctgtttgatccttcaaaataataaacattttttattcaagggacttattcctttagttcattatttatacaaaaaaaagagaaagagtatgtattgtccatagtcacagagagggtgccatgagccaaaagaaaaaaacaagatgcatatgggaattttatgggagtgtgcagcttaggaggagagatagaaacatgtctctgaacagcaaaagcaagcatagaaagggacagatgccttaagaaagtcctggtgaagcactatgttggccccaaggagggagaaaacaattgcactacgaggatcagaaaagtttccaagaaatgatagtatttactttggagggtaaaaagtggttgactgtgaagaaaaagagaaaagtagaacaagacaagtaagggcatggggaagagccctgactctgtttctgtatgcacagagttaataaaacatgtttcgttcggtttggttggtataagcagaaagcaactttattctttctgtaactaccaatgcaaacccactctgtagacttgcttctcttcaccccttgggtgaaatcaggaacagacactatagcttgcccggtcatgctcaactcagataataaaacaatggtgtcttttttcaagacatccaatccagtatattatcaaagctcccaactttcattcaaataaaaatttcccccaccccacccccacctaagcttgggccctctcagcaagcaccctgagcttggagcctgaaggtgggaaggtattgtgggtttcttttctctttttcctactctactgaagcccctgaaattgattaccctaccagccaacccaccaggcttggagcaaggggagagcacagagataaagacgacaatttttgtttttgaatcagtaaaccttgaaacccttctatgttggacttcctgttatgtgaaataatactttctcttcttaagtaaaacaatataggattttctataaatttgctgtatagaaattagctgttataattgccattgttgttattttattttaaaggcagagacatttatgtaaaagattttcctatgtttatatatggctatcacaatgagtcacagcaaaaccttttagaaattatattggcttttcattttatatacatgcatatgacggaaaataaaatttaatattatatattacataatataaagttttaagctttatattaaaatttatagtttaaaattgcaaggaaaaatggcattattttgaagagaagtggtaattcttgttatattgacaacatgctgggctagggtcagaatgcttgcagtttagtccaggcctagtggcctatcttacaaagtaatgatacagatcaagtgcagtaattaatgcaaagactttttaaacactgtgtttaaaaatttaactttttattcaaataatagtgtagagtgagcttttcagtatattggagatactttctgaatttaatgtggtatacaatcttgatgtttgtgaaatttatttttgttgaaaataacattcagaatatttataggttttagttttctttggtcctacatcattctattttggcttttacttggcttaaaaatgtttctgactaaaattttaatctgtgcatttgtgcttatctggttttctagaaaattcaacaaatgaaggatgaagaatcaatgcagttttttagaaatttgagtagacatattttagctattacttggagtcaaatatggtctcaagataaattaaatatgaactataaaacattatagcacaaaatactgagggactatcgttaagcttccatttgcttttcaagagatgggagatttttcttagtgtaagtaatctaatgagtgttctctgcttgtagtacttgaagtattggattaggtacccatgaggattacaattagtatggggccattggtgaaaggtatattcctcctttgattaaaaaaaatttgcagttatttgttttttaaattaaattgactttttaaattttacatcataatgtgagcctggttgaaagatgagaattactaaactttttggtctgagaatttatcacggtaacctctactgcacccttcctttagccatttccggcctcgtcatgtaatacagaaaccaattgtgtttgcctctgagatttcttgttgatgctaaagtcttcaaaaatgtaatccacagaagaatacattgtaacattttattcttaaatgaattttccaaactctttaattttaaaactcagcgtatagttcatatttataaaaatttctactgccttcagatgggttagttggaattcagaccatcttgagatgatggagatgggctaactggaaagcctagtagctgtaaaagtagatttcagttgagccatttgttagaagaccaataacttgccttttaccacagtatgtgggaaattgtttttttgtactagcatttactcacttgctctcaaacacttctatgcacattgctccagcatttgaatattgactcaatatggtatttgtgcatataagcatggattttgaatattcaatggttaaaggcaacctctaggttgactgctaaagaaacacattatgctttacagaatagttctccagagaaagtgatacatttgctgcaatacgtgaagatgtgggctccagaagcaatgtcaatattcagtaaccttagcttgtattaatattatgagaaccactaggctgccagctaaataccaatttaagtttagatctgcatgcctaacattggggactactgttcctcagagctgtgcataattccttttaacactgataaaggagagaatgaagtggtgaaattcccttttagggaagccaatattgagaagcccatttatttatctagagcattagcatgtgagctgacagttaaagcatttgaactcttagaaccatgacacaaacgtgaactaaagaacagtccatgggaggcgcagtggctcacgcctgtaatcccagcgctttgggaagctgaggcgagtggatcacctgaggtcaagagttcgaaacaaacctggccaacgtggcagaaaccccatctctatttaatagaattagccaggtgtggtggtgcacgcctgtaatcccagctacttgggaggctgaggcagaagaattacttgtacttgggaagtggaggttgcagttacctgagatctcatcactgcactcccgcctgggtgacagaaacttctcaaaacacaaaaaaacaaaaaatagttcaccacacattacaaaaagtccacagtctctaaaattaaaaaaggttaaaaatagattgtaatctaaatggctcagtaattcagtgatattacatctcaaatactaactgcatattttcccacacatcttagagataacaaacaacatatttccatgtttacagaaatgaatatttttatatattaggttggaaaggacatcaagtatgtggcatctatcacagtacatagcttcaaaattaattgtcctttcatccaaatttttgctttgcttttaatgaatgtttatgaaagtccaaggagaagattgagagtccaatatcagaaagaaggaaataatcaagtgtggcttatctgtctttgttagagatttcttaactatttattaagtggttctttttggtctgagaaggaaaagctgccctataaccttaatatattagaatattcaccaataacatgtagtatcccaattatatacattataaaacctgaatcatttcaataataatttgaatatcaaatatcttgtcccattttcctcccttcaactgctatcttttatctcactattttctatttgtattacttacattttttcaattcctcttttctcctgtatttttttatttctgattttgattcgcaaaacttttctttatttagtaaaattctattttcagttatgttgagttttttaaatttggacctcttccttgtgctctgcaaggtgtcatcattgatcagagtactgtccttctaggaaacagctgtgtattcctgctattttaataggggaattttgatttccagactaagatgtactttatctccctaggcagatacttatacctatgcttttttcttatttcttcccacacattctgggatcttgctaccctaattgtcttcccatttcccagacttttccatatttttctctccatttggtgtttctttattctcctcaaacaaaacaggaaaaaagcctttgcttgatcttcctgccatcttcaagcccctttgtagtttctttttttcctatggcctctgccacatttgtcacaggaatggattccactcacttctattttgttactgtccaccttacagctctaaaggtaggcttccttctatgctcttttccattccaaaaccatatccacaatggtttccagggatctcttagatataaaattttatttctttttatttaaccctgaactttattgcctcatttaaaaaaatgtcttttccctggccttgttgaaatcaacatttggatttttcttatagattattaactaatatatttcttgataggatggtagtctgaagccttctgttcatctgtctctgggaaaaattgttcacgctcttaatttcagtttacacttcgatgtgcatgactttagaatctccatatcttttcaaggaccctcctttcttcaaatgtctactcaatattttcatttaaatttgtaccatcgcttcaaacttaaaatgtgttaaaagctttagttaaattatgttaaaacctattctgtttatcaagtccaaaatctgtcttatttgaacaaacagccttctttccttctctgtatatgtcaaacaaatctcaaaattgtattagattcttcttttaaatatctagcttattttttttccatttccattaacatttgcttagtctaaggtattatcaccttacacagagtattccagtgacattgtacctggcttctatgctaaagggacagaagccctttcccagacaatcatggacacttttatctcttcaaaacactgccgtgtaactttcctgcccaaaaatgcagtagcgctcaatgtactaagacaaaagtctatcttatttgctgagatttcagggtcaattattttgaccataatttacttttaaacaaattttaacatttggtttattaaaataaaacctttaaacaaattaaatttaacaatttacttgagcaaaaaatgatgcataaacctggcacgattcaaaactaaagtgtttcagagagctctgctcaggtggacagtgtgctgttatagcccaaactgaagggaagtacagaaatagcttgattggttaaatctagacatttgccttatttggacgtggtctgatcagttggctgcctgtgactggctgaagctcagctgtttgtgattgactgagactgttttctgttacaaaaaacatactcttaagtaaggtttcagtttgtttacatactgagttaggttgcagttcattatgtaggaactcacaatgtgaagacagcctcaggccaatggccttctgcttatttcatgtgttttacttctcattaacatcaaacaagactcttctgctccagctggattgattcataattccaggaggatacattgtcattcactctgcagctttctttccctttcccctttgtggctctacaccttatctctcctttagttttttttttttttttctttttgagttggagtctcgctccgttacccaggctggagtgcagtggcgtgatcttggctcactgcaacctccacctcccgggttcaagcaattctcctgcctcagccttcctagtagctggaattacaggtgagcacccccacacccagctaatttttgtatttttagtagagatggggtttcaccatgttggccagtaggctgtctcgaactcctgacctcaggtgatccacctaccttggtgtcccaaagtgctgggattataggcatgaggcactacacccggcctcctttaaatcttgtctatatcctgcctccttaaaaattgccaatctctaaaactcagagtaccatacactttatttagcattttttcacacagcattcctaagcaaactgtgggtggaactaattcttatgtttaggtaatatagatgccttattcccagtaagcactcatgcaataaatacagaagagtaagtgacaaacctcagtaattatttggagacgtgttttctcatttaaaatcaaattgcataatgttcaacccctaaccccctgtttaatctgaggactaagtgtaccagaaagcgtttgcttagaaatagcctctgaattcttccttgggctgcttgatttagaattctccattcaggatgtctaccctttggaaatcatggtaatttatcaatgtaatctgcattttacaaacctagccatttttacaaaaaacttaaattctctttgaatatgattataacatctttagattttgacatctatagaactgtagaggaaaaaaagggctcaagaagtctgcgtaattttgtgaggataattgccacatatttggtttagaattgtcaggcatataatatgggcttttcaaacaccttgtctcccaatcattattcactttttcacgcaataacatttcgggatggctgctcagtaccaagaactgtgttagagatacaaggtacacaaaagccagtctttgcccttagtttttctttccactattcttattacgttatattttcagaggactacattcacacaattctgtttgtttataacatttccaaattgggtaaggagataaaagtggtgtgtgtgtttcttattttctaggaaaggaaaaacagaatggtgatattcacatatactgcttactaatattagaaaaaaggggctggttttttaagtgctatatttagatcatactgttctatgacaccctttaatgaggaaagcactctctctaccttatatgtaaagtgggcattagagcacgggtccccaaaccctggtactggtctgtggcctgataggaaccaggctgcacagcagagggtgagcagccaggaaaggagcattacagcctgagctccatctcctgtcagatcagcgggggctttagattctcataggagcttgaaccctattgtcaattgctcatgctagggatctaggttgtgtgctccctatgaggatctaactaatgcctgacgatctgaggtgaaacagtttcatctcaaaaccatcccccattacccccatcccccactgtccctgtgagcataaactgtcttccacaaaaccaggccctggtgccaaaaatgttggggactgtcaaaattagaggccctgtcaactagaccttatttaatttttaaaattgaaattttaactgaagaatatggctaaatcagaaattttgtttcctttatatgtttgtatatgtgtatgtgtgtgtttatatatatatatatatatatacacatacatattctttatgtcaaataaaatggcttattttctaaaataagctcttgacttttaaaatcattactatatttttcttagagtctgaatcaatcctagcccaataaattaatcactcatatggagaatgcaatagtttttccaaatcataacatttatttcactaaagtgtcaaatttctacttgaaattctaagtagaattcacatttgtgtttgagtcctaactgttctagaaagtgtattcttctcctaaggaaatcattccaatttgttggtcagaatgcttgcttttaaaatattatcaatgcaaaaggaatgcttattttatagtagtggaggactaccaggataagtcttaataatacaaatgaataaataatcaagaaatttgccatcaaaaatgatgtaggcaaattcttctaatacttttatctgtgttcataatcactgattttagaaagttgctatagaaggtagaaaggaaccttgagtgaccagctggtactgtctctttgctttaggcaaaaacatctaggacccctctaagacaggtatttctttctctggcatctcaagaaatgggacttcatatcttccatggtattgcattctgttgttttattagatacatggaataaaccttttccttagtctaaatgtaatctgcccttaatatggcaaatattttgaagagtaaaaggccaaatgatctgtatcttgcacataactttcctttatgttaaaaaaagtttcttctgctaatcatttaaattaattgataccttggtcttcaaccctaaattgttgattacttaagaaacttgtcattctcacacattctatccagacagctagataatgccatgagggggaaatgctcattattctgattgatgtttcccaatcattttctgttttcctatgcttaatttttggaaaaagctgattttatgtgtaacatctataggtagattttgacctacatgtagtaaaagcatccaaattctttcttttttcaaattaagaaatacttagatgagttaaatggaagcgatagtcttttttagattaaaatatagattattttagtagccgtgaaataatcaaattttttctgaattaaacactataatgctaagttattaaggtaaaagctacttagattccaaaacaaaaatacatggcttgatgaggtgaagattttctgggggaaaaaatctagcaaaattatgttacctattgtaaatcattttgccaacttatttagatttttaacctctagcaataacagattattttgatacattattcatatttctgcattgtgcaccttttgcaatttgcatatctggctgcaaataggcccttctttcaggcttcagtccccttggtcacacaggatggccaaaggctgcttcatgattaatttcatctcaatagggtaattatcatactgaaatgaagcaatgcccatgaaatatgctttcctggagttataagtacaagaggcttagcctagagctttcaagtatgtagcaacttttagcttaaatgttaacctttctctattttggtactatctatatctaaaaataatactggattttataagaatagaaaacaataacttagaatttgatttagcagctctttggactgcaagataatttgtcattagtttccactatcttatgcaaaaaataaaggatgtatatattttgaggggtcaaggttttataatgctgggtcaaattttagctgctgaattaataaacatgaatttaactcctgatctgtggaaaagccattcaacttttctatatttagttttcttacctaagaaaataagaacggtcggccaggcacggtggctcacacctgtaatcctagcactttgggaggccgaggcaggtgaatcacgaggtcagcagttcgagaccagcctgaccaacatggtgaaaccctgactttactgaaaatagaaaaaaattagctgggcgcagtggcggacgcctgtaatcccggctactcaggaggctgaggcaggagaattgcctgaactccggaggcggaggttgcagtgagccaagatcgtgccactgcacgccagcctgggcgacggagtgagacaccatttcaaaaagaaataaaagaaaataagaacagtctaagttccttgtaatattgatgaagtagcaagagacagctttaaagctgttttcatttctttggaagattaataaaataaatttgattcataatttgaatcctgaaaaaatgtttatctcaaacatgctcttaagtagaattccaatattttcattttttgttgtttgtttctcctcctattcttttaacaaaatccatgcaaattaattaaaaatttgcaaatttgtctaaattagttaattttacaaaattcccaattgcaatgtgggttaccatatattctactaaaaatctagttctaaaatttagagttaatacactttctgaataacacataatcagtgatcaaagagaaaaagagattttgcgtcatcttaaaagtgaaatagatccctgagcttaatgttccatttcaaagcagtcaattggattttttttcatttttatagttagatattctgtgccatttcttactgtttcatagagacaatttttccagcagtttgttgggtctggagttataaagttgaataagtgacaatcaatcagtgatctcagagaatttatagggtagtaggaagggaagttgtacgagtaaataattatatgatttcacattgaaatggaaatctgtactgtggaggtcagtgggctgggtattgtcaataaccaggataaagtctgtgtggtaggagcccactacctgctttaccatctgctgctactcattctcctgcccctgtcagttcctctctctaatggccagccacttcactgcagatggggggagtctttcttatttattttgttgttactataagtaagagacttacatgttattcaggtatttgaataacattgtttattgtctcttttgaagtaataattgatctctaccaacttattctaaaattaaaacataataaatacactgttttttttttcagagatgggagaatgctcaaaaacatgtaagatgtgggtaggtttctcagcaatactattattctttacctgctgtccattagccaaagaccaattctggctgctgacagtgtagcagtccatttgccactaaagttatgtgaaacctatttttgaaaatgtaatggatttgcactttacattaaatgaagtcaaaatataaacagtgtcctagaaatgaaaagttaatcgtattaaactaatatttaaatctctgtgcaaaaattggctctttaacaaaatgtttgcagactaatgatatcttttcagttttgtaaatcaggttgttccatatctgtggaatcagaagacattgaaacatttggctcatctgattcatgacaatttgtttatataaataccgcatgtttcagggatctacaaatactaacttctctgataatttcctgaaaaaacacccccaagtgaattatgctgacattttaatctaggtccatcctgtctctgatttaaaagtccaaaatactatttatcaatttcagaattactataatctttagttgaatattgttatggtcatctgttttttatttaagtcattgtactttatttccaaaaacacagctataaacaaaactatgacaagataaaatcatttgatatgatgaaattttcattagaatatgtgtagtggaggcagtacagatgaaatactgtagtaggtgttggaaacggtgggctcattatcctgtcttttttatttttgtataggtttagaattttccctaacaaaaatgtagtttcttttgtagttggcagaaatcaaaaggagacagaaaaattatttataatgaaaatttgtctgtctggattaatgtgttttcagtagtacaatatttggtgcagccttcttgtgttgtacatgtatggactcagggtcgattcctcccctaatgtcatgcaattttgaaaatggaaatgctgtgcaagagcagatgtcaaatctgatcttctttgcatgtgtcctcaatagtttcaaggatgatatttttgttggttggatgcaagctggcagacttactgaaaaggcatttggttttaaactgttaatttctattgagatgtagatcatgtagtagtttgtgaactaatattttagacgggtgaaaacgcaattgaggttcgtgcaactgcaattgcatttgcaccaacctcataaatgaactttaaagcttaaaatcagagaaggaatagatggagttatgagggacaaacatgatactgctatgatcccgagattttcctccattgaaatctttcttttgcaggtagacattgtagaatgacctctttaaaatacacttttacctggaaacagtatcttcaatgcatcagtgtgcatttgtggactgttttctttggcatgtgttggacgcgggacaatgaggggcagggaaggcttagggagggaactaagtcttagtagaaagaagagcccatagataaggaaccctaaaacatgcccaatctatgtgcacacagcccaacccaggacaggctaaggttattaaagaggtaaaccccattgagagatgaccagcctgttgggacactcaaatgggaaaactcagcactcaggggcatgtttctgaacctgaccgctgagggagaaagcagctgacagagaaaccaaacagtctgtgggagaagtgataaggccctaggaaaagcactacataatttgcaggtgtgtgtgacctccgtgctctaatagaatcttaggtgtgatgaggttgtttaggatcagtgatttaagaggatataaagaaaaaggagaagataagaggaaaattggctgcaaatttttgcaaatatttctacaaattctaaggtactttacatactgatattttaaaatctttttctttaaaatttaattacaaattgcagtataattttctaatattttgagatctccaagaagtaaaacatctgagcagaatggtgctcatttgttgaaatttttgggcatattattttcttcttttcttccatttgttttagtcaacaattatttaatacttgtctactaaatgtcagttatatataattactaattgagaccatttagtctaggtttgacaaagatggtactagcatgcatgcagttttcctccagaaaaaaaattaattatgtaaatatcaagggtagactgaattcagttttggcaaaagatattttctctgaataaatagctatagtaattagaattatttatgaatcaagtaatatttattttatgtaacaacaaataaaattagcatttttataatcatgtttatatataaatgaataattatcttaccaacaagaggtaaagcatgaattagaaatcaaatcaacattaaacaagttataatcaacatttgacaataattaaatgaaagattgaatatatatgtgaatcaactactacatatccacctaacttcgtgtccacacataattattgctaaacatgtgatggatgaatgaatgaaagtgaatatctaaaacaaatgacccaatcttactttccattattaaataataattcaataattgaaaacagtaaagacaatcagaaaccatactaagtcaaatgtgaagtgagccgttattttttgaaatttttatttacccattatttcccattctgattaagtatatttaaatgtttatcatataagtttttttttaataaatcctttttctttaaaggaaaaattctgaacaaaggagaaaaacatagcaaaaaaaacttagaacaagagggaagaaagattcataatgaagcttgctcattctctcggatatattttgcccagggccacactaatagtgattggtgccactgcagtttagggaagggcattttagagtcaaaggcttgaacttgggattggttgtttcaggctttattctcacattagtcactaagggaccttcagtaagtcatcttatttggttctacatgtgccatcgatttcaaagggctgataatacagacataatttaaatagaattctgagattttcaaattcagatgctcaacaaatgcaaagtgatattccatggccagttaacagtgaggcaaaacagtgtttggaatctttatcttatgatttaaattgcttcagtcatgtttttctttcagtaagctccattctcagcaattcctctaataagtttatgtcttaacaaaaattcttcgtgtcaaaagcaacactttttatgctcgtttgtgtttgtgctcccctgtcccttttttatttatatatttttccaaaatcatacttcatggtaatttatgtttttttcattccaagagccgggaaaagcttctgaaaccaaacaagggactgtaaaaattgcagcacaaggtaagcaataaaacactttaaaaagcattgcctttttttaaacatctatagcactttattgacaaaagcaaaagctgtttattgcagaatagcaccatctgctgggatattgcaaaaaaaatattgttgaatgaaaatacacagttcaagtatttatttagtaattggagcaagcatgactgagagtaatgccaaatttgcagaggaactgctgaaggacccaagaactagtcttggctccaagtttcagtatttgagctttatgtatatttttaaaaataatccattgatgtgcataaagaaatacaaatacagatataaaataatgtacacttttctataattttcagtataccttgtaatttatgttacatgagaagatcagaatgttattaaagcaatattacttcataaacatcaaaactgtaaaaatggggttccagatatggctacaaaataattatcctatttttatgagccatctaagaaaattaatttcaccatttacaaatatcttcaggataactaaagtggtttcgtctcacaccatgaggattaatttgatgaaagcatgagggaagggttcaagtgttctgcctttgttatgtggcaaaactttatggaacacacttagaaaataaaagatacaatgtttactggagaagatctttatcatctcttctatgctagattatataatatcaagcaataaaggagatgcacataggtggtggtacaattttcaggggtagaaggctctcatagcagacttcttagcacatcacatgatgtatgaccgaatgtattacatctgagcaaaatttttctcttgtatttaatcttggacccagcaacatgcagaatcacccccgaaaatattggtaacatgggtttgttaaatgccatttgactcgaggatgttgtctgtgagcaaaataagctagaatgattaaaagctatgataccagtttttagttttcacattgaaaaacttgtttttctttaggaaagttctgatagggaatatagtaaatattatgaacgatagaaaggcaggacaaatattattacctttggttttttaatacatgaaaatgcaggtcagggtgagttcctcaagccaatgactaccagtttaagaaatcattgctattagtgtatatatgttttcatagaaaaccacaatcaccttaggctcattctgtttgactgagacttctgaggaccatagtgtagatgtggaactacgacttgaggcaagaattttgtgttagttacttcagcctcatgttagaggcattcatgaggaggaaaatgaagagatatctgaaaatttgattcatatttgagcttgaggccatgggctctttaaactacatttaaccattcaagatttaaactacattggacaagtcaaccttagagcttatcattttggaataaaatatttatttttgaggaaatagtaaccaagagtttcaaagtcttgttagaattatccttggaaggaaattggatgaaaagattgatgaagcacagtgaacaaggcaagagtgaggtattctgtgtatgcgtttactaaaataaaaatgacacaccaatgcagggacacatcaaagcagaactgcatatcattcgcgtctttgcaaatcctccatagatctttcttagatatgtttattttaatgccataggcatataattaaattatgcatataaataattaatatttgcaagtacttcacgtggagacaaaacttaaaattggcaataatcctatagtagactgattttttgaagtataaagtgacaaaattgatcatgatctttgtggcatggtaaaaggctagattagatctgttcatttatttatttttaacttttacaacaaaggacatattaaaaatctggctttccatacatatgtatgtatatatgttcatatttatttataactattattaagatttagcatatattctttggaattttaaaataatttaaggaaattattttaacaaagttttgagacactgaggaggcaacaaaataaatatctcactactacaggaaattccaatttggagatctaagaaatttaggtagatataaggaatggcttttgtttctattaagacatgagacaataacctcaactaggatggtggcaatgacataagaaaaaaagcacaaatgtcattaacattttgaagaactaatatctgatagagtatatcaaaagaaacaaaggaaagaataaaaatgatactgagctttggaaactgggtaattaggagatggtaattgttaaaaatattaagtttcaggggaagaaactagctgaagggaaaaaactagctgaagggaaaagatgattcattcttcagtggatgaatgttgagcaaaagtaaaataattggacaataatttttttggagccaattagaatttagatgggggatcaatctagttcacaggtattacataaaaaattgttggaagaaattgatatagacccaaattggaaaggaaggagagagatggggaattatttttttaatcagttaggtgcaatgatgaggtagacacctagtgatattaaaatgccaaagagagaacacatgccgtaatggaactcggcttaaaagatggggtatgtgcactctgtgttagtgtatttccactggcttttttcttctggattcctgaagcaaacattaagaatctcctggatactataggaagaacacagaaagagaacaacatcaacaaaactagaatgttagccattccagtctttttacaatgtgaaaaccaaaaacccagttattgagaaccatgtctactcagtaaattcaggagtcatccaatcccataacagagttaagtagattagaaccaggcaagctgaatttgaggaccagaagtaggacacgtggaacacaagctacaaaaccgttctagaaacaattgaatcccgagaccctggctttgattagcttgtgggcctggaatccagcttggtagataacatggctttccagttggcaataaataaaagccatgcaccttcaagggatccagggcaacaacagaaaccagaatcagttatgatggaataggtcaaattccttcattcaactatctccattgtcgctgaaaactggaaactgaaactatcaaatatataagaatgggaaaaaagaagatacatgtgcatacatgcatgcttgcatctctatatgcatatgtacagattgtttttcatgtattattttagaaatccaaaaatttgttgtaatttaacaagattttactaatcttgaaggaatttaagtttcagaggctttcttgtctgtagaatttgtaagaaactacagttttgctaaatgtattcacattctgagccctctttttggcgttggtcaaggcctttgtcaggttgccctttagatgtgtgtttatggttaaattgatgaagtttagcgttcagagcaattcattgaccagagctccttcgagggggtaattttatgttgtttcattttgtctttctttagagagttccccatacccatccatccaaatcatgattggatgattttgaaaattgtaaaattttttgaaggaaattcttattttcaatgtaaagaatcaacaacaaagtctgttgagtcaaactcagagacttactaaaattaaacctcatggctttgaaattcatcaggccatgtccatatcatttaattcattttcggtgttatctttgtttttatccttattatatcattggaataaacaatttcttaacttaaaaacattgtaaatataaatctgctatacattttgtgtattattagttaaaaccacatcaaaaagaaacaaatgtcccaaagtagaattaacttatttgtaaattcacttttctactacaaaagtaatagcacgtcaataacatttagaaaatagagaaaaataacctgtggtaaattaaaatacattttcttcctgtcttttattcctgatttttagagccaattctgctgcttatactctgcaaattattttaatgtttcagaggcttcattttctgctctgggctgccttttataacaaggtcaggatgaagacccaataagaggatgtacctgaaagagctttggcaattgtagcacagagcaaatgtccatagcagttgtttctaagtgttttctaagtgttgtttctaagtgatccccaacattctatcccgctgaggtgagattaccatactggaatatgcacaatctcaaattcaactaatgtggcctaagatacccctgaatgattttggctcctggataaacattacacagaaccaggggtcatattgcttggagcaattctaagcctgttgagcacctctcccaaatatttctggtaatacccataagcaacaacgtggatccagatttagattcatggtccagaattggataaatatcagcacagaggaagccagaattcaaaggtgattaaagtgttctgtacctttttctctatgtaaaagaaggcataagtttgctaaaaggagggtaggatatttattttcccttcctgaaattgggcattttatacatggttattataagtgcaaatgtagactgcagactagtatataattcctcagtagctaagcatagataatttttggaatatcacttccactttttttgattaatccagtcacagcctatattttacgaccttctagaagagattgtggtttcctcagatataaaatttaaaatctaaaatgaatttacactaagcatatacatataaatttgacttcttgtctacgtaactccatatatttttttcttcttttgctaatgcttatttctgagtttacaaatatctttatatgaagtaatattttctgcttacactcctatcatagatttggatgaattgattagtgtataggtgaccactgaatttatgaatatgtggaatacattctcatattctggggagtattctgaggaatggtcatttcatatgccttaacgctattttcattacttcagcagcagctaagaaggatgaaaagaaggaaggtatgttttatgcaaaatcccactgagccttttgtgagtacaatttaccaatatcctgagttgggttttgactgctattctgtctatattccccttggataactggatctattatgtgcatacattttgcatgaatgtgctttttctacttcacctcacacagaagggtgagctactttttgaaagtaattttaatctagtctttctcaagatataaggaataaaacatagcttctcaaaatcctagggctcctactctgttgacagttttatcaaatttcagaactatgtaaaatacagactcattctcatcggcattcaaatcaaagtcttctaagcctttggggtatataaaacagtagtcaagtttcaatttcacagctttaagctttttatctgtttttttttttctcccattgctctgcctctcggatttttttgttctattttttctggcttatataccgcttttcattttttctccttttgaaacattgtccataatcaatatgcaatattggaggagcttgggatgagctgtgcttttgtagattcaagagatccagtgtccatgaccagctaaaaaacatataaaacactccttgtaggcagcaagactgaaatattggtatcagcttcaaccccatttttttctttttcccctgacatttagtcctccagaattttcacttttcctgagctatccttttgtttaattcttcctataataattagaacaactaatcatcattcacaggatccagttctttatttgtgatctcacattgccatttgtgacctcatgttggtcttactaacttctcatgtaaactagatcaataatctccaaaatcagtggtcaaggactcctgtgggtctctgagatcttttcagtggttctataaggttaaaattatttttataaatgataggaagttttcatttgcctttctcactgtcgttctcacttgagtgagacttctagaggataaacaatggtaataatacaacacagtaaacgcccaagcagatgtgcaaatcctattgctttctcattaaaccagacattaataatagtcacaaaagtaataaaaaagtcactcatttcaccatatttttgtattgggaagtgtatcgatcataaaaatatgttatttatgttaacatttaataggtttattatttttaataaatgcataaataataccatattttaaaaatttcctcagctttaatttttttaaaatgataagcatcaatagaaagaagctacgtaaataaaagctgtttgggagttttaatagttaagattttaaaggagtcctgaggtgaaaatgaaaaactttgacaaaaataattaatttgcctctaatattacctctttccaaaatagtcaacagatttcattcaacttttcatgtcataacctatttaaaatattgagtggctttacaatgactctgtagagtacactgaatgtactctacaagtgttaaccttcaattaaagtttttaaattctttttctgaatcgtctttcctaactgcctattaagcgtacatcaaggcaaggtcatgaccaaggcctaaacaattccaacagtaaagatgcaatgatccctttttgagattgagacaatttattactttcatagcaaatgtaagagtagccagaggttccagctctccaaggttgttgccccacacaccaaaaaggatgaagcccaaacaaaaggggccagataatgcaacacaagttggggacacgtcattgctgaggagctaatccagactacagcaaaatgattttgtggtctgcagctccattccaggcagctttaggcggaatcaggaggtgatgagaagctgcctcttgacatcctcctgggagagatagggagccatgtgggaggtggtctcacagcaggtctttacaagcctcccgtctttctgtgttctgggagaatcacaaagcatcctaccaaaacttaaattaactgtggttcaaaactttacctgcatggcctgtatggatatgtgcaaagttgccaggacatcatggtgagctgttatctgatattctcacccagttcttcctttatcatcttcatctgtaccaagtcattctctattttacatatacaatgtggcatcttgcctttgttcttgctgttatcctaacagagcttatcctttttccttctatgaacattcatacattttcctgtctctgagaagttggtctgatactaccaattaaaaatactttcctgcatgtataatcttccatttgtatctctctactattatttatttcttgccaccttgtacttcatgttacttgtgtttattttcctattactctaattgacttaagccttttgtcttaagggaccatgtccaattaacttttatcccttatggaggatgagcacatttccttggtttgcacatttctgaacaaatatatattctatgcacgcaccagtaatattcaggactcaagataaatataatacccagaagaaatatgaataggtacctgttttctcacaccacaggcaaggaatgatttttttttaactactaggaggtatattccagtgagctttttaggtttgggaagttataatcagctattgactgtccttcttaggtgtgtgtaatcactagctgctccttgaattctacgagcagatccaggtagattttattcatctaaactcagattgagtgatgaattcctagcaaccggaattctaggaattccaggttatcttctgaaagatagaaatccactgagaaccagccatatgagatttattttttactataaatagagaaaatagagctgaatacatgtgagaattagtcgctagttctatggcttccagattcagacccgaagataaatcatgctgaaaaacaaagcaaaattcctagtattatagttgactaaagttgtcaatcaggcaggttccacaaaggagataggatacttcagtactagcactagtaggctatcagaaaattaacttttcccttcaatataaattggtatttcattttctttctgtttttttttttctttttttttttgagatggagtctcgctctgtcgcccaggctggagtgggcacaatctctgctcactgcgagctccacctcccgggttcatgccactctcctgcctcagtctcccgagtagttggtactacaggcggctgctaccacacccggctaatttttttgtatttttagtagagacggggtttcacagtgttagccaggatggtctcgatctcctgacctagtgatccgcactcctcagcctaccaaagtgctgggattacaggcatgagccaccgcgcccagctggtatttcattttcatctggcatcacttatgaacataataggccttacttgagacactgctacagatgagtgaatgacggattgaacagatggcaaacacatcactgcttttaaatcacaggtgctgggagcctcaatgttcttaaaagactactgcccagattattgggcagggaagtatattgaccaagtaagcctttgtaatgttttaagctgtttgagccaagaatgctgaaagggcataatgaagtttaatagcatgaatattaccagctagtattaatagctcttcagggtcagtatgtgatctttggactccaagcactatatttttaagttcctctattactttagttctacatttctgttgcactattgactccaaaagaaaatacataactttatcatgacattttgagtttcatttgcctgaccctggacttcatatcgtgttttattctttcattttaatacaattgatatctgataaaatatattattgattcttattattaggaaatagaaaggcagattaaaattttagatattctatagttacatttattatattgaactttctgtacatattccattccagtatctggtcagagaatatagggattggaaataatcttgttctaatatgccatgtttcatcttctctgtgttcccacatttcccccaaactttaggttgaatttattcctacatgaccatgttctcttcataatcctcctgtgcttttcctgttggctgtattctggactcaagagattgttcagtgaggaacacagaactgcttgggcaggcagaaatcctatttcagtatagtggagtcaaactaactgacaacttaaaacggacattgaactatcaagttcataccttaagctgttgtgttataagattcttatgtttcaagtagaagtggccactgcatattgttaatataaaactgtattatgtcatattttttctgtgtatttgaattgcttgcttatccaattaaaataattattcaggaagaaaatgaataggaaaatgtttgcaaagcacatatgtttcagatagcaaatgtagcctactaatttaaaattcctgatgacaaactaaatagcaagaatatttttcacattggttttcagagctggggttaattaagaaaaatctattctaaaattattttcattgtagtgtgctggacacaacagtgtttaacaaatgatgactaagcaaatgttttgtctcaggaatcgattattttttaaaatcaagagttttttccccttacaaataaaacatattcgtgttacagaaaaatttgaaattcagaaagagaggtaataaaatcttgcctaattatttaatctgtccacaactaccattagtatgttggcatattttcttctaatctttcttcatacacactcacatgcacacataaagtcattttatattatgtttttatttttattttgcattatttaatttatcttatttagttaatattttccacattgtggcataattagcaaaacatcatttgaataattgtgtatttttctattgtatgaatataccacaaattcatcaacactctcttattgttcagagggtagtgtttaatatgcccattactgagagacacaaagcaatatcctgagaaaagcatttccctaaatatttatttttatgataatattgctttttttctctatggatttctagaaatggaattaccacatcaaaaagcatgttaatttttatgattttctggattcttttcttagtttgtttcctaaaatatgtttctagcttatacatctacggaagtgggacattaccttcaccacaatgttactggcactgattattattgttacataaaacaattttgttgaccatctaactgccttttgtgaagagacaatgagtccattgtcatatccaaacattttagttccctttcttcatcatggaagtgaagtcgtgataccaccacacctctgtaaggcacagaaatccattaacttgcaaactattagtgaatgtctactgttctaggttccaagccagataattataagccagaaaacaatttagctaccttttgcaggtatcaattcatagttcattattatgattctaatttcagtaatagagaatttaaaagttcttacagaaacagtaaaaggacaaagaagattaaaaaataaaatattctaagcaaaaattcaagctcaggtgcttcaatcttaaaacaaatgagcttaaaaacctcttgttttcattttcaagtggtgggagcagaaagtttcatggcctaaataatagaaaataataaatttatcagatctaggctgaatgcccgtctactataaatgaaatcgatgtcttttgaccacgaaatagacattactacataacagttataaatatagtgatgtattcatcagtaacccatgagtcaacagtaatctatttcttttccattaccataagaatgtctgaatatctatattggaagtgtattgattattcaaagacagtgcaacataattcacctggactgacttagattgaacaaatgaaagtttcaagttaacttcatgaactcctaagcatctttatggaaacagagcatatatttactcagtttgatgttctattaacaggttactaacttacataggcaaaacaaaatttctttataaattatatgtgggtatattttcctttatatttttcaatgttttatattctttataaaatattattaatataagatattttataaagagtttctcactcctgcttcactctaatacttattcccacaaaacagaacagtttctaagtctcatattctagaaatatacaaatgatcaatttgttgaataatcaattttatttgattgtttatagaaatttgttgtgagctgatcagctgttgatttattgtatctgttttattaataatttatctttgtgttttcagattccaagaaaacaaaaaaacctgcagaaggtactggacatatttctttttttctgccttatgtttgatgaaccatgaaacagcataccttcttaaaggattgatgtagaagaaagaattatgtgtgggatagaggagaagaaaaaatgattgagattgagagagagagagagagagagagagagagagagcgccaaatctattctgacaatactgctatgagaagtatttcgcagtaatggaaataaatactgcatatcctttcacagtaattgtttccaaagaaatgtttacttaacaagaaattgaaaaattttcagtatcaaacatttattttactagaaagcacacactaaattactttttgatagactggcatcaattaggaactgatttcttcctttcggtcttgaataattcatttggcaagtatacctgtgcctcctagacttgttcacatgtgtttttatgtgtttaagagactattacatatcaggtgtaaataatttaaaatggttaaacagtataatcctgggttaatttattgtcaaataatatttgccaatcaaattatggaagcacctacagtaattaacaatacctcagagcctcactgtgaaatttcacctcattgtgaaatttaaggagagaaaattggaaggaggggtgggaaaaattacagtctaatcaatatgtagggtagtacgttttatctttaaagttttaagagcaatgattttgtttgtatttctttcagtagaacaacccaagggaaaaagtaaggaaatgcatgcagtgtatttgtgtacttttttttttactactattatttgcctgctgctgtatttagacctgcaattttgaatccgcttttcctatgttttatgcatgtgaactctgttgttttttgtccaagtgaaaaaatacacagtctgggggttagagtggactgagaagcatagtaatcatttttagaactctttctcaagctcatgcaatcatctaacaatactcttgacgggcttgtaatcaaaagtaaaactgcattccattaacccaaactgacttatgtttttgtaaatttagtcctaatctggttagttgtcagtcctttgaaaattgactagaagttcttttacaggctagttttacaacttttttcctatctttctttttgtaatctgtagatattttggcatgcccatgtgatatatgacatttttcccataacataatttcccccctacactcactatgagctctgtctaatagggttgctattcagcctcatccactgttgctttaacactattaagactgtgtgctaacaattcagtcaagctcaataacttaatgtatgtctttcacaaatataggttctcctctgaagaaaataagatatatttaacaaaagaaagcaaaaaaaaaaaaaaacccttgaacttattcaatacactattaaaaattagcacattaccagcaatatagattttaagattctagtgatatcaaaaatgttttaaaatatataccaattaaaatatatttatgtgttttggccctacaaaaagcaaggatgctgagacattcaacgttgtaaaaatgctctaaaatgccctgtggagacactcgtgaaattatactacaactcagccagggggagcaatccatctacagagagttctctcagttccagatttacgtgtgtgcagagctactgatgagtactggcacagagatacagaaagcactctataaacgctgcaccagcaggaaaatggagaacaactggagattcgaaaaatagtattaaagtacatatagagatagccttaaggccctttattacagtttataagatttaaaagttcctgcacacactgcagctccttggcaatcttcagggcactgatgcacttaataaataaacatgccttttcacgcattcattcacaacccaactgtttccctccttgagaaggtcctcagattgtgactcgggcagcaataaggagaagaaatagttttcttcaaaacacctatcagttcttttcaaattcactcatttgctatggtttatcatctagacttgcttttattattgttagtgttgtatctttgaatttctttgatttggattttttatcttgagggttgctttactcgatggtacaccccaattttatattttattttgcttctacttttctaataatcacaacttaaaggttgttcacttttcagatatttttaattatggttaagggaaacaggatgaaaagtacaagagaccatcctgtacattttgtaaatgtttgtgagctataatttttttcaaaataaaaagtaaaagaaagagacctcaaaaatcaaccataaacatgagtttgcagtccctgtagagttaaagggtaaatcaatgtatatttactaaggtaattcaataattacaccatgagctatcctatataatgaacaaattagcacagctatttttcagctttctgataagattgaggggactttattttaacttttaatcttatgtatagctggtattcgattctgatgcatgtccaaatctgcttccagtacttttttgactgttatcactgtttgtgactgtcatcacaaatttcttggaaatgttttataattagagcttcagttaagcaataaattaaacaatgtatttaattgctcttcatttgccagacaacatttgataatgttctcattttgtttaattttagctaaatcgtcatagcttcttctttttgacctgcaacacttggccaagccatttgtttcatttttttgttttgctgcttaaaggctgtcttaaaagaggataagttgctcattataccacacttatttaattagaagcctgactaacaaaattgtatacttgggaaattgatgtgatgaccgtagcattctatgacactctatatttttaaaatatagtttgtagagttctttcagtatgaacatattctagtcttcaaaatctattcattaaataaaactttaagaatctttccattcttctttaaaatatcagataaaaatgtgggtatgttaaagtatttcttgaaaatcttcttttacattaatttgacaaggttgtcaaggcaaaataaataagaatagaaatgtagatgatagcacttcatgtaaaattagtgcttgcaattcttataaaattagtacttattataatgtaaatgtcagcttaatcttgagaacaaaataatgctttgtctcatacaatattgacaaaagtagattcctgaaaagaaacgctatataaagaggactccaaaaggagcatttgtcctaaaagcaaggcaaatgttttaccctgaaacttctttttctattttagtgtcttaaatatgcctcacaaagcctttgtcttagcttaacagctatttcttccatgtaagaagattcttagaagaggcagtccacgtgaaatgtgctaatcttcatctttctgagaattattttaaaataactgcaataagctgcggtgctgtggctcatgcctgtaatcctagcactttgagaggctgaggtgggtggacctcttgagcccagaagtttgagaccagcctgggcaacatggtgagactttgtctccacacacacacacacacacacacacacacacacacacacacacacactacaaatctggctacacatggtggtgtgtgcctgtaatcccagctacctgggaggccgaggttggaggatcaattaagcccaggaagtggaggctgcagtgaactagaattataacactgcactacaacttgggcaacagaacaagaccctgtctcagaaaaactaagcaatttcttaaaaagctgtaataattatcttttgtacttactattttgactcaaatttatttcatattgatctaatataatagcaaatttaatttttttcaccctttatggattctattttatttttctggtttatcatctgtaaaaaattcaaattcctctaatattcagaatattttgatgctgccccataaggaaactcccaagataaatggaaaaaagaattattttaagtatataatcttagcctttttatgtaagccattattagttgctgcaatctggcatcagcacatgcatgtttctttgtgttaaaacaattaagttgggattcataaactttagaataataacgataataataataacaataataatatgtttcagaacaggaaaagaaagaaaaacatgtggaaccaggtaactgtttttaaattcctctgttctcacaatttcataatattatttgatttgcaattgaatactgaattacaattgaatgacatagaatgctgatttttttttctttcctttttgatacagcaaagtcaccaaagaaagaacactcaggtgagtaagaccactgttgctggattccgaatactcatgtccagtgtttattaatgctgtagcctcaaacaggtggtaaggcagcgccagtaaagggtggggaatgcttccatctcacagtgttttttccaagttcttgacatggacataacatcaatgcagttttagaaaatgaaagccaaatgttacactcttgctcctcaatgtgtgttctgtgaactagcagcatcagaatcacccaaaatgttattagaaatgaaggatttttggccccactcaagacctactgaatcagagtctgcaacttcacaagaccctcagtgaattcatctgtgcagtatttgcgaagtactctttcacagtttagtgtaaaagcaaaacaaaacaagaacaaaacactttttgtaaatgcattatacatcgctttgtttttaaaatatggaataatcacttccagcaaatattatctccttattcataatcttacttaataacatttcctgagtgctcaggggagttgcagtgagagcaaaagtagattttgcccaaaatatatttacattctgatgagaaaaaaactgattgagagtcaaacaactagacaagacaaataaacctatcaacaaaaactaaaagtgcagttgctgtggataccaaattattgtcttgaagttttctagcatttaacctgcccaattaatcatttcaaatgaaaatttctgaaaccatttatatttccctcatttaaaactatcacctcttgattttgcctggctaactcctactgaaggagcttcactgagttatttagtattgtgtgtgtgtgtgtgtatgggtgatcataaccttatgtaatacctatcagtcattcttcccatttcattttatttaaatggaaatagcatctgctcaatcttatttaaaaaaccacgcaaaggggcccaactgtagtctcaccctaccacaaaccacggaaaactacaggtttgaatccacatttattattcatttttaaagattataaaatatcctgagacagcccaaatctgttttaagtgtctgtccaattacttcccatagtatcattttcttacttttataatatttcatatgctgttaaaatcgtattatcttttcccttttctaccttatatagtcagaaattagaagaagccgactgttttttctctttattcccagagcacctattgtaatgccaggacacattgggcgcttgatgatggcttattgagtgaaggaagaaacaccaaatagaacaattacatttttataaatttaaaaacagaagactttaaaataatttacaagatgcaataattgcacatttcagcatttcatattttcacagtatttgacctttgggaagaaatgttttgtctactttacagagaacaccctgttggttcagagttgcatttcctcaagcataacacatcttctcacttacgcatgtaagaagaacctaagatagtgtgtgcattatagaaagacagagagacatacagaatgactattggtgtagccagttttaaaagttttaatagttaaatattactgtctaatattgaacctgacaaaatacaataaattgcttgaaattattatctatttttttcagtgtgtgattacaatgcagcaacttagcagtaactagctgtagttcaaaaattaaaaccatcaatttgaataatttatgaagtgaactcattcttttcacactattttatagactttgaggaaaatgcatttgcctgtatataaaaaaatgagatccttggataattaaaaatggagagcaagatgattgatttgtaaatgaatattctgtgttgggagaagtatgaataacaaacaataaaattctataattcatggaatatatttggattatatcagaaaaatggcacagtattatattttccttttctcagatcttatttttctttagcttccaatattatacacacaatctttaaacaattaagataaccttacaattattttggaaagagataagcagatttgtaattactgttgaccttattatttcttgtcattaacagttccaagtgacaaacaagtaaaagcaagtatgttgaacaaaatttttaaagaagagcatatttgggcagcttactcatttgaattttctgctatagactatgctaatgctaattttgagaatggcttaccagctttttggtatgattatttgttgtgctgaatatgcaatattacttatccctgtcttttccgtgaattcattcttattaaaatttatctatagagctttcatttgttaatttggccacatcataacccctttgtgaagtgttacatttttatttctcattttgcagtataataagtgaactcttcagtacacatcagactgaattatcctaaagattaatcagttgatcaaaccagtaggcaacctaatttgtctactatgaatatcctgtctctaatgaaaggtagcccctcaacattttcttaaccattgctcttggaatgtgacaattcccttttaaggtttctattcttggattatgaagtattaactgataaccataacatactgtggcatttgcagcaatggtaactttgacaatatgcttaggaaaaaatgctgagaaattgttgatatttcttagtttgatgaagtaactgactgttattaataaaagttattttaagcataatggaaaatattttgccttaggaagaaatacataagctttgtatataggatttaagtcagtcctcagttctatgcgtgacatcaatgtgcttatatattttttgagaggttagaggtaaacaagtactggtgatgctactaatacataaaacaaatgcctgttatttagtgctgaggtttttttttgtttgtttttttgtttttgtttttgttttttttgatggagtctttctctgtcaccaggctggagtgcagcggcgtgatcttggctcactgcacctccgcctcctgggttcaagtgattctcctgcctaagcctcccaagtagtttttgagacatattatgtcagtagatacatcagataaaaattgaaaaatatattgagtagcttgataggaatgtctttttttaaaaaaagttacagtttgaagtatacacatagacattgagaactttacaagagaggtttaacatgaatctaaaattccatttatatttccatgaaaatttttagttaaatgtaaagctgattggaactctatattatggagtctttgctatgctgatacttagtctgtagaaatgcttaatcaagaaaatatatcaaacaaatctgataattttgtagcactgggagagagctttagattgaagattgctctgaaaatgaaaatcttcttcctagaaaaatgtgacatatagataaaaatattcatttgcaataaaaaaaaatctgtaagttctgctatctatgaaacagactatccaatcaggttttgaagagatcagcatattttgcaggaaattagcaaattagcttgccaaatcatcttaaacacaatataagtttcataagagttaatattctactccctatatggttgagagatttgcacttgacatggccattatccttcaacacaaaaattaatttgatataattcacaaactgcttaaattatctgataacaaggtgaccagccattttcccaactaaaaatgtattttggcattgaagtcatacagcaggagaatttttactcagctgctacatacagcaggctacttataaagttaatgcctaaaatgaaaattacatatcattatagataccattgaaaagcctttaaattatccatatagtatggtgcacatagttttctgtatataacctgcacatttgagatatgattttacagtatgttaagttgtgaggtcaaatgagaatgatagagatagataatttaacataaactatgtatttatgtgatgcaattccataatgttgaatttaaagggatagatgagattgacagggttaaagtcagtccaagaaaaaagtaaaaggggatttgtcattaagactggattaaaggccataactggaaagtggattgagtttgtagtatgggattgtttactctaggtcctgaggaaacacccgaaatcactgtaggaaaaatactggaggacatggacaagcttgggacgtacatcaccttcagaatagagcatatattagtcccttttcatgctgctgataaagacatatcccacactgggcaatttaccaaagaaagaggtttaatgaactgacagccccacatggccagggaggcctcacaataatagtgtaaggcaaggaggagcaagtcacatcttacatggatggttgcaggcaaaaagagagcttgtgtgagagaactcccatttttaaaaccatcagctcttgtgagacttattcactatcacgagaacagcatagggaagacttgcccccatgattcaattacctcccactgggtcccttccacaacgtgtgggaattgaagatgagattcaggtggggacacagccaaaccatatcatagagtctcatagtaacatgagcttcaagaaaatgaaaacctttcagattactggtgcgatgctaaagaagagcactccatgcttccacatcgaaagttatgtgtcagggtgtggtgtggatgaagaaagtgtaccttgggctaggcagggatgctgaaactagactgacaatttctgcaagtcagcaaagactcctttatttatcatagtgtgagcaaaaatacctcaacacacccacctcccctacctacattcccctgcatgtgcctctccacacattggatagcaacacagaggttgacaataaaattagtcatttccaagcatggagaggacacaacaagtagatgtgtagactgtagagtgcttcatggctttaacactgtatatatggtgaatcttcaagaagaaatatagtagacattgtttaccaaatatatgtgaccacatcacccctttctctttcaatgatcacatcaaggatcactatttttcagaaccttgggtagcactgtcccaggtcactttattccacctcaaggaccttagggctgggatcatgtattccatatgcatggtcagccagccagtagtcagtttgaattttgaggaaaatagccaccaaagcccaggataaagccaaaatatagtcatttttagctctggatctaataatcaggcatttttcaccccttgattttagcattgcacagattgggtgttatgttcagccaccgagcctgactatatttatctccttaaccacacttcagtgcctaaatgtgagtcagatatctatcatctaatctactaatatatgtcaagatcatttaggagacatctgtatgcagaatttaaaagtaaagtcccattgaatttattcagctatgtatgttagaagaatatttggagacaactgctcttaataaaattgcatggttttttttttgactcagtttaaatactctggcatggaaatggcagaagtctccgggaagatctataggcctgaaccagcatgcttgatataaaatgagttgtctctagaccacacactgcatgccaaatataatcttggttgatctatgtatgatcttagtcagttagaacagtcttggtgtactatattgtcccagaataattattacttgcacctcttttcacttgctcgattttgtataatatattatataattactaatagtatcacagctggtgctgccagaatatattcaaaacagcactcatacagcactagagtgatgattttatgaggtttaagtaccaggaaaggtaagatgtgagagacctgggactgccttaggtggtagggtaaggcatgcttcttgtttaaaactatgtgtaaagatgaggttggtgtcctgagtgccagccccaaactgaaaatgccatggttcagagtccaagaatgttcatcaaggttgacacaaagagctagactgatgaatactgacagaagtaaaatctaggttcagttaagacatgaagaggtaggggagaaagggacaggatttcaaatgggaaaccagaaataaattttagtatttaaaagtgacataatgaacacagcaacatggcactataaagcatggctattgagatcaggactatgtgtcctaagtgttagtaataaagcagtccccagatattgtattataaagggtagaatggtattggtgtagatataaacaaatttcccaataggacggaaaaaaagagacttaaaatacatcacacttgagcaaaaatctgacataagaaaaagcagccatttcagaaagtcagagtgtggatagattatttttaaatgttgctgatatagctggtattcaatacaaaaatataatttattcttatttcatacagttctaaaatatcagttccaaatggttcaagaacttaaatactaaaggcaaaacatggcatagtttcttttaacctaggaaaatatacagtttcttgaaatatgggaggatttgaaaaactagatgttcaaaattctagtcatacatttaatagctgacattttattgtattaaaattatgatcttcaatttatcaataaatgcaataaagaaagataatggacaagccacaaacttgtaaaaatacttgtaatatatttaaatagcaagagattaatagcaaaaaatagatgaacaactccaaaaattaaaaaaaaaaaagacaaagaccttgatagacaatgggcagaaaaaaaaatgggcactagatataagactgcattaaaaaaagaaaaaatgcaaatgttctataaacgtatcaaaagatgttcaacctctaagtaataacggaattgtacttaaaagtacaagatagtattttacatgagactaaattttcaaaattagggaataggcttattctggtgatggtagtgatacggagcaaaagaaactctcacgtatgctgctgatgtgaatgcagaatttagggagaaaaatgtgtcatttatctagggtacatgcctagcaatttcacttctatgaaaattattgcacatgtgcaaaaggagacacatgtgcaggaatgttcatagcagaattatttagaaaacacaaaactggttgtgacctagtgtccactggcaggagaataaatccatagtttgtagaccaaacattggaatgctagacagcagttaaagttaatcaactacagctactcatatcaacatagttatatctcaaaaaatcacacaaattaaataatacagtttaatttatataacactaaatattataatgtaatttaatttatataaaattatcttacctttatttagagacaaatacatgtaataaaaacccatatagaaaaataaggaaataattattacaaaatatagaacaactgtaactttgagatagagaagcgtgcagtgctagtaggaaaagtaagaagtttcaaaggccttggcgatattctatttcttaggtgtgcaggaggttacaaaggtgaacattctttattgctattcattagaatgtgcacaaatgttatatgccttctgtttatatgatatctttcacaataaaacaggtttgaaaaacagagagtgagaggatagaagtggtgacattgagtgtagcagctctatgcagagagatgaggtagctgaaaatgtcatatagaattgaaggatgtggttgtctgtgtctctaaagagtgacatgagacattgtgaaagcatcagtgaaggagaaaactgatgagggagcagatcgaagcaatactggcaagaacaaaggccttgacttggcaaaaggagatgggatccagaaaaaaatatggaaggattggtactaaaaaggggcaggaactgatcaccttttggaactggaaagaaaaatggatgagtatgtgctggtgtggtagtggaacagtgatgtaatttagtctgcccctattttctctatgaatttctcaacagcagcttacttttatgttgtaggatgtttaaggagggaagagaatattttcaacttttgttaagagtatgagaaagcaactttattgggtctgtggtaatattactggccagtgctaagtgatctcataaatgtgatccacatttgaagtgaggtctgctgcagggtgggggtcttccttcagcttcgatgactgctcaggtggtaggcataaagtacatttggtgttttggcagacatagtgggttgattcgtgcctcccaccaaaagatatgttgaagctctaccctggtacctatgaatgtgaccgattttgaaatagggtcttcatagatatactcaagttaagatgaggtcatgctggattagggtgggccctcaatctgatgactggtatccttaaaagaagaggaaatttgggacacacagatgcatacagaagactgccacatgaacataaaagcagaaattgcagcaacgcagcttcaagccaaggaatgccaagggttcctggcaactagcagactctaggaggaggcaaggaaggattcttcccaagatcctttagagggagatttctagggtcctgccaatgcctgaattttggacttccagcctctagaactgtggaaaaatgtatttgttttgtatttatctacccaatagttttaaggcagtcctaggaaattaatacagcagatgactataacaacagaaaatacgtgagtgatttaactatggctcatttatgcataagcttggtaagaagtaaagtgaggatatgaggaaaatcttgaaaaatgagaaagtggcaagaacaaggaatggaagtattaatgggatcagataccgtataatgggagttcttgtgtaagtgagctctaaagagaaaaaaatggtgccaaagaatataatttttaaaatcaaaattctggcagtaaaggaaaattctgagggtacaaatatagttggaaattgccagagaagtggagtttctagttttctgaattgaggaggccaaggaggtcagagatcatgtaattgtatgagttgtgtatatcagtgactcccaaccctggcaaaatattagagtatcctggaaatcttaaaaatataccaatactcagggctcacgccagactcattaacttagaatctcaaagctctgttgcccactccagatatctgaatatcataggcttagaaaaactccccagcttattctaaggtgcagacagggttaagaatgattcttaataatattcatagtagtagtagagcagatgataactgtgtgcaaaaatagtcaatgaatgtcaggaaaggccacaagactggttgatgacaacaatgaagaggagtagagagtggtgcaacctgatagcatgtacttcaaaagaactggggtttggaggaagcaaggagataatctatgaagagtaatgagaaacaaagaggatataaatatgcattacttctatacaccttggtatgtggaggatggaaaaacaagcattctccattttagaagactaccatcaggaggggatacagtggccttagtgagctaggatttgattaaaggaagaaagtaaaatgaacattctgagaagaggctgaagatacaggagtgaatgctgctgatggacagaggacacagaggaagggatttggaagtatgtcagcttctaggagaaatacagagccatatggactctgttttctgctagaaggctgaaactcatggtagtaactgaggtaagtagggagggggactcacagtaggaatagtcttgactgattcataggggaaatttggttatcagtttccaaagtgcggtccaaatcaggagcctaagcatcccctgggaactggttagaaatgcaggttctcagaatatgcctccgacatactgaatcagaccttttgcgctcagcatctgtttcaatagccctccagcgtgaacctgatgcatgcttaagtttaagagccattgatctaaagtctttacctggaaggtataaaacagccaggagtctgttcagtcttgaagcccagggtattgagatagctcgaagaagaggttatgtatgtcacttcttgcctgggtttaaattgtgactcttggggcatctatcattgtggaattaaaacctgaaagtgacatgaagatctccttctgatgtctgatgtctttcaaaagccgggttttgtggcacagagaggatgaggggtgtaaaggctcgccttgtttgatttggttgttctcagagcatcagtgctgagcatatatgggtgaagggtgatacaaacaaataccaataagaataaaaataagaatatatatgaccaaggggaacaacctcaactaatcaaaagttataaaatgaggaaataagacttcgtgaaaattcacgagcttattattattattattattattttattttcctgtggactagagaaaactttgactttaactagctttgatttgtgatccaatactctgtcctagccccaacagttcagattatgacttcagggcagctctcctgtcttccactctaagtatttagagaaaccaaaaggccactttttgtcattttattctctttgtctctcttgaagaaacattcaaatgaaattttctatgatattacagctaatcttttacagtgtaaaactaattcattgaggtcaaatattgtttgcttgcaatcagtattaaacaacttttagcagactcaaccatgattaaaagctaaacaaagaagcccttttaaatgctcttctctataattcatatgtaacttaaaatttgtagactatggccgggcgtggtggctcatgcctgtaatcccagcactttgggaggctgaggcgggcggatcacctgaggtcaggagttcaagaccagcctggccaacatggtgaaaccccgtctctactaaaaatacaaaaattagctgggcatggtggcgggcggttgtagtcccagctactcgggaggctggggcaggggaattgcttgaacctgggagggagaggttgcagtgagtcgagattgcgccactgcattccagcctgggcaacaagagccaatctccgtttaaaaaaaaaaattgtagactaataaattagtatcccattgtattgaatgtggccttaattttaagaactattgatctaaagtctatggaataggccaccttcttttatggtcactacctacatttttaagataatagagttgcaccttggaagagaatttctttattgctatttaaggaagtttattaattgaaaaaatcatataagcactttgtattttggctttctctacagcttgctttgctctcatgtgcaacatacattttatctttaattttattctcaatagtataagatgtgaatttggcatcactaatatccacttctcattcctttaatatctgaacttgcagaaactgaacgagccaaagaggagattggtgcggtttcaattaaaaaaggtaaatgcagcttaaagataaagatgtcataactataagttatttctgctaaggtttctaacaatgtattgttttgtgcttagaaaagagctctatttattgattttactagttcgttgatatagaaacaaacctattttgcacaagattttatcattactgttctaaagcctatagttttattcctttaggaccataaattaaagctagttatgctagtcaaattgcaagttaattttgaaaaattatagaaatgtaactgtttaaactccataggatccccatcatctggagagcattctagtgcaacatactgccttaagagattaggaatcgaacaaatgaaactttaactaaaagtactcacatgaacaagattcactttgttcaagaatagtataaaattatgaaatgtattaggtgagatgctgacttggagacattttgctttaagaaatatattgggaagtctgaaatgaagtcaataatgtagccaatgtctttggaagtatatcaagagacaatttaataagcctatcctcaacatacactgatgcatacacacacgcaaacctgcacacatacccttacacacatactccactaaaaccacttctcctaaaagactaatttattgcacatgctttataaagaaaacatataacaggattgtaggtagatagaaaatatatatgacacatattcacatactcaatcccaaacaatgtatacatatgaatataaatgaatacaggaatgtaacttaatatctaatataaatttatgtttattgatacagtataaattaatgttagctactctataaattaatttattgattattttatatatacatatatctctaagggaaagcaacaaaaattagtgaattctttaagaaaaatatgaactgtatttgcaggcaataattagaagcaattaagttattgaaattaatagatgctctctttcaaatacagctctattattctgaatttacagtagatagggctaaaatctatttcctagtcatttctttttcttataatctaatatttgtgatgtcagtttttagctaggtgatcatgatacatctttcattgacatcatttgtactataaatggcagagtaattcatttatcagaagttattgttaatgcggtgtcatattctggaattgacattgctcattagtattaagtgaaatgtgggttaaacttgtttgcttcaaaatgagtaattgtattaacaagaaaaaactgagtcttaatatagtgtcagagaaaatcactaacatagacatagatacagagttcatgggcccagtaagtggacttaaggccaaggcactgatttatgttgaaaggacaaaagtgtggccaacttatgttcaaaaattagacaaagctaaaagcaacaagatgtccaaatagcagaagataggtttcttttggagtgagattttatttttattattttttaattttttgagacagtctttctctgtcaccaggctggagtgcagtggcacgatctcggctcactgcaacctccgcctcccaggttcaagcaattctcaagcaattctcttgcctcagcttcctgagtagctgggactacaggcacgcaccatcacgcccagctaatttttgtatttttagtacagacagggtttcaccatgttggccagggtggtctcaatctcttgacgttgtgatctgcccgcctcagcctctcaaagtgttggaattacaggcgtgagccaccacgcccgactggaattagattttatatacagagccttagtgaatccatgtttgtggaagacagtcttgagacacagttaagaagcaaaggttgaactcctggtagctgatccatagactctgcgctctgcatcaatgggagcctggatattgttagaagaaaaccttggccaaattatatttaacacagtttaactgagcaaaaaatgattcatgaattgggcagcttcctgagccagagtaggctcagagaaacttcagcaaagcctcgtggtggaaggatttatggacagaacaaggaacatgacatacagaaaaagaaagtgagatacagaaacagctagattggttacagcttgacctttgcctcttttggacacagtttgaacagctggttccctttggttggccaaaatttggtaattagcacaagagtagattacagcctgtttctacctccatttgggttcactatgtacagagaaacctctacgccaaactcaaaatatgtaaggaggcaacttcaggctaggcttgattgaacagtatttagggtagaaatataagctcacatagtatggggttgaatcaggacaaattggagttagcacatagacagaattgaaattgaaccatcaattagtgaactcaccagagtcctcaactaagaatggtcactgagtttatagagtatggccaaacattttggttggggttacgtagacttgcttgtcaggcttagagggaagtgaaaggaaataaattatctatctattcgcatgcattattgacatcaactactttgcttctagttggtcatagatctcataccccaattctcaatttaaatataattctacatattgagtttatttgcaactacagcacgaacagaaataagtgtccttttcaaagcaaccatagctgttttgaaactcatgaagggttttaccaatttgacaaattacaaacaaaaatcaaaggatacttttctcatttgtcaagtaacttgttcatctcctacctctcactgacaatcagccgtgcatgaaaaaatatattgttctcatcatgtatttactacccaatccccaaattccacaatacttagcatactttacaactggtccacctctagcctttcacatgtgagtagaataagcaagtatttttttttgtttttaagatattacaaaattgttctaaattgaggcttaaactaggaactgtgtgcaatgttaagtggaaattactaattttgtaattgttttaaagtttttgaagatgaataataatttaacattttaaggtgttcactgtaatgtgtcaatttatctgcagcataaattgtcttatcttaagcctacttttaagtcatattttatttggagatacatagtatttagtcattaatatgatagcagcttgctaatttatatctgattttcaccttgcagttttctaatcattttcatatttactcaccatatatttgtggattatatattatatgaaaaatcgagaaaaattttaaatgttaatattgttcttgagcaatttaaaatactaaaaataggtgaaactttattaagtcactaagctggcctgaagttttactgtcaatgaaagttttttgtattaccatatttcaaggttgaaagccatcagggtagagatataaatacaggtaaagttctacggaagtttgaaaattaatcttacctggggaaaagacaatgtttacggcagaagatgactttagagttaagccttaaataagagatggggttttgctatgtaaatgagttagaaaaaaatatcctgggcatagatttcagagcaaggcaaagtgatacaaatttgtagtatgtatatgaggaacagtaattatctcaagaccattgtaggaattaatataaactgggctaataatgccataaaaggccttgttttaaaattggactttattccatgggcaattagggaggtgatgaaaaattgtaagtatataaataacactcaaacatatgctttagggagagtaactaataaaggaaaattttgaaataggcagattagaaagattctcaacaatgtagtgaaaagtgttaggacctggactagggcattagttatgagattggaagagagagagattatgttagcactaataaagaagtatattcagtggaatttcacaactgatgataagctttgggagggaagaaaagaaaaataatttaatgacaatagcgttcttcagactggctgccagaagaatattgttaatattcttaataacaatgaaaaagaaaagctaaagactttggagagaaaaggcaagattaattttacataaatttaagtcaaagtgctagtagcacatgaaggtagcatcacataggtggttctagaaataaaactagagctccagacaatgataggctggagatgtatacattggtgccctttgcatggaggtaattgagcttgtctggtcatgatgagataaggtaacatttacatttgcatttgtttggggaaagaacaaggaaaatcaaagataaaagcagactaaaataacttcagtaactgcagaaaaaaaaacttccaataggaaggtgatggtcatgggatttgtcaggtacataatatattaataattttcaatacagaattttcaggggagtgacatccaaaaaccctaaagggtgacaaattgaatgaggaaagagggagtgaagtatatgagaaatgatgatgaagatagttggctgggaataaaaaatagtatagtagctggtgtttttatttaacccatatccatctctctctctctctttttttttattatactttaagttctggggtacatgtgcaaaacgtgttttgttacatgggtatacacatgccatggtggtttgctgaacccatcaacccatcatctacattaggtatttctcctaatgctatccctccctttgccccccacccaccgacaggccccagtgtgtgatgttcccctccctgttctcattgttccactcccacttatgtgtgagaacatgcaatgttggttttctgttcttgtgttagtttgctgagaatgatggtttccactttcatccatgtccctgcaaaggacatgaactcatcgtttttttatggctgcatagtattctatggtgttcaaccattgtggaagacagtgtggcaattcctcaaggatctagaaccagaaatactgtttgacacggcaatcctattactgggtatatatacctaaaggattataaatcattctactataaagacacatgcacacgtatgtttattgcggcactattcacaatagcaaagacttggaaccaacccaaatgcccatcaatgatagactggataaagaaaatgtggcacatatccatctatcttttaatctcagaggtagtgtttctccttctcttcaggaccagtttctccagtttttccttcaaatcagtcatccataccattttgtggcgtcctcctctttcttgttactggcattgttcctcatcttggaaatgttttttctctgattaaaattacttcttttccttgatttacacctctctctctctccctgtctctctctctctctctctctccgtctctctctctctctttctctctgtctctctaccactttatctccttcccatgtcagccagctttctgaatgctggaatcctagcactgcctctggccttccacaaagactaagctcctgtccctaccatgccactgaagctccagccaatgctgatgacatcatcattgctaagccaacagaatgcttccatccttatgttactagatttctcagttgcatttatcactttgtctcttctccaaacttctctgttgttgggctaccatgacaatatagtcccctggttctctccatatgactggcctttatttctggcttctttgtgttttttctttcatctgttgcctcgtgattgttggtgttcctcataattcattattaatcctctgaacttctcattctgtaccatttccttttgagatatatctgctctcaaagttgaaactctgccctatatcatgaagttttttcaatcctgtgtccccatctcagaattttttaatgaatttcaggcttgtatgttcaactgcccaataaatatcttcaaattcagcttcacaatagctaatgcatgctgggcttaatacctaggtgataggttgataaggtacagcaaaccaccatggcacacgtttacctatgtaacaaacctgcgcttcctgcacttgtaccccggaacttaaaataataaaaaataaattaaaaaaaaattccccttcacggccaggcgcagtggctcatggctgtaatcccagcactttgggaggccgagatgggtggatcatgaggtcaggagatcgagaccatcctggctaacacggtgaaatcccgtctctactaaaaatacgaaaaattagccaggcgtggtggcaggtgcctgtaatcccagctactcgggaggctgaggcaggagaatggcgtgaacccaggaggcggagcttgcggtgagccgagatccggccactgcactccagcctgggcgacagagcgaggctctgtctcaaacaaacaaacaaacaaacaaacaaatccccttcacattcaatctttcttaacctaaagtcctcattttctctttccaacttactgtttctgtttcttgagcatattttctcttatttgtagccattactgccatactaattcaagccttcattgtcttctaccagaaccactgaaataacctcatgctgccctcatgtttttatttttattccactaatattcatctagtagaacatcccaatggccacaataatttagtaagaccacaaaactgaataagccacttaaaatttaatattctgttcccctgttttccataagataaaaatccaagcttgttaaaatggcatatagagtgccccaagaactggctcctatatccttttccaacttcatctttagacatgccttgttttctatgctacaacaatcctataatgctatgttcataattccgactatgttagaagactgtaggaagattggagcaggaagtgatagccttgtgaacagattaagtagttagcatcacctgagaattgacgagaaacctctgtttccactttccaccataatatgtatctggagactaaactgatgcaatattttttctttcataattagtgatttattccaatgtttcagtcaatgacctctcggggcagtacctgtaaaatctgaatagatcatggacagttcttatatttctggcagtatcttatatttttggaaataatagcattctatctttggaaataatagtttatcatgctatggctgtaggtctacctctccgaagtaatatgtgtcatatgagggacacttcaaacggcacaatattttcttaccactcctcacttcctcaccactattctagcatacttctcctccaggtaagtctcacttctccatttaaacgtacctactaggctgggcgcggtggctcacgcctgtaatcccagtgctttgggaggccgaggcaggtgaatcacctgaggtcaggagttcgagaccagcctgaccaacatggtgaaaccctgtctctactaaaacaaacaaaacaaaacaatacaaaaaaattagccaggcatggtggcgggtgcctgtaatcccagctactcgggaggctaaggcaggagaatcgcttgaacccagaaggcagaggttgcagtgagccaagattgcaccattacactccagcctgggcgacaaatgcaaaactccataaaaaaaaaaaagtacctgctaatactgctaataaagggcatacatcagagcccccatgggtgatacggagaaaaaagggagggatgtcaattgtattggagaattgggtgctgaaggaaaattgtagggaagaatagtgaaataaaagcctaaaacataaaatcaacgtcccagctcccagtttagctaaagaatagccctaatctgggcattacataccaagtgtgttagctgctttgtctcctttacattagttttgatttctgaagtagtgaaataagaatctatttttttttctaaaatacgcttctacaaaagtagaaaaaagagaatttcttcactcagcactaaaggatattccagatatcttgtggtatagaaagagaaactgatgacggtcttcttttgactccaagaagttaaaaaattcacttacttagatgagctgtttatttctaatgtttgctcttcatagaattagaattgatgaattttacattagaaccagaaaagaaaggatcaacattttatgtgaaatgttatcttttctgtatagataatcagcatttccagtgaccttttctgagcaacaaaaaacatagcactttaagggactagccttctctatttaatatgtgtgccagaaattatgaacccatcgttgaaaagaaaacttggtctttatatgtaagtcacacttcagttgttttctgagacatttacccttcaggggattcaattaaaataactaaaaaatatgtatttcctaaacatacttataatgattattctgaataaaagaattatgaataagaatacctacctgtgtggctctattatagttacaaattgtcagtgtttcatttccatgttgatttgagacagaacattcatagaatagactcaggcactacacatcttactagcctcttatagcgtacattgtaaagtgtagctctaatttggctttcaaaggtttctgcatttggtcctattctctatttttagactatcccttatctcctctctggaaatcctctgctcaaactacacttcctctaggaacatctaagtctttcccactcctttgtctttcctcatatatcattggctatacctaaaatctccttttcctggaaaaccactaacattgaaactgatctcttttctctttcaactgaaaatatttattatcaagacatatcttttgtcaagtgatacatttaattacaaaacaagtctatattaattaattattatgttaggaacaattctagatgctatggtaaatgtaagtaatacatttctaagtattctataagtcaaagaaaaaagtgggattttggagatctaatgaacaaatgtatgataaaatttatatgcttttagaaacattcatcagaaaagaaaaaaggcggaataaaagatagctaagaagtcaatattttttaattcataaaattaaacccaaggaaagtagaaggaagagaaataaatgaaagagccaaagctatttatttagaaatcaagtagtacaacaggaaaagtcaaaatattattatcaataaaatacaataaaaattatgaatgcttatgaaaatatattaagaaaaaacagagaaggtacaaaatatcaatatcagaaataaaaagggatcatcactacagattctatagataataagcaaataaaaagattttccaataaactaaaacattttaataaaattaaaattttaaatttataattgtaattctattcccctccctcaattttagccagatggtttcactggtgaattatttcaaacatttaagaaaaaattagcaccaatcttacatcaaattttccagagaatagaaaaagaggtaatattctctcattatatggggttagaattactgtaataccaaaacttaagtagagcaacaactatatatatatatatatatatatatatatatatatatatatatataaacttcttgtaaacctagaggcataggtctaaacaaaatattagcagattaagtctgctagtacgtatgaaagataaaatgcagtcaggttggtttaatttcagaaatgcaagctcaaaaaattaaaatacatacaaattgatgtaattagccagaataaaaggaaactatattcatcatagtagatacatttgatataattcatcacaagaatagaaacttacttaatctgataaaacatctgcaaaaaccattagcaaacatcatacttaatggaggaaattaaaggttttccccctgctaatcaaaacaaaataaggatgtttgcgatcaccagttctatcacacaccatagtgggttttccatccagtgcagtaaaatgagaaaaagaaatcataaatatgcaaatagagaagtaagaaataaaacacgttattcacaaatgatatgattatctacttaaaaaattcaaaacaatctatagaggaaaattgctacaactgagtgactagcaagttttctgcataaaatgtcaaatgaaacataactgctttagaaatcaagagcaaaactttggaaaataaagtgaaagatgactacaatgctgttctaatataatagcatcaaatccataaaatatcttgaaataaatgtaacaaattatgcataatgttcttgaagatctcttacattttaacatatttgagaaattaaggaacacaaaactcaatggagggatattttatgttcaccaatcagatgacttgattttgtaaagatatcaattctcaaaatgatctattaattcatcataatcccagtcaaaatcctagcagatttcttgttgttgctattgttttatttaaattgataagctgactcgattttcatatgaaaaagcaaatgtctaagaatagccaagacaatcctgaacaagatcaaactggaaggtttgtagtagtagatatcaagaattatcttaaacctacaggagtaatcaagactgagtggtatccattaggaaaaaagtgaaattttatctcacaccttacacaaataataattcagtggattgtactgctaaatttaaatgattaaaaattataatgctaccaggaaaaaatgtggaaaatttagaatatcttataaccgtggtggaggcaaatctttttaaatagaatacaaaaagcattagttacaaaggaaagattgatacattgaatttaattatcattgaaactcctgttaacgtaaaccagagagaaaaaaatgtaagtggaagaagacatttacagtatatgtatatatgtgtgtatgtgtatatatatatttaaaaagactcatttagaatattacagatgcatacaaatcaatgtaaaaaacattaaaaaattaggcaaaaatctaaagaggcactccacagaagaggttatctaaatgctgataagtatatgaaaagcatgtggcattattaggtatcaggaaagactgaaattaaagccaaaatgtgatactactgcatagaaagactgatatttttctaagagacagtagtaggatttgtgcaatttaaaagaaaatagttattttatttattttattttattgttacaatgtaagggaaatatattaattaaattaggccatcctttccctacttagatttcttgtgcttccagagtcctattgctggtgcctgaaattctggagaagttctagctattatctcttcaaatatcacttcttcctcacactgtctaatcttttattttataagttcaattagatgtatgttaagatgaattctatcttctatgtctgttaacctcttgtatattttccatctttttgtttctctgggatgaattccaggctatttcttcagatatgtatttctacattgccctttactccttacttacatctaactaatctatgaacaattttaatgttatttttatagaaattttctttatttttcagatttaatttgccttttaaagaaaatgtattacagccctaaaataagattggatgaataaacaggagtttgcctgtgaaagtgagatgattgtgttttaggcaaaggttaataaaataataacagcttctatttaatgagttatgtggctgccactgggctgatttccttaaattgttttcacttagaccttaaaacagcccttgtagcattatctgcatttttaacaaaaagaataaggctcaaggtaaaataatgtgcactcatttttgcagaaattcagtggcaaaactggactgtgcactctaaaacattcattgcttcttcttctaggacacataatcccttagaataaccagaattgtggttgcccttcaagggaatttgataatttcaggctaaactgcacagttcttttctggtaataaatcagttctggaaagtcacctcaggaatatcttgggacttgtgcctttatttcagcattgaaggccaacttgcctaccccttcccactgtcctaaccctaatattgactataatctaacaaaaacagcaaaataaagagcatagcattcattggtatttaccctataatatcttgtgttatgtaagatttatctacaggtgtgatctgtgaggttcatacatatttatttgcttttagtttaacatctcccttgcttcacagtcacatggtttgctctattttggggtcataattgggtaaaataataggttactttcctggaaatatagggaatttttttctaaccagtgcatattcaaatttttggatatctgtttttttcaacagatataattaaaggtgaaattcacctcctttttttccctccctccctccttccttcttcccttcttaattacactgtctttttacaaagatcaggaccagttaccttatagacatttttgattggtctaattatttcttcacaatatggtttaaaatgttctatacatcctgtatttgatgaaactgaaagctaaatctggcttagctaaatttcagttggataccttggaaataatactttagagatgatactgtatatgctacacggcatctcatcaggaagcaaaagatgtctggatgtcctgatatgaatgaatgtttctaagtttcatcagtgggttaagttggctacagacacatttcttcattttaaagttgtattttttcttctttcagttttatgtggggtgatatttgggtgcaatagcaataatcagttcctcatcaatctttcatttaatggttgctaatgaactctgaagattttcttgaatcaattctttcaatggagtgcactgattccaaatgaatcatttgtactgttctacttttggactgtcaactactgtaaataggtaaacagtgaatacttcactgagagcaaaacatcttagagaaaggggtacagcacccaaataatccccttttggttactgatgatttgggatggtttcatttaatatttaaatgaatctcaggcatgactacactattgtttcagctgattaagctatgttaagcacgaatataaaggagcatctagttgacatttacaagacactaaatgactccagcaataacctggaatgcaagtagattaatcatagtcctgtcaagtggaattctatgtagagcttgtttatcaaagcggagtgtaaaggaataaaacagatacaattgtagaaatgtaggcagaagattatcacttttttctttaattctttagatataaaatctggtttcaattgcgttatagagaaatgagaaatgtttaagaagcttcaaaataacttgtgtaaaagaaagatttagcattgaaagaactccaaaatgctttttttgagcagaagcagtatttctgtctggaactcttctttaaaccttatctttgttttgcagctgtacctggaaagaaggaagagaaaacaaccaagacagtggagcaaggtaaaaaaaaatgaaggaggttgacattatcttctttagaaagacaacaacatgcggaggaaagcactggattcagacaggcggaagacaataacctttaagtctattactctttatcactgtccttgcatgtttttctgtgccagggagaatgtgagacagcaatctgggttggtctttcttttgtgtaactgaactttgaatatcagttccgaacagggaaactccccaaactgtttaattacatcaggggacatgctgaagattgctgggaataagacaatgatccagggtaactggtagacatattcctatttgatttgtggttttaacaccaccttactgattataatttgaaaaataaagatggcccaatcctatacatgcaaaaactatttctgttgcttgaaaaaaaatatgtaaaagttaaaatgaagaaaataacagcaaaaatagagtatattatgatatatactatattatgacttcaaccattctcccaagaggtctgaaatttcagtgttataaatcataatggtataaaatagttaatgcattttatttgtatttatgtagttatatcataaatagatcactccagactctgcttgagaaaaatgctacagtacactaaacttaaaacatttaaagtgatgtggcttctcttagagctcaagtgtgctaataattttaattgtcgttccctcatgtcattgctcttatataataatactatatttattgtaataaattaaattagaacttgcaataattttatcaagaacaaagtctaaatgatttctccttcaaatttgagatgcaattaaatgtatgaaatcctaatatcagaagttaagatcttttgacataaatatatcaagaaaatccttcaatccctcacatgtcaaataagtaaactaaggttaagaattcagttaagtaaaaagattggttaagaatttatttccttgggcttttcaaaataaaatccctttataattgcatggaaaatgttttccaatttattctggcttctggggactctgaaattttacagttcagtagatgtttctgttggtttctttttgaagaagagtggaattttagtttctgaaatataaagtgggagcactggatcctaatttcagtgtgttcatttatgcgtgttcctgagtctaaatttatttttttaaaaaataaaggtaattatccctgatctgcccatctgagaagatgttgtatagggcaaacatgaaaacatatgtgaaaggatatgaaaatgtgtaaacttctagataagcatgtaacagatacttaggcattttttcttataaaatcaatttcaacacagatgacataaattatcaaattactttgatttcattgagttttatagctttccccctctagtataaaagtgctgattactcatgatattcataggttgttttcatagccacagtatatcaaaagaagattgactagatataaaacacccacactaataatagtaccaaacagacaattgatttgaaaacattgtttctttcttctgatcatcacattggtgtcagtttcattaattttataatgtctcctctagtggacaagagactggaaatggttcttagagataggatcttactccttcagatgattttataattttgtttactaaaatcttcttttatcttattaaagcttaggctcttggattgtgtgaaaaaaatgaggttctttcaatggctatttttatattgacttggtaaatcatttcaattttaaatattgtatgacaatggcctcatatttttcaatcataacaatcataggaaataatatatttggatattttgcatatttttatgatagtatatctattactaataactgatacaaaaaatagatattttgtgcttttaataaagtaatatgagaagtaataatgacattctataaattgtcccatattctaatagttatgcataatgctttaagacttgtatactttgctttcttacatagtttttagttatcttcagaagtataaataatctattagtttataattcattgaaatatagttaaattctctttaaatatttattttatttatttgtttaaacatgtggactttatttagaaaaattatatgatttttgttactcttaatagagtttaagtacactttgtgatctgagtataattgtgcatattgaatctctggacttaaatactatggatattccagtatctcaaaattaagttgaaagttttattacagaataatgtagtattcagttctcttaagaattaaaaatcacttcgacagtcagttaagaagaaacacgacaaaaatatttttaggtaattaaataagatttgtctactaaccatcaagaataaattttaacacagttagtaaacattttattaagtataaagttggagcctgttgatcataaatgtatcagagttcactataataaaatattcaactttgccttaaattaaggaatgtttcaaaattcataaatgggctaatttgtgtccacttgaagagtttctttctttgcttttgatgctattctgtaaacaatggttccctacataattgtaatagtgttttacgttgtcacaacaccaggcaaaacccaagtgctattgcaagctttgtaaatctatcactgtcctcatccaccttatcagattcttctcttctttgtgtatgcactggtctttttaaaatctgtgatgtgtactgattgtagatttattccatactttcaagtgaatgctaataatatctaagagtaatgatttccctgagaaaactttatccatttgaatataatgaatgttcatatttcttggtgtaccaaagttataaaaaaagacagaaacaattttacatttaaaatcaatgaagtaaaacagaagatttagttaacacaattgtatttaattatttgcttaatatgtatttttaaaataacttatttgcatatgttgactaagtcatgctgttgaccctcaataaatgttaaattatgataatattatagattcctgtgaattctaaactttttgacaatacttcgtgctttggttgtttaatatttattgagcgcccacaactggccaggcgctggggaatgggtgtgaggggcatagcatgggcttcggagagaagatggtctatattgaaggcaatgcatgaaaacgaggatactctccttgtttatgtagtttatatattttcaagagaaccattagcaactcaattctccactccactgcctcacttactcacataatacattttacttcttcttactcttattttacttaatattatgaaaacaatttattcttatattttatctcattaatgggaaattactttctagtcccttcttttctaactctttctttccactaacactattcctttaataagagaaagatctaaatcctacttatcacagcagaataatacgtactcaatggaagttcatattgttaacattaatttctcatagaggtctgctttctgccatgcaatatttgattcatgtgattcagacattgatgggattgctattcaacattaaagagaatttcaccccaaaaaatgggcaatgtgtgtcaattatgtctgtgaggaaataaccaactttatgtatccctttgacattctagacaagattatataaaagaaatcagaagttcattataatgttcaccatgcaacattatgagtttaagattattgagctgctaatttcattttttatcgattaatatttaccttcactcctgctattatgctgaagccacagtaggttgtatctctttttcccttaagaatctttaatagaaagtatattacaagctgctacattacaaagctgagtggtcagagcaaagattgtttcctgagaaattttgtttcctttttatttattttcttcttttatttacagattagctttccactacaggcctaattatgaaaagacaaatgaattggttttcactatcttaaatacagttccttatcatcaattacttttccagttcctggaccaaattaatgaaatttaagtttcatactctaaaattaaatcacagaaataatctgaaaccatcagccctatgtaaaaatgcattgttactgtattctcattgtaaattaagttacacatttcaggtcaagtaattttagtaatgaaaatcaacactttatcaatattctacacaacatttacctgcatcttagtgactattattgtcccaatttttatagaccaatgatatattacaagctagttgtaaagcaatgctttaagagtcaaaatttaactcagatcttggaatgtcaaagtagtagttaaaagtttttcatcattatgacctgtaaagtctgggttttacttcacttgatttttatacagaaaaaaaaggaaaaattatttcccagacagagaatctgcattctcatttcaagactttacattgcattccatgatcaaaaattcttaacttggagttagcgcttacaactttggtcttcaaagaagaaataattgatgatagccagtggcaattataaaatgttaacctgcttgaacaatagagcacagagctatctccaaataaaactttgggcttagtttagctctatcaatcatttgttctgtgactgggctacttatttgccttgcactgccttttttaaataagcaaatattattgtattaagctatctctaaaggaccttccatctctaatattgttcaattctcacttgtaagacatgttttccatgctcaagacatttccacattgcccccaatgctgaagaacaagctgtcttctgattgcaagtacaatcaatcaacaggaaagtccaatttagattataaaatgaaaataccttaaaatattatttaaatctactaaatggaatgacaatatttaaagttttgctgatactttacattacacttaaatttcaaaaatatctcaggaataaggcatgctattgggtaccaaattaaatgacataaaatgctttaagtaaggttgtaagcatgagaattagtaataatggcacacaggatatagaaagtatgcccttgatacacacagaaaaaaaactataaaaaatggggcagaagaacttaatgtctctggagataagataatgtagataacaactgtgtgtgacgggtggtttctgattatttttacaacatggcaataatgactttgtactgtcagtttttcagtacgtactatattctcttagcaaaattttgcaaattcattggtacaatggcaggaacaagtttggctttaggatctttaaatccttatcactggaagcatatacatttaaattccttagagggtaacacaagttccttttgctaccaagcctcagtgtgactttccagccaaggttcactgtttctaccccacgttctccattcaagaatccacatgaactttcacactccatggtattcttatgttttttttttatgtttgaaatgcctttctaattcttctttcattccaaattttatcagtttttgaatccatcacaaatgccagtgtttctgtgaagtcttctttcattttctcaggtcgagtttgccagtctttctgctatgcacccagagttctgagccctttatcatcgtatttaatctgtctatgtggttgcatcacaacacagttcgaactccacacaatcttccttatttttccagctctcagtagaaaagagacactcaacaaatatctattaaatataatatggtttatcttttaaaacacaaacttgtgtcctccttttataatatcattttcaagagaaaggattctaggggtcctggacttctttatccacaggagagacactctgtcattctggtaagcacaacacaaagaacagtttctggtttgttgaaatagcatcggcttttattttactccaaccaaaccctttttgagagtcttggacctcaattttctttctgtgtacatatccatcacaaagattacaatacagttagtgtggaaattttttaaaaatttaataaaaatctaaaatataaaaaatcaaattcaacaatacataaaaagaattatacgtattccagatatgcaagtctagtttgacatttgaaaagtgtttaagtaatcaataacatcaacaggctaaagaagaaaaaaacacatgaccctatgaatagtaatggtaaaagcatttgagaaaatctaacacccattgatggttaaaaactctcagcaaactaggaatagacagaaaattcttaaacttggtaaataatttttacaaaaatcctacagctaacattctatttaatggtgcgaagttaaaagctctcttgctgaggtcaggaacacggcaaggatgttcgctttcacgccccttcatcaacatcatactgaaagttttagcgaatgcaacaatataagaaaaggaaataaatggtgtacaagttgggaaaaaaataaaactgtatttgttcaaatatgacttatttatgtagaaaattccaaaaacttcctggaactaatcacagaatataacaaggtttcagggcgcaaagttaatatgcaaaagtcagttactctgttatatcagtaatgaaaaatttgaatgaacaagattaaaaacacaacgatcacttatattggcaccaaaaacataaacacttaggtatattttttaaattatgtataagacctgttggagggaaaccacgtaaaagaaataaacagaaactaaataaattgagagatactccatattcattgatacaatgacttagtattgtcaagctgccaattcttcctaaattgagctacagatttaacacaattccaaaaacaattctagcaagttatcttgtggctattgacaaactaattctaaagtttatatgaaaaggcaaaagacccagaagagccaacacagcactggaaaatgagaattaagtggcaaactgacactactgaacttcacaacttactgtaaaaatacagtaatcaggacagtatgatattagtgaaagaatagacaaataaatcaatgaaagagaatagagaactcagaaatgcactcacaaaaatataatcagctgatctttgacaaaggagaaaaaacaatttgctggagaaaggatagacttttgaacaaattggtgttgcaacaactggacatccataaacaaaaataaaaaagaaaacaaaaaaccctcaaaaatagtctttacgtcctccacaagaaaattaactcaaagtggatcatagacctaaatgtaaaacataaaactataaaattcctgggaaataacatagaagatttaggtgtccttgggtttgacaattacattttaaataaaacacaaaagacaaagtccatgaaagaaaaaaaatatataagttgggcttataagatataaagatgggaataagcatatgaaaagatgttcaacataacatgtcattagattaaaacaatgagataccactacacacctattagaatagctaaaatccaaaacactaacaatacaaaatgctggggagggtgtagagcaacagaaactctcattctttgcttgtggaaatgcaaaaagacaatttggcagcttcttagaaaactaaccttactctcacgatgcaatccagcaattacgctccttggtatttatccaaataagctgaaaacttatgtatatgcaaaaacctgcacacaaatgtttatatcagctttattcgtatttcctaaaactaggaagcaaccaagatgtccttcaataggtgaacagataaataaattctggtacattaatataatgagatttttattcagtgtggaaaatacatgagctgtcaagccataaaaatacatagaagaaccttaaattatatttctaagtgaaatatgccaatgtgaagagtcaacatgttgtataattacaactgtatgacattctggaaaaggcaaaagtatggagaaagttaaaaactcagtggttactagggtttggggaggagagaagggtgaataggtggagcatagagaatttttagggtaatgaaattattctgaatgaaactacaatggcagatacgtgtcattatacttttgtcaaaatctataagatgtataaaactaagattgaaccctaatgtaaactatggactttggttgataaagatgtatcaatattgcttcttggatggtaataaatgtaccacactcttgagggatactgatagtgatggagcctgagtgtgcttgaagagggtgtattagtttgggctgctataacaaactgccattgactgggtggcttataaacaacaaaactttatttctcacagatctggaggctggaagcctaaaatcaggctgctagaatggtgatgtgctgtgacagccctcttctggattgcaaactgctgtctttttgtatcctgacatgcagaaagagggcaagagagctctctggggttccttttatttttctaagaccactaatttgattaatgagggttccatgctgatgacctaattatctgccagaggtgccataccataacattgggagtaggatttcaacatatgaattttgaagggacacgttcagtctgttacagaaagaatgtacaggaactccgcactttctgattagttttgctgtaatcataaatctactctaaaaattaaggtctattaattttttttattattatactttaagtttcagggtacatgtgcacaatgtgcaggttagttacatatgtatacatgtgccttggtggtgtgctgcaccactaactcgagtgcacggaaatctcgaagaattagtccagttcactaagttaattttgaagtatattttgaaattttataccatgagtagcagaaagatatattaaaagcctcctttattttgattatattaataattattcagttaacattttttcttatattcaattatatttcttcaatttttcaatatatatcatcttataaattaagtttcaatttgaacagttacactataatgagaatgattcttgagatcccacataaatgtgttttaggacaggatttccattttaaaaagttcaaaagacaatatagaatataatgaataacattgttatagaaataaagaatgtattatatcttaaatgaatggataatcagaagttattataaaaaataaatgggcataaaagtgtaatatatgtgtgtgagattactgaactttggaaagtcactcaaaatttcttagataacaaaaaaaataaaatgtgaggtaaacattggatttaaatatacgtaattttcttttttgtccaggaagactatcagatattggccatttcattttacttgacacttttgccacacaaagattacaaattggaaaatggctaatcatgaaagatgtttataatgatgatcaggttactgtgtaaagatttgacaataagtttcctgataaaatgtgatcagcacaaaatttgacaaatttattaactcattcaacagatagttgtggaatttcgagtatgtgttaggctacctagtccctgcttcagacatatgatttgcaaggctgtggcaggctggcagttatgaagaacattgatgttatttggtgattcagataggcaccctgttcacttttaggaacaatttgtggtgatatctactttataatccaggatgctcccagaggtatagtgtagaaatttaaccctaactttgtcatctcataacctgggttcaaattttccattccaatttactagctgtaaccttgggcaagttacttatctcttagcttcagatatcacatctataaaattatggataatacctacctctttggagacaggtgagaagttaaagcgatcttatgttaaaaaatgcctaactacacaaaataatgctttatcattatacgtggatacaggaatttccttgagccctgccctcaaggaaattacagtattgtaataaagttattatcttaatttaaacatggaagctttgacatcttaaattgatgggactacactagaaaaatttcatgactaataaaattttctttgaaagagtattctttagtggttcagtagccaaccctgtccctaagatatcctagttcatctcatctccccaacattaaaatagaagttaatagaatgcatatctaatttcttatcaaataaaggagggctaattttatgtttttatatctttaaatattcctgatctttctgaaagagctagacagagatgaactaaagtgcaccctactaattttgattagtagtcagattattaaggcgcataaggataagaatatcaaagtgtgtatatatgaatactccaatgcttgcagccgaggcacacagcctcaaaacctagtaattatgaaattgaaccagaatttagtcaaaggaaaaggttatttagattgtttcaagagaagcccctcagctaaggtaatttgaagaactatactactataaggaagagcttatcaaaaagactagaatactgacactactgcataaggctgttatttcacattcttatgcctttgtatatgtcactgttttaacatgccaatacagcccagcttgtctagaatatacaagtgtaatttaaggaagctcttcaaagaagtatttacaaagtgttatatagtattttctagttgatgcttttggaattcacttattctccatcccctaaatatgttaaatatataactaaaatctgagagaatagtctaatttcccttatttacaatttcttgaggaatatcttcccacagtcttcacgtactgacaacattgttcagatgtcattcaagaaaattttatattatgctttttaattgggttgtccagttagagatagaggattacacaggttgcaaaattttattctttttaaataaaatataaagactatgaaataaataaaagtcccaagtttaaaaagatagcaatgcatagatataattcaactggaaacactgtaaagattttaaaacatatattcaggaaaaaaatgtaaaatgttaaaaaactatatttaccaagttctttagcccaatagaatacaaaacagttaaatgtatcattatgacaaagagaaagttaaagacagtgtcctgaccaagttatatttaattacaaagttaatgaagtgtctacagtaaaattagtctgttatatctttcagaagaattcaaatttactgttacataaagcatcaatatattattatttccttcatgataattgtaaacacaatattttaaatcatttaggcaacttgaaaattctgtctctgtatttacttataaattttatatgttggagtttgtagtagattgaaaatattataaaatatatttttaaaaatatcctggattatcaaaattgcattcgaattaaaataaaacaaagagacattcatgtaagggattcacatattaactattaaaacaattatgcaattaatcactattaaataactttaggaacagtgcagtatcatattaggaagcaaccacaagatgttgtgagacaattttattttcttttttgatgctgtgtgatgatgtgcgttataagttacactctgggaaattatcagatatcgtttcactttcagataaagcttgccaggtggttctttacaattattctttccatcagaagaaaagtccaaaaagtttggtatgttggtattattcattatgttcgtgaaaaaatatctcagatcagcaagcatcttataactacaaaagagaaagagagagagagtttttgaagttatatttctgagcacttcagtagagcaagctgggtaagaaagattaagaattttgaatttggttctttatagaaccaagggatcttaactgcctgataattttgttagaatcctttacactttccaatttcactttctttttttgttctagctatgttcaatgttgacaccaagccagaaagctccaacaaaatatttgtattaacattctcactaaatgtcactaatgataaaactgaatttatacttgatcattcagagcaatgaataataaataataggcagatcaatggtattaataattactgctgtttcctttaaacagatgaatacttgtagtttggattcaaaatgtttatgcttgtgtcaggaaagaactctagggctgatatcctctgttataagactttccactatttcagtcttttgtcttgtctttttcatgagcctcttttttcaaagaattcttgtggaaggaaaaggaaacactattgccatatataccttttatattctacaatacaattaaaagtaaaagctctttgctatttatttttggttaaatatactcaggcccataacttaaactggaaaattcctggatgcatttctattgagtattattttcaaaatgaatagtttttatctcagattatttaaaactcgacttctatagctattttgatcataatctgtattttaaatttttaaaggtctggcaatagcacatcaaaatgtataaagttaaggccatcactaccaatatataaatgatatgtcaatacagacaaattatatgagattggatttgaaacatgccggtaaaaagaacagctgagaacactagtcttagtgtgtgggtgtgttttcaccagtcacatattattaagaaaataattgttcactttctggtttattttgcttttatataattggtttacttaataagtcaagtcagtctgtgtgaacaaagcaaataagattaatttgaggcctttgaaaaaacaagctactagttatattgatagttttcatttataaggaatactgtaggttgctttgcagcacctgtaaatgatctgcacttcacctgttttttccaactgcttgctggatgtttcctttttgggcgtcctgttgacatatgaaacacaatactttcaaaacagaaataatgtcttcctccaaagacctctcctttttacattttgtatctcaggtgagggaaaattatcctactgtaagccaagtaagaactctaagaaccattctcagcttaaaaaacaaaaacaaaaacaaaaaaacctaatacatggccgggcatggtggctcacgcctgtaatcccagcactttgggagaccgagttcagcagatcacttgaggtcaggagttcgagaccagcctggctagtatggtgaaaacctgtctctactaaaaatacaaaaattagccgggcatgctggtgggtgcctgtaatcccagctacttgggaggctgaggcaggagaatcacttgaacctgggatttcagtgagccaagatcgcgccactgcactccagcctggcaacaaagcaagacaaaaaaaacaaaaacaaaaacaaaaaaaaacccctaatacatctacttacagttatgcaattaaaatggcatttcctggccaatgaaattccacccaatttataagcctaaatctaaatggcgtactctcagtgaaaaccttccccaattttaaaattagaattaataaattctttccctattatctatataactttactggagtacttttcacagggtcaaatattttgctctttgttgattaactaccttttcacaactatttctacatacaggccatttcaaaacttagtggtgtaaaacaacagctgatttcatgttgttcatcatttagtaggtcaggacttcaggaggatacagtaggctgttttcacttgattatctcatgtgattgcagtcagatgtctggctgggctgcagtcttgtaaaatcactgactcctggatgtgaaggatggctctctcagagggctggcagttgatactagctgttggctgggagctcagctggggctgttagttggactgcctagatgtagcctctccagcatggtggtgttaattagattactcacatggcagctgcatttcccaaagcaggtgtcactagattagcaggtgaatactgcatgaccttttttgatttcgccttggaagtcacacagcatcacctccacttctgttggttgtaaatggcctacggagcaaaactgatagatctgccctgtccaggcctcccattctctctctgtttctctaaaatgtgtctttctttccatttcatgtttgtgggtctaatttctttcccttgtcaagttctgcctcagtactacatactttcttacatccttcactgagcccattatgcaactactggagccagtacttatgtgcttgagagcatagatatagtggttcaaatccaaggtctcctatttaaagatcttggaaagttatttaatcaatttatgtgaaaagtagaaataataacagaacctatatacctcatggagttgtgagcactgaatgagaaaatggtagagaatattgcctgacacgtagtaagtagacaatgttagctatcattcttatatctttcttcttcaaagcccatgttagtttacatgtacctttttttgtatatatggcatagtctgtactagtgatagaaattcatgggcttattttctattgtttacatatttagtccaatgtcttatagacaacatatgcctggagacatttgtattgtgaatatcaactcagatgccctgtgatcttaagcctcagtatacaaaacacatgaagagacttgcatttttttcctctcttattccttgtaactttttcttcccatgatctctcttgcagaaattagaaaagaaaaatctgggaagacttcttcaattctgaaagataaaggtaacagagttaatttaatataatattacaaatttattaggaaatatatattattgagaacacagtacattagctgcatcccctttgcaaatatgtaaaccagaactgcagaggtcacacacatatttttaaaaacttgtgtttatttgtttgtctctaaaattatttcttctcattattaccaagaaagtgctctgattacaattcccaaaaatcccaaagagaaaagaaagaaaaatgaaaaaaggtttttttaatgaaaaagataaaaaatatagaagggaagtaaagaatattaagaagcacttgtccccaaattctctgattctctcctttctattcctaaaatatatatttagtgcataatatatcccaagcacttggtaaacattggagatgatgatgacaacaaaaatggcaaagctacaaataggaagtaatatttggtaattagaactctgcattctgatattttcaaatgctctgaggcatattctgcctgcgttagtcttgtcacactctatattgctatgaaaaagcatgaaattcttaattaaattttgtaacttccatctcctgaatggactaactgcctttcctctttgcctatgtaaatatttaaactgatcctaagaataatgtccacatacagcatcaagccttctctacctatttcagccttcaatgagtcccctctcttctgaattaacacacttgtaatatttataatttattctgtagtacgtatatatgtgttatatatatgtactataacatataatttattatataagtgtgtgtaatatatgtatatataataaattaactaaaattcatctatttaaatctcaaggtctgatattattcaccttaattttttgtgtggactgatcagtgctatattcaacaattatttattctgcatctaatatgatgtaattaattcagatactagacacaaaggatgcaaaaaaagcatagactataatctctgagaagttacagtattaataacataattaaaattataataatcataaaggaggtacacaggatgctatgagagggtgtaataggagattttgatcaattttgtgtgaccaggaagttttttcctggagaaataatatgaaatgtaaatgagaaggtgaagagtttgcctttaaaggtgtggtaattgtttggaggaagtccaaaagtggtgcatctactctttgccaggcaccttgatacctactttacatatttgtttcagcaaaatgtgctagctacctctatttttgtgaacaaggaatgtgaggtctagcaatataagttactcagtgtcacactgtgggtaatagggaaaggtaagagtcaaagtcatctctgccctactttaaattccattttttcactttaacacagacactgcctttgtcttagaataggggtcttatatttgtattcacaaaagcacttttgctttgagtgtagaccttataaaaacaaaaaaaaatctatttggcatagatgcattggacatacactatgaaaaatagtctaagttcttttgctattggggtaactacacttaattctcacagatgggcttaatctatttttctttagtgattacctgtattttgcgacagttccattcccagcctccactctcatgtaatatgaaagtcaataaaaacagcgtccttgattttgtgaaaatcaaaattgtcatgaaaacatactatcaggaaaagatatacatacataatttggagttcacaatttgtaaaatctaaatatttccttcttccattgtcatatggaagacatttggggacattaatgtctttattttagtctgcacttatatcacaggaatacttgaaccacatgttattgttcactatgaaagcagctcaaaagaaaggttggggcttaactccaaagctacactttgggcaatgataattatcaaaacttttaactattacttaaaatcttcacatgtaccaaagcttaaactagttggaggaataattgttaaaatctgtcctggaaaacattatctggaggaaataaatccacactgaccacttcattaagtaggcttttgtaatttctaatattgttgcaattgtatattttacatcatcctaaatcaataatcacatgctgcaaaccttatatacgtaattttccagtgattgaaaatgttagagaaaatagtagataattttacaattgacattccttactgaaaagtttttgctcaatgtaaaattatctactattttctctagaatttcaatcactagaaaattacatatataaaggtttgcagcatatgattattgatttaggatgatataaatatatctactttttaattcaaactgcattaatgcccccaaaatgcctttattatatataagtcgaatactgttttagaagaatttcatttttcctgaatataatttatcattactaagtatcaaagacaaaattttaatattacctataagattttagggacttcaaaagcctctgcagtgttattgtttttggagagtctctttgaagcctgctgctaagctgtggcagaatcagaatgcagcaatttcacttgctaaaaattcacttattttattagcgttgtattttgtcagttacttctattaaaccactaagagattacctacatttgcctgttactcatacattccgcctgcatgtgtacatccaaattcattttaaaatgatgcttcaagtttaaaaccagcattattacaaggaaatcatttggagctgcatttatcagagttgtgataaccatgagtcactgggggcattcagagatacattattaggcttttgcctttaagtaaggacatatagagttctagggatgaccgttgcaaagaaaaaaaaaatcaggagaatgatatgtcttgccaacttttgttgctggttcagttattgactttcctggaccagtggactcacttaagccttttcaacacacccacagggacatagtcctgcttttgaggtcttgaccatccagaaaacagaaaatcctgttagtgacccatgatattggttatcttccttgtggcattcaaccctatccctgataacttgtttctaactcctggtctgacatatctgagtatggaagattcacctacggactgagaaacagcaaactgaatccaaagaggcaacacagtagttaagtaatttctcctcctctgagaacaaaataatagcacttttaggtttctctgttattggagtaatacaattggacatcaaaattattgactagttttgccccccacgtctgtgtatgtttggatataatggcagaggaatcttgacagaactgatcttcttttactgatgctcaggactgtgcaacttatgatcccccaacttccatttgtcctcaacatgtttttcttggccatttccactcaacaattcaaagctagaattaaggttggggtaagttgtctgaagacttcgaaactcctccccagccatgctgtacttcatcatggatactaacccagttcctcgttactgcctttgtctctgggggtagtgtaaggcagtggaaaatctgaaaccattttcctatcccttagggaattatttttccataacaatgttcgtgcctcaataattttgacagagttccactttatatcccagcaccattaaacactttataggccctgataatcaagaaccataaatcatcctatagactcttggacaaacacaaagaaactactatattttaaaaaatgttttccaatattctgcttttgacaaacaagatagataagctgaaaagtgtcataagagttgactcaaaccactgatgtatctctccttcctaatgcagaagtgcagagtttccatgtaataatctcttcacttttttgtcagatttaatatcctcctcacttccttgggtagttagagattcctcagagaagtctgtggacttcctaaactgggacaaaagcccctgaggacaaagtggatgctgagaatcaatgatctgtaggaaagtcagtgcaagtgatgactcagcctaggaaccgaaggcatcttgccagtagcaaacttggaaatagaaatcacttttattttctgagatcattctccaaagcttacggtattgggtttacaatctttgaatgtcctataaaagtgtatctgttattccaccctttccttctctctccactaaaatcaatgtagttctgtgggctctcattctaggtcctgtattttataaatactaaaccctcacacaaacatacacactcacccatttagatcaacatgctgaatcttgaattctgagactcgaagcattgcactctcctgccccactgggagtctgttcccaccaccactcctcatttcacaacacattaatccttttggcttagccaggaagtgcaagagcagtaaattacccccatcagcttgaaaaacagttaatgaagctttccagtgtgtttgttcaattcatgactcttgatttcatcttcatatgctgaagtatggaaaaatagcactatttatacacaacaccataaatagcaacatgggcatttatttgtcaccaaagacattaaaaaaaattctacatgcttatggatatctaaagctacagcttacccgacaagaaaattttgctttgaaagatgcagttcttttaataaaacctcaaaatcaattcttaatacatccaaaactatctggactcagttaattctaagtgtttactagagtggcatctccatttacaagcaccaccatcacagtctctgtattttcacccaaataatatggtgggaatagaaaaaggggctgaaaggatagatctctttctttcccttataattgcattaaaagtcattttcatccataaaatctttattgagcattaatgttgcagaggaagcataaaatgtgttaatgttttattttttattaggctgttgaatataatgatgttaaagacattgaccatatatgtgtctggagcccatgatatggtctgaattacactgaagatgtgtttggaaggtggtagaataagtaaagttttatttgagttacttcaaccaaggccttcattttgaagactttaaaagtttataggtaaaattgtctcctagctgaaattgtctctcaaattttattttggtcttattctcaagtttgagtctgaagactaaaacaccgctacatacatgatatgtgcaggattttctatttggttgtttattttttgacaaaatgtgggctaaaagaaataaactggctttgtgctgattaaacagttttggaagacttctgcatgctgaagtcatgcgatttttaaaaattacacataaataaggtcctatccatccaaatactcattctcttaaacaagtagattataacttgttgaacaacttatgtttgtgccaaggaaaaatgatcagtttatggcttattgtattctatactgttgtttctttgtccctatatgagtaaaaccatttttaaagtgcattataaagtttccacttactttcagcttactgatactttcagcttactgacttcatttataggtatctgaaaatctctttgtcttggcttcaaataaatgtccgatgtttcttttcagaacctattaaagggaaagaagagaaagttccagcttccctaaaggaaaaaggtaatattatacaatgaaatgtgaagccacattgatctgccttttgcatattcagttatttgcaacaaagtaatgaatcatttcattttcaggctctcaaaaccatagccttcatatgtttttaagcaaaagaaaaaagatttatattccatcattaaattctaaattgtactatgaaacaaaaaaggaaagtgtagctgcatcagaaatactgcaaaaattttaaaaagtcttatgctattctgattccatgggtctgtagtgaaatggaggaatctacattttataaatatccaaagagcgaatcttaggaatagccatggaaaccaaagatttaagataaaatgaaatagtaaaaatttctcagtgaaatcttttgattctgtaagttcatatataatagaatcctaaacatattgtatagctaggaggaacttagaaactgtagtccaatcctcttgtcttacagacaaatgaagcccaaatagtcaagacctttttcaaagttacagtttgtagtggagacagcattagaacttcaatctcctaaatcaagcactgttctttttctaatgtgccatgttgcatctctagcctttccattgtgataggcttgaagtaaggtggattctgatatgccatacatcaaattatgttccctaaaacacaaataaacttgccaaattcaacgtaaaacataaaatttctaactaatccaagtatattctgtggacatggcattgtgctcagagttgtctaatatttcctggtgtcaaagtaaatattaaaaattttccattgtgcccatattaatgagtcactgaaattataaaaaccaagtaatgtacttactattgtgaatgttagaagaagagcctgtttccctgtaaaatattgaccacacttagtagagggacttagctgtacaactttcatcttactgggatttttttattgataagagaaggatttctggtgagcttacataagcatggattggggttggaagtggtatggagatcagcgggagaggaaagctgacagaaagatgagtaagaggaatgaaggatgcatggagagccaccattagtgagtgtagcaatgtataaaactatagccttaagtcatactttcctaattttgcaactaatgttaaaataaacataattgttatttaatgaaatgtaagaacacaacatgattttttttctcagccccatatgtatctaatcaaaaaaaattaaagcaacatagcttcaaacctattaaggaacttatgccttcttttagaaatgtgttattataactaaaactttcttttcatcggcttttatgagagagttagtttattgctgcacactattttgttattttgacacgatatgtaaattagtatattttgccttgcaagaggattcatatatgttatgttaaatgtccaacaggcagataaatcgtgctacattttagtattcaaagtttaaattaattgagaaaggtaagaaaaatatcctggacttaccaaaacattaattcatcttaaataaattctaggtttctttaacatgatcttactgttggttgacttggatataacaatgtaagttgaaatggttagataccattaagtaatttaatcacacaatgatgctatatttcttttgccaatataaggtggaaatatttttaaaaggtgcagacaggaatattatatatatcaatatttttattttaaaagtttagtttttgtttattttagtctctgatgtctggaaatatattctcaaagaatcttcttctactcttccaagtatcttctttccataatcccataccaggtggttggatctagcaccagccatttcatcgttagagatattagtgatggggacaggggcaacatatatcatgttgaagaagatgcattagctaaatcctcagttttacttcattgtaccattttcttcctaatttttagtaagggctatgactagacagtgatttgtacaaaaagacaattaaatgtaatcaccagaataattattttaaatcccattttattattattattattttagaaattcagcccttaaattactgtcaggattttaattagtcatttttatttttcccacttagagtgacagtgatgtctcctagaaatttgccagaatattaatggtgctttaaaattttatgcattgaaattcttcttcttttttgttccaaacaaccagccaaaattcagacctatgatgctgaatgtaaatgacaactcctggagattttatcagcaaagtgtaatcatatcatgcaaagtgactttaactttcacctgtaggaggtgttgtctcattaggctttctctttcattaaaggggatcaccaccatctcacacatattggaacagtcacatctcaaataaatctttagtaacaggaattaactttaaaagaaaattttctaggttaaagttttaacacttcttttagtaattagagagctccttaaaaggtttcattaaaggagcatcagacataatatggcaatatcatacacaattaaatgagaaattaatctgttatgtgttaatcttataatacttaaatagccacagcatattcttctttgagtaaaggtagaaccatgttctaatttattctcttaaatctggttatgcactaaactctcctattgaattaaaataaaaatgtcgttcaggactcatgaccaaagattctgattcagtaatcatgtagtggagacaaggactctggctttttaactctcattttccaggaatatggaagtgcattttcaagatttgaaggctcttctcatcttcattccttaaaatgaaagataaattatagatggataaattttaaaagccgtaaccatatgcaatcaagagggaaacatttacttggttgaaaaacagagtgaaaacaaggtagtaagccaaaaagaagctgcgggggtgctgggctctggatccttaaacagaattgctgaccaggatcacataaggcaataacgttcattggaataagcagggattttacacaagtctcaatgcaattaaccagatactgaagtggaacccccattcaagaaaagaaggtgaaaaacagttgccgtaaatagttctctggtgctacagttaataggaaagtgcagacccaggaaagtggagaaaataaactcagcccctcatctaggacctgaagcaagtcatgtattgaaatagagacttgttcaggaatatccctactaacactatgaggcaagttttggagccatcaaagtgtacttgggactagaggcccagtgaaagattggtgcgagaggaaggaatcacacaatcgcaattcataggaaaaaaagaaacaaaaacggcaacaaccacaataatacagttctcaggctgaaatataacctgaaattccaaatcatatgaaaaaattaataataagataggtttgcaggtggtgttggtgttggttgggggtgtgtggtcatttggggcggcctctgccatcttcagtacatggttccaagttctgcctatgcattggcattgcagccagcacaaaggaggaggaagtgtgagggcatgcgtgccaggtggcatgcatcagtcccatccccttgccaccagggaagatttagattcttgatacatttaactgcgagggattctgggtgagagaaggaatgaagaacaagttgtgttggctagtcaggattttctgccattacatgcctttccatatgtttgaagattattataacagtatggagaaaatgtggaaaatatggagtgatttagactaggttgataatatggcttatgggagagatacaagcattttaaaatgattttgactaaacaaaacaacgcaaaaatcaatgtgcatgaatatgtgtaatatgatcacatatatgcatttatatagcattacaaattatacatatgtacttatgtttaaatattaaatataaaacacactaaaaatgtcatcttgatttcaacattgtatcagatatagtaccaatggagaaaaggtataagaattgaaaagggataatcaaagttgtatttgcagaaaagccatcttcataaatattccaaatttacccacaaacaaaatattagtatgaataagagaaattagcaaaacttctggatacaagatcatcctatgaaaattaatgtttagcattcctaaacataagtgatgaataattcaaaaatttattcgttcagggtaccctattcacaatggaaacaaactctgttacaaagaataaatgtatctaaatattgatgacattttcatgtaaaaattatgaaaaaaattttgaaatccatttttaaaggcttgaataagtgaagcaatatttccttttcctatctggaagtgatcatttccctttaaagtaatgtatagattcatataaaaaatatcaacggtatttttagagtagaaaaaagttttcttaaatgtctttaaacttgaaaggacaaaaataagaaaatattttttgaaaaataataaggtggaattgcctgaccaaatatagttattttttatagaattgctttaattaaaatgatatggaaatagtacgggtataggaacgcacactgagagaacataacagcgagcccagaaatgaagccctaaatgtaggaaaatacattagatgacagatgtatcattgagaaaataaatggaaaaccacacttgtttctcatgtaggaaaaaatttaaattccgctctcatatttgcgcaaaaagaaatttaagacatcttcaagacttgatgctagaagacaaacttcaaacattcaggaaaatagagaagaatatatatagcttttggttacagtagaatttcttaagacacaaagagagcaaatccagaagaggaagattagccacacattagaaaaatatattgcaatgcatataatgaacaaagaaaaataactgatattttaaaaatctgcagattttatttttaaaatgaaagcaagcacttgaaatttaaaatttgccagtttctatttattttaaaaatagctaattgagcaaatgaccaaataataaatttatgatcactgaaaaatgtgggtgatatttgtaatcagtacttcttggttaatttataatgtggactaacaatttatttctatgacacagttcaattcaaatagatgatagagaaacaatagctgaaatctatctaaactacatgaagttttgtataggacattcatgtaaaccaaacattaatagtaggtgtatgtctataagaaaatttgggtgactttaagagaaatattaatatactcagaattcaatgtcatggacctgataatattttaaaaagtagaaatacatttcaaaattgcttcaacatgttagaagccagattcaatcaaaatgagatgctacactgaagtgagatgggactttgagatgggatactagaaaaggacatgcttagaatataagactctatatctcttttacaccatgctgaatttgaggtatttttaggacattctagtagaaatctagagctggaagctggctatttgggtgtgagtatcagaaaaaatatttgggttggagatacacttgtgaacctgtattctgaatttgaagatgttggcatgccatgcatgggtgcgatttcttatggaaagagccaagagtaagagaaataatgttaggagaggataaagttaagtctcaaaattgaggaaccctaaaccttcttcttaacatgagtactaccaacaaacttgaagtccaatactagtaatcactctctctgctatttattttacagaaattggtaattttgcatgttcagttgtcactagtttttgtgtctcattgcaaaggtacaatgttgtttctataagcactattttaatattgattaattcagatacaaacctgcaggggaaagctcaatgatttattgaaggagtatgtgttgtgtagtctgcttttataagaaagaatcaagacagttggtctcagagacttatcccaaaaggcacctttcagaataagttaattcaacatatgccatagtaaacttaaccagtgtttttgtcttgctacatctagagaccataaatattccagtgtccagtgattaacataaaaaggtggagttttgtccccaaagttccagttttaaagttatttagtgttctgattctgtttaaactgatataacagggatttattttgtcttttgaaactgataactctaagaagattcaattaatctatatattttattcactactctaaatttttaaaatgttccaatagtattgcaattcacatatgtcatcttcactcatgtcattgtcctcctctacgaaatattagaactttcagtaaaatattttcatagtctaatactgggtctagaatatttggtttagtaatcaacattagtattttaatttttctgtactttttctgagtttcttggtgcctagtctctaatataaattcttagcatgatttaattctgccctgaagtattttaaggagaaatactacaactgtcatgttaacagtgaagaaattgatgcccaaagattaaatgattagccaagatttttatgctgaattagctacttagtatcagacttaataaccactaaaaataatcttatttttctttttttcaatattggaatatattagcaaaacttatcctaacacatagtcaaaatttttgtctttgtaataattttattgtgtttgctaggcatgaaggaagattacagataatctgttgattaataaaaaagaccaatcaggattctaaagaataaaatcttagaagatgcctttaaaatccatgattactcattttctgaagaattgttaaagtgaaagttggacccataacagtagcactttcactttaagcagcaatttacagcctaacacatttcttgttatgtccattatgccaaaatgtcaagttgataggatggaaagaggtcatgtattattttcaaaagtagttgagggggccaggattttctctgcaagcattagctatacaaaagtattgtatccaagcactgagaatttttataatcttcatccaaaatgttaatatacagcaacatgtgtacagctgtatgtaggtgaaatacacgtgcaactctaagtgtagagctccaatattcattccttggtattttttaaatatcagccctcattcaaaaggcagaattgaatgaaagaatgggtcacaatctcactgcaacctgtcttatcactccaagctattttatgcatatgttctaatatgcttctctccttgaaggtttttttgttttattttgtttcgttttgttttttgttttttcttttcagagatgaggtcttgctctgttgctcaggctggcctcaaactcctgggctcaagagctcctcctgcctcagcctcctgagtacctggaattataagcatgcaccacacacctggcttctgtccattaacattttaaaaaatatattatttctactgtaagtcttctattatttttacatttttgaacaagatataagatgattcatacttaaacctatgacattttatctacttaattgattattcttacttcaaattcaagaaaatcgatactggtacccagaaaaacaagcaagagtctagtgacttcccctcagtaaaggaaaactaaggaatgcctgcttgtttaccttggtaagtggcctttgcacaactttctgaactcattgaatggtttaaagtcagcaggctcattagctgaaatatttccaactcgccatctgccatcttcaaataacatcacagggcctgattctgacaatttctgcaggacctacaaatgcatgcagccacctccaattatatctcacctattttaaatgcacactcttcacactgggaagcttcagggaaggaaagaataatgaggagcatataagtaggcataaaagaaagaacagataaaagcagagtgacactatcagaagtgtggtacattgcatttagcatatacaaaagacaaaagaccatgaaaatgaaatgatgacagaataaggcagggacaatgtatgcatttattctgtgctgaaaagagagaatgccctgtggcccattttatgtgtttaatgtccactcagcaaagtttttctgtaagcatcaaactccattgggaattttgccaaggaaggattgcagaatcaggacttaggcataaagcattgagtcatgacttaagcgcctgcattacaaactggagccattttagaactacacctacagaaacttatcaaccataattgtttttgttttgtttctgttgttgacttaatgggtttgagaggtgtgtaagagggacagagacagagacagagaacatgtgtgtgtggaggtgtgcttgtgtgtgtgtctatgtgttatgggaaaagcagtgatgtcagtagtttgaggctcttgcttcctgaaataactaacaataaacaaattagttcgtgtagccactctgaataattttactagacagacaaattaaatataaatatctgaagataatgcacaccagggttcaacgtctagtgagtcagttctaatgtgtttttccatacatgtaagggttttggatagtgagacagggattctgcttcatattttggtttaaacaccctaaaaatgaagttagcattttgattttcctgtcattttgaaacagcattttaattttgttatatatccgtaacaatttttgagtgttcacataatgttctgtggctattctaggcagtgaggctccaaagatgaaaagacatattccctgtcctcaaagatctcacaagacagtgaaaaaaggtgggacaggccaagcgcggtggcttatgcctataatcccagcactttgggaggctgaggcaggtggatcacgaggtcaggagatcaacaccatcctggctaatatggtgaaaccccgtctctactaaaaatacaaaaattagctgggcgtggtggtaggcacctatagtcccagctgctggggaggctgaggcaggagaatggcatgaatccaggaggtggaggttgcagtgagccgagattgcgccactgcactccagcctgggtgacagtgagactccgtctcaaaaataataataataataataataataataataataataataaattttaaaaaaagagctgggacaggggaaaagtgaagtgttcgccaatgctcccttcaataaggcagaccaaattgtcatctaatcaatggagatctgttatttcaatattagtacttgaatactcaggaaatatttgttaaatcatttagtctaattctagccacaaattcctgagataattataatgtttccatttcaaaagattagaaaatggaaatttggagagtttcagagatcacatattagattatttggttaaaaaggaaataaatttcaaactgaggaattgtttgcttgcttagcttttgcctgtttgtttgtttttcttcaactgcagtggcaaaaatgatctctgcaactccttgacatgaatgaagttgaactatcacttgagaatatcatcaccttgcttcttcattatgcatggaaggattcctcagttcatgagcaaagatgatactaattcagaaagataatcagggaaaatgggagcatagagaatgcatgaagtgtcaagaccatatggatgtggctaaataagagaaaggaaaatgttaaacagtcagtaaaatattgaagtaaagaaatgtacagccagataagatgaaaagctatgtagtagcagatgctgggtgttggttcactgtgtgacctcacccaaagttagaacaatttcttcttttggcaatctatgaactgaagaagttcaaaatcaaactcaaaggcagtgaaatcttgtctttttcacagttatatttatccggaccacaaagcattgtgtctgcagcagaagaaatcagataccatctagtatagcagactgaatctttgcaaaataagcattcctcttaagacttatttagggaggcttatctcatatctgaaacattgaagtcaagctatttggagtgacagtatttctatattccatgcagtacttcctcatgcagaaaacagaatgtggaagagtgtgagtgtgtgtgtgtgcaggcacatgcaaagtgcatcacattttcttttaaataataatatagttaggaccacaacaaagttgtgaaattgcgtgtctttgtgtgtagtagtggtaatagtagtaatagcaagtagtagcaacaggttttcatcaaagtccaaatattcaggagatcctgaataaaaaaaggtccaaatgatggaaaaaccatgggtttggaataaatgtatgaatgttgcttataacaaataaaatgttttttttaattttaaaatacgtattgtatttaaaattgggttagaaaagtgcgagaaaagtagtttaaaatatcagtgaaatgattgacctccaccgtttgctttgtacctggcaccattcgaagtacttcacgtgtagtgtttaattttcacagcaatcctgtttgcattaacgtgaaaatggaagcactgagagttacttgcccaggtcacacaattgcctgatgtggatccagaactggtgtctggcagtctgattttagacctatgtcctcagccaccacgttttccagaccccctcatactgaaattcacctatggttgaccagagataacactgctaatgttcctttatatattttacaggagtaggttttgtgacccgcttttaaatataacaacttcccatgtcattaaatattgaatactactccaggagtgtgtgagagagttattcattttctattaatgctcagactgcttagttttaccagctcaacgtaggaaactatataatacgattcatgatttaaagactggcttgaaaaaaaatagaaacctctgtgattatactgtatatgttaattataatcctaatgactattagtagtttgtgtagataatacaacatagataatatagacagaccacttataagaagtagaatgtggtgtgctatacagtttttatgtattaaatgcttcaaagcttttaattctatcagtagcaactttagttatagaagtgtgttgaagtgcttaaaactttggaaacggaattcaaatcccagttttgccacttactagggagtatatatttaaacatattattaagtctcagtattgctatctgtaaattgagtctaataataacatttaccacataggagtggtatgtaaggattatgtaatttgtccattttttcaacaaatatttgttgatctctcttctgtgcaaagaacagtctaagcactatcatgtattagggaaaataaaaaaatcatcccaggactcatgaagtttatatgctactagggttagagagctaataaacaaatgaatatttaatattatatcaataaaatatagataacatatataatatacttaccttagagactaccatgtggcaaatacaaagtgtcattggtgcaaaataataataatgattattattttattttattccacatgtgagatatctatgtgctaaagaaacaaccgtgataataacaaaataaattgagaaaaaaatctatgatatttagcttttgccttgcaaagtacttaaaatagaggcattctgaaaataatgcagattattgggatttatatattgaataaatttatttcttttctttttatgaagacaaagcagagactcctaaacagagtttgtctccactgctgcccttctgacttaagcacttgcatgctgaagttttggtctgcttattctacttgaaaacactattgatgacattgaaaaatcactaatgaagctcccttccccaggcccatcagcaatttacatttcacaaatgaaatcaacagcctggaaaagtcagtgctgcataggaaatggcaggctgcctgcctcaacaacttagcatggggactttttggttccatatttccccaatgcttgtacgtgtagcccaaaacgaagggcttcagtggcaaatgtttacagaaattagatattgtattattatacaagaataattgtggtagaaaacaattaaacagtgaagacagaatgaaaaataaatgctcgcctgctgtctctctggcctcccagtcccaatggccagtattaactaacaactgtccttggtttcctgaagcatctcattataacttttcattaagcttcatatataaagtttatatatatacacacatatgtaaatatatatatagttgtttttatatggcttgaaataaatcctagttagaaactgtaatctcatatggctcaaaaaatactttactgtcagtagaaatatcatctacaaaatgagtgcactgagttcttaaaaatcaagtagcctaataaaagagctgctcaacttagaaaatccgttgccactttctcacatatcaattcctgccttgagtattcaagggtaaaatcccaattctgtttaaaaaaaaaagagaaaattactttgaaagatcatgcaatttaagtttatgagcataatttaaaaatagctaagctctttatatacatcacttctaattctcacatcaattttacattattttctccattttagcaatgacagaatgaagacttgaggttttaagtaatgcccaaggtcacaaaacttaggaaatgagcttgcttttaaagtcagattataaaacccaaaaaccgactcttcatacaccaaaagaacttgtcctaaggtcatctttagcattactgttcacataacactaaagccagtagttctattctagtaagagggcccacagccacacgttagataataccttttcataagagtgcttacaaaattctgtgtacaagatcgaagttggttctggttgtattgtacccatagttggtataaatattctccacaatttttattttttccaaaagatcgtttgacaaacattaaggctgagaagatttcatttcaagattacaatatgattgacaggagtgaaagccgtgtgcagagtgggaagcaaggctgtttcaaatagatacctattattgatgagcaaaatgctaatgaactgtgtcctaggaagaaaagatttaaatttgtgggaattcatttctaagaaatccaaatattcaaattagccatacttcggaaacagaactaagaaggagaccaagatcattctatccagaccttgggatatgacccgggtgaagggaaataggttgggaaaatggaatcttggttctgccacttagcagctgaatgaggttccgcaaactaacttccgtaagtttcagtcacttcatctaccaaatggggattaaaatagcatgtacttcataaaataatggaataatgcaagtcaataattgaccagcacttgagccataagtactccagaaaaaataattctcatcactagaattgtgctaatttgcttgaaagtttaaactgtactgttgacctagcatagattcaataaagaaagaactattagagaaaagaaaaagttgtttcctttccagtgaagccaaaatctcatcagaactcaccatcaaaagagagaattgtgtattgtagactaagtaattagataggaattaactttagcctaaactgactgagacaaaacatagcaccaggaaacccaataattgaaggtatcattgaattgttgcaggccatatttgctatcattggacacataaagacatcacttatttttttaagtttctaaaataaaatataaatgcaacagctatgtgacattgaatttttatctctagttgcagagtcataagatgaatcaacttcttctaggacttcagatacccaacagggagcctttagtcattctatatattccatttatttcactcattcattccttcaacaatatttgttgatcatataccacatatcagatatttcacccagtgctgatatttgagtaataaacaaaacacagttcttgcactaatggagcttaaaatctaaagagtgattacagacaataacaaaattttctataatactgtggcacatagaaaacattaaaatagggtgtatctaccaagctaagtgaatgtgtcaaaaagggggagaaatatgtgccaaagagtgtcagagtgcattaatagcactgatactactttttacagaaggtgcactcaagtattatcggaagtagtgtgtaaaagtctatgacattctttattatataaaattctgcagttaaacaaattagtttttaaaattataactacagaaaatgagacactgctagactaaaacccaaataaagctggtagcattatcccttatacatagtttatgctcagtaggtattccaactatgaagtcagttttttctgctgtttggagggaggaaaactgtaatgtacctggactcttccattaatcaaaagaagactctataccaagaacagataattataaagcctaggaaagttggttagataaaaggatagactggaaacatgaaaatatagtcaactatcttattgattagggttgtgctatgagtattacttgaatagtttaaaaaaggtatgaatttattctatactggtgtttttagaatgcagaatttctggacaaaagacattgtcctaggacaataagagaacaagatactttatgtcacaattgtctatattattatattaaatttaggtaaaattgatttattttataaaattgatactaacggaaatactaggaaaacaataattatattaaccactaggtggagccccatgaattaaatgtatggtagtcaaagacaaaattgcttaagttggtcaaattaggaaaatttatgacgtttttcttctgagcaatttttattaattttttaatttgcaatattttcagaatgcataaattataagtcctggcttttattaaagacaagaagccaaattacttgattagcatgaaacttttttgcaaactggattttaaaatcaaagtatttttgcttaagttactttataatttaccaaagatacatattccattaatattttgataacagtatataactataattgaaattgaaaacagacaagaaaaatcagtgaagcctacctattaatccactttgtactgactatttttcaaatgttatttttttcccttttgtttgtacgtgtttatgtgtacgttttgccccagaacctgaaactaaaaaagatgaaaagatgtccaaagcaggtaaggatattttgtaagatttacatacaaggagatgttctgtttggttggaagaaagctagttttacagttttacaatcctggctggataaaatatttagacatccaaaacattaaaaaaatactgatgctatgtgccatatattttacaagtaataagcaataaaactaaatgtatgctaaagttaacaaaaattccttgctttctggtagcagattttgggtaagtttatcaaagcactagaaccattagcacatacgctgctctttgtttatttactgggcaattgaacactgtttatgaaatgctaagagggcaccttaaatgtcagaggctccatacagagcatgtcaaatgcctaaaatttattattatcatggattgagttttatgaacctgtatttacctactttcaaccattttgatctccaaaaaaggagtcccacatggttcaacctaacagattaaacacttttctttcacacaattaaatgtgcaaatattttatggagaagtaatccattgacctattggccattaatttgaaagctgaaatacttttaaaatagactttctaaaaacaggttttgcaagggaagaagtcaagagattagctgggcactcaaggctagtgatgaaggttgagtggatgaatatcatagaatatgggaaaatgtagaaaaggaagacactaaatcctaaggaaaatttcaattatagtctttctatggcttatcctaattcaagtattttgtatctttataaggagatttatatgtttatatctatccaaaagaaagttgtatctatatctatatctctctgtagagtgaaagtgatactacaaaaaagcagacattcatgatgttggtctaaaaatttttgcatatattcatttgcacaaattttaatctatatttaagcagttattacaaatcacccttctatgtatatgttaaatattaaattattaaagtcatttctcttaagagcattgccatcagatcaaaataaattgtttattttcttatttttagtgaataagcatgcccatttaaagtaattttatataattttaaaacatgcattctttggaagatcaatgaaaagttgaacaattttaaactgcagaaaaaaagcataatagagataaaatgttatattgagtgtttacatcaaaagttacaaataaactttagatatatcttcagaaaaggaaaaactgcgtacaaaaaattgctttattattgttagcatttttactggagtagtgaaaactcactaatcagataaaaggtgcattatgttgtcctttcctctttgcataacattgtattttatgctttattttactgatgatatataatagaaaaagtaacatgcactaacaatttcctattattagtttacattaagtatttatgtctattttattattgttacttaaattttattttaagttcaggtgtacatgtgcaggatgtgcaggtttgttacacgggcaaagatgtgtcatggggtttgttgtaccaattatttcatcgcccaggtattaagcctaatatccattagttattttttctgatcatctccctcctcccaccctccaccctccaattggccccagtgtgtgttattcttctttatgtgttcacatgttcccatgatttagctcccgcttacaagtgagaacatgcggtatttggttttctgtccctgcattagtttcctaaggataatggcccttgttccatctgtgtcactgcaaaggacatgatcttgttctttttcatgactgcataatattccatggtatatatgtaccacattttatttatccagtctatcattgatgagcatttggcttgattctttgtctttgctattgtggatagtgctgcaatgaacatatgtgtgcatgtgtctttataacagaaggatttattttcctctgggtatatacctagtgatgagattgttgtgttaaatggtatgccacactggtctttgatgaatcgccacactgttttccacaatggtcgaactaatttacagtcccaccaacattgtatatgcgttcctttttctccacaacctcatcggtatctgttacttttagactttaataatagctattctggctggtgtgagatggtctcattggggttttgatttgcatttctctaataatcagtgatattaagcctttttttcatatgcttattggctgcatgtatgtcttctattgaaaagtgtctgttcatgtattttgcccactttttaatgaggttgtttatttgtttcttgtaaatttgtttaaattccttatagatgctggatgttagacttgcgtcagacacatagtttgcaaaaattttcttccattctgtaggttgtctgtttactctgttgatagtttcttttgctatgcagaagctcgttggtttaattagatcccatttgtcaatttttgcttttgttgcaattgcttttggcatcctcatcatgaaatctttgccagtgcctatgtcctgaatggtattgcctctgttgtcttccaggctttttctagttttaagttttacatttaagtatttaatccatcttgagataatttttgtatatggtctaaagaaggggtccagtttcaattttctgcatatggctagccagttatcccagcaccatttattgaatagggaatcctgtcagttttgtcaaagatcagatagttgtaggtgtggagtcttatttctgggttctctaatctgttctatcggtctatgtctctgttcttgtactctggggcacagctcccagaggaagggctgccatttttgccgttttgtggtcttcactggtgatatctccaggtaccggaaaatttgaggtgactagggattggagtggacacccagcaaactacagaagccctatggaaaggaggccagacttttaaaagaaaaacaaaaacaaacaaacaaacaaaaatctccattcaaagggcagcaacctcaaagattgaaggtaaataagcccacaaagatgagaaagaatcagtgcaagaaggctgaaaactcaaaaagtcagagtaccatcttcccttaaaatgactatatcacctctccagcaagtgatcagaactgagcagagtctgagatggctgaaatgacagaagtagacttcagaatgtggataaaattgatcttcactaagctaaaggagcacattctaatgcaatgcaaggaagctaaaaattatggtaaaacattgtaggagctgacagacaaaatagctagcatagagaataacataagtgacctgatagagctgaaaaacacaatacaagaatctaaaaatgcaatcacaagtattaatagcagaataaaccaagtggaggaaagaatatgtctatttttatatggtatttgcttttaatttcctattatgaaagataaatcagcattaaggcattttttattatacaatatgatcaatcaacaacttattgaaaacatatattatgctaatgtcactaccatatgtccagagttgtgcttagtgatataaaatttacaaacaagtggtaagatattatttccattctcaaagagtgtaatcagggacatagacatgagctatcgaaagatggctacaaggaaatgatattagtgaagggttccctaggaagttagagagaggagccattcctatagccattcctaagtagcagtaagcgaaaacttaatggagataatatatttaagctagaaattcaggaatatacagttgactcttgaacaatgtggtagttaggttcattaacccccatgcagttgaaaatccagatgtaacttttgacttatccaaaacttaactactaatagcctcctgttaactataagccttcctggtaatataaactggatgcacaactatttggtatgttatatgtattatatgctgtattcctacaacaaagtgaactagagaacagaaaatattatttaaaatatcataagataaaatatatttactatgatgatacttatgtatcatcataaaggtcttcatctacgtcttcatgttgagtaggctgaggaggaggaggaaaaggacgggttgctcttgctctctcaggagtggcagaagtcgaagaggcggaataaatgcaaatgggtcagaagcataactttacagaatgcatggtaatttctgtctaacttttttgctttttcatgtctccaaaaatgtttctagatagtaccaatccttcttccagcatttactttactgaagcaatgcttcatgtaagggtccctgttgtaaaataagttaaagcagtcttgagtaactggaacccctctgtcagattctctaatgccaatgtgtttctggtactacttcttccaaatctgctacctctttgtctggtactcattcagaagtactcatcttcattaaattatcttctattaattcctctggcatggtgtgtattagtgctttaatttctccaagacctgaatgttgaaatccttcacctcccaccttttttgccatatctactgtctatttcatgatttttttgattgacgctgtcatacatcctgtgaagtcatgcacaacatctaaatacagtttcctccaacagaaacattctgattcaagcttgatggctttcatggctttttcctctaacaaagatgacatcttcaataatacaattcttccagactttcatgatattctctctgtcaaaagtctcttctatagcagacaatcctttccataaagaaccatgtttaacgacccttaaaagttcttatggcctactgatctagagactgaattagagacattttgtttgggggcaagtagaccacttcaacaccttaggtgtagaactcaagagagttgtgggtggccaatggcattattcaattattaagagaatgttaaaagtcaaccgtttactggcaaggtacttcctcactgcagggacaaagcattgatggagccactccataaaaatgtttctgaaatggcttggctctgtatccccagccaaatctcatctcaaattgtaatccccataatcctcatgtgttgagggatggactgggatggaggtgattggatcatgggggcgatttcccccatgctattctcatgatagtaagttctcatgggatctgatggttttataagtgtctggcagttcttttttcacacttgctccctcttgtctgctgccacgtaaaatgttcctgcttccctttctgccatgattgtaagtttcctgaggtctccccagccatgcgaactatgagtcaattaagcctcttttctttataaaattacccagtcttcggtatttattttagcagtatgaaacagactaatacaggttctcattgtccaggtcttcttgtataatcaaaagatttgaagctggtgtttatgctttcccttcagtccttgggggttagtatatttctagataaagtcagtcctggtcataaacccaattgcatttgcacagaacagtagagttaacttgtcccttcctgctttaaattctggggctcaattctctttcttactaatgaatgtcctttgtagtattatttttttccaaaatgggtcactttcctttgcattaaaaacctgttcaggcagaaatcctttcttctcaatgattttcttaatggtgtctgagaacttttctgctgccttctcttggttggctgaaccttcttctcctattgttgtgacattttaaaaaaagccaaatctctttctaaaattatcaagccatccgtttctggtattaaattctccagctttacatccttcacctttctttttctttaagttgtcatataatgacttcattttttcttcaattatgataaagtctataggaacaactttgttatagcaatcctgcacccacataaaagctacattatcaaaatgagataaaaaagtattttgcaataagtacaaggttttcactcctgctggtatagctgcaatgaaaatttcacaaatttccttttctttttgaataattatccttatgctggatttatatatcttgaaatggtggacaaccacagctgcagacctcaatctatagtacctatcaagcaattcaaatttttccattaatgttatgacttttttatgcttctttggagcattctcagcatcactagtggcacttcatattggtcccatcattttagtcaaggtttatgatattgcactaaaaatgataaataagaactacaaaaaaatcaccttttactgaaatatgcgatttactggacagatgaactgcttatgcagagattaatgtcacacagcattttaagcagctacccacaaaacttcagttcatcacaatagtagcaagagaggctacaaaatcactacagtagtaccatatgtactatagttaatttcattcagttatcctttaatattgcatctttacatttgtttacctttctcttgactgtgcatggcaccttgtatgatctggaagtgtttatagtggaagtttagacaaattttatctttttataatcgatttatatatttgtatattttatggtaacaaatgacaaaacagactagtacctacatatattttatgcagttatgatatacctctttatttttttatatttttacacaacacagttcatgtgtgttttttcaaattgttgcaaacctccccaaaattttcaatgtatttattgaaaaaaaactatgtataggtgaacctgaccagttcaaacctgtgttgttcaagagtcaactgtgtaagagcagctgagacaaggaaattactataaagtatgatggaaccagtgttggctttatactagcgatacatgaattttactccctttgccccttgttcaggggtgtaactttacttaaattacttaatgtttctgaacattaattttcttatctattgggtgaagctcatcatactcacctagcatatttgttacatgaaacagaaatgatgctttctacttggcccagtttcagtatggtagctatatttaggagctagcctagagacaggaatgagcacaacagtggtgggagaggtgaggagaggactaaggacattccaggagtcacatggctagcagaagatggcaaagttgcagtagtaggatacagccataagaagatggctgtttaaatccaggaatgggggcttagaagactaaagtgaaatttggattcttgaggccataatcgagaagaaggtggaattgttagtcataatggcatgtagagtgaaattctatagaaataaattagaatcaggagtttgaaccaaaatcttttataacaatctaggtattataaaataaaagtaggagcaacataaaggttgcataaagagaaagtaatgaccttggaatatttacattaaattaattaacattgattactttcaaaattatttagagccatgactaatgttcagtaaatgattttttaagttttaaaaaatcactcagctttgaaacctattgaaaactactaatgacattttgttacatattccttcaggcctgtgagtacttgtgctttaaacagactatcattctctctgtactgtgttataatggcttttgtaatcatcaaactgtttcatatgaaaataataggtgttgatgacattagttctgtataactacaaggtctgaagcatgggaagatgaaggtgattaactagaagttgcaaagggaattcaagtggggtgagtgcttgtggagactctacatagagattttctatagacacttgtaatttgggaacattcactttgaatcctcaggctgggttttgtatttatgaggcgagaggtccagagtagaagacaaaggaaagagagttcttcaaacctgagaaaaaggaatacttatatattgttgatgggaatgtaaattagctcagacactgtggaaactagtttagaaatttctgaaagaacttgaaacagaactaccattcaatccagcaatccaattactgggtatttatgcaaaagctttctaccaaaaaaaaaaaaaaacacacacgtgcactcatatgttcatcacagcactactcacaataacaaagacatggaatcaagctaggtgcccatccatggtggattggataaagaaaatatggtacaactacatgatggaatactatgcagccataaaaagaataaaatcatgtcctttgaagcaaaattgatgcagctggaagtcgttatcctaagtgaatcagtgcaggaacagaaaagcaaatactgcaagttctcagttataactgggagctaaacattagatactcatggacataaagatggcaaaaatagacacttaggactactagagatgggagaaagagaggggacaaagggttgagaaactaactattgggtgatatgctcactaccttgctgatgggatcatttgtaccccaaaccacagtatcacacgatatacccaggtaacaaccctgcacatgtaccttttaaatctaaaataaaagttgaaattattttttaaaaatgagcataagaaaaaagaaaagaaccgagaacaacttcttggaaaagcaaaataactagtgaagagaaaaaaagtgttaccagaaagatcagggactacagtgtgccagcctcccaaagtggaaacactttcaggaaaaagtgggaatgtcaggagtcagtatcaatgtctcagaaaggtcatgggggtaagatgagtgagacaaagccaatacatattaccaaaaaccctgtcatcctgtgaatgtttggagagcattttcagtagagtggtggaaacagaaattagtttataggaattaaaaaaatgcatcaatcataagtgaagaaaatgcacaaactacttttgtgaggagtttgttgtcaaagggaggccaaaaatgatattcttgtatgtagaatcaaagacatatttttactgtcttcatgtttatgatagggtgaagtattccatgaagaggaggagcaaggaaccagcacagagagatattaattaagaaagaactgtcccagatataagaagtgttggaatacatactctagatggaggaaatttttttaattaagaggaagaaaaaatttccccagagttttgtgggaataatgaaaagataaattaaattaaacctgagtatttatgaagaagtactgcttggtaatcttttcttctaaatcctctcctataaaggtgaccaataacatttattgccaaatccggaggatggttttcttgcttattatgacccctcagcaatattagacaatgttttccacctcttatttctcagaaaaagaaaaaatcctctctttagcaaagctaaatcatttaaccagcaacggttaaaaataaaacaacaaaaaatgactatgcttttaaatactggagcaacagtataacaattatttatttttagcatagcatattgttggacactaaatttctttttttttctttacccctttataaaaatggtggcaaacatgacatgcatttgaagtaaaaataaagatataaagacaattttctaaatttcatgttttatttgggaagaaagaatagcaattcatgacatacctgcagactgggtggtctttgattatgtctaaagaacaaagacaagattagaggatttattaagaaaggatagattttatgtattgtttttcgagaaagtttagccagctcccattggtgagtgacagaggtggacaaaattagtcctagagttgcagcaagttatctcggaagctatagataaaactggtttcaggttacaacaagcaattccagcagtcaagtatgtgcagagaattacattcttggagccctgttttgtgccctgagtgttttctccccctggcttttctagactttgttttagttgagtatgacaagaatgacccaatttagattatcagctttcacatttccccccttttgatcaacatccttatctgaaagcatcactaatcaatcattttacagttaggcttaattatcccttcatgccaagatgaacctgtcctagttgtctctgtcccatgtctggggaaatgtttggggtcatcagagacttaggccacatttaagtaacaaatgggccagaaagaaaaatgttctcagggcagatttggctggatcccagcatcaaattccattttatctgtccctgggcagacatcagcaatcatcttgaggtattgaactaatattatcctgttggaagagttggctttacaaagattagacaggcaatagaaacaaagcttaaaaattatcatacaaaaaaccgtcagtaaacatataataaatccagtttgaataactagtttgaaagcttaaacctaattctgaaggtaaccaacaaaacatatctaaaagtctagacatattctgctgagacttgttatagccactgagtagtagtttatgactgggttgaattaaagcagagaataccagctttaccaaaaggattaccagtacaatttgaacaaaaagttgtgatagggatattgtcagagctgctcacagtacagataaaagggatttcttaggtcaagatatgtcaagttaccaacagaagctactgactgaaattttaattatgccattatccagtcaatgaaaaaggcagccttgaggggtgtaagagtctcataataataaggaatcttgttccaacatctcaaggaaagttgtttcatgtggaaaacagaaactttttgtcctagtttgtagtttgaatgtctttggtcgtggcatcaggcggttttgtgaactttctgtgtttcatataccagacatgagaattgttctttagaacttgcctagcattaccttatagggctttaaggacagagcagttctcattttaccacttttatggaagaaagttgaattggaggaacctaaaacaatttaagacctagtctagcctatagatagataacaataactaaaaatgatatatagagttacaatctaataacaggtgtattatagcttttctttgtaaacatgtttttaattgatcatatagaaaccctagatttaaaaaactcttgaagctaggaagccaaaccaaggcagactttagaatttgcttactgtcttaaggttcctgggccttccaggaaatgacagtttttatttacttattgtaagaatgggaactcttgaagtcagaaattttggacatattgtaaaatgtgacattttaattgaagccttggcaccttggtagtataagcaatgttttcaattgtattttgctgtaaagagagagcagattttattggacttttgtaaataaccatattgccataaaaatatttgcaaatagtttttaaatttttggagaaattaaataagaagaaaaatgtttttatctttgtttacacaactatattttaccaaattgcttaagaaagactttttttgaaatctggaaaacaaagcatttaagtaaaggatcaataatattttaaataacagtcataaaaacattatctttatcagttatttaatgttatataatcagcttattttcagcttgatctctattagcagtttcatggatccatcagtttctttatgtacaattttatttggtccattgatttaaaattatcagaaacctgtgtttaatgctgtgcaccgaaaacacagttttttgtcagacaatcttcaaataaactaaataagttaacacaagagaaaaaacatgtttataaaaaaaacttgcataagtaatatgcaatcacttatcttacttttatattaagaaaattaagccgggcgcagtgtctcacgcctttaatcccagcactttgggaggccgaggctggcggatcatgaggtcaggagatccagaccatcctggccaacatggtgaaactgcatctgtactaaaatacaaaaaaattagccgggcatgatggagcatgcctgtagtcccagctacttgggaggctgaggcaggggaatcccttgaaccaaggaggcggaggttgcagtgagctgagatggcgccactgcactccagtctggcaacagagcaagactccgtctcaaaaaaaaaaaaaaaaaaagaaaataaaagaaaattaatattcatatacaaaattttcacagttctgtaactgcatttctaactgctaatcaacttcttctttatatggttattctgtctgcaaaacattttccttaaaattgaactcaacatctcttccattgtccttttttcttttgctcttatctcatggaagtcatgacttgccattcagttacattggcttaaacttctgagtcatttacaactcttctttctgtttcagaacccagcatccaagtaggcacgaagttatgtgtctcccaaatttattctctccatttttttaattcttctgggtaaaacctgtttttttctgattcttattatctcttccctgaataaatatacaaaatcattaacttattatcttgtttacattttctctttaaagatctaccacaagcctatgctacttatctttacaaaatggacatctgtagggaacagtgctaggttactgtcattcattgtcatactgccctcaacatatttatttccatagtttctacttgtttaatccaccacaaccatcaccagaagcccacacagacatttaaaaaccattaccagttctgtgaatttttctcttctcaatgtcttttgaatcttcccctttcactcagtccctcactgaaaacatcctatttattcatctaacctcgaatttcatcaacaaactatcccacctgcccatgactttctagcggtaaacatgtctttatccttggtctgtttgcacatgttttcttctaatgtatcatgtggtattcatgtcgtttgttgcatagatttattctaaccttgtgtcttagctcctatattatctgttctgtgagttatgtctttaatatctaaggcagaaaaaaatatttcaaaagccactatagccacagtaggtccaacaacattatctttatggaaaggaaatcattggttaataatttttttaaaatctgtttttgacatgtttcttgactttatgatatataccacatgcacaggcagttttctgtgtgtaaaaggccaatgaagacagaaagatgtagaggaaggagctctgggacaattgatatggagtggtttacatcatcatttaacttctaagtgatttgacatcatgatttaacttctaagtctcagcttctttaaaatggaattactgacagtatattccatgccagtctatcaaatttattgtaaaaatttagcaatgtaatgcatatctaaatgtgacataatgaaaatgcctaaaaaactataaacatataaaatatatcaataaagtaagtgaaaaatataaaaggttataatctatacagttactatttaaagtgtggtccaaagaacaacatcagcatcacctagctgcttgttagaaatatagaatcttagggcccatcaagaactgatgaataagaacttgcattttaacaagagtcctaagtcatttatatgcacattaaaatttgagatgccttgttcaaaaatttatagacattcagtactgcccttatctccagaaagaaaaacatcaagcttctctcttgccacaaacttggctaattcaaaatggatgtgtttggtcctatttttttgacttttcagtgttttattcacttattccattatccctatctgttgaatgactatgcaccaagttactgtatcaatgcttgctaactaacggtgaggtcttcgccattcctgagcactggttggcatcatccacccactcacttgatgggtgatttctggactttggtcatcctaaaaatgactaaagaagacaactgtccctttattctgacactgaatatgcaaaggatcaatggcttacctgtgtgtttatttgagcttaaaagaaataaataaacccatatttagctagaagaacatgtatatcaagggtaaactgcctttatattttaccagttggctaaaaattttacataatgggtgaatgacttactcaaagaaaaacagtatgcatcgatactcatcagtcaccagagtctctttggctcatatcacttaagaaacttctaattgattactctatttagtttatatctgtcatcagtagaataaatataatatctatttaaaagttcccatagtgatcctgcaagagaaacatatatatataaaatataatatgtagaattatacatatacatattatatgtaaaattgaattttttatcatgcattaggccttgctagcctttgaggatgtataggtgaataacctaaacactcaagaaatgtatcaatgcaaagatcattaaacggttaatatctgtgatgactgataagaaatattacataaatatacacgcagaccgccatatgaatttttcatttatgagttggcagttgaatcagtatttctatcactgacaaaatggtttattgaataaccaccagatattttcatttatgtatatatatatatatatgtatatatatatatatatgtatatatatacatacatacatacatatatgtactgggaggttggtttattacaagaaaacgtacaataaattgagaaagttctaatggttttaaccatgttagttcaaggacatttattgagtacttactaagccagatcctggaaaatttaaaaataactaatattggtggagcaatcaatcaattaattaagaggattcattcacatacatgtataaattgatttcataatgtaaaatcataaactgacattaagtttcattattttgcccaagctacaggcagggaagtggactcacaaagatcaattggatgttcaggttacaaagttgatagatgacctggcttctttcaacttatcaatgaccttactcacatggccaacttgatttcaaggacgtgaaagaaagatttacagtgtcacagatagttatcttttacttcaatttaacctttaaagcagtgtatattcctcttgtcaacatatcctccatattattttgctacaaaacatagaacttgaaaaataccactacaattctattctcaatataaacagagatgaatggggtaggaggaaaggtggaaaatttgaaattgtgcgctattttgaattggaaacctaaagtaaagctaagataataaatgtagatgctgtcaggacaatagactccatattccttagagtagaaatttttgtaggttcatttcatgtgtttcttgtgctaggaacagttcctggcacacaataagagcccagttaatgtatttgaatgatcaagtgcaataagatatgtaagttatgtagtaaaatggacctggaagcctgtttcttaattcgttaaaaggggaaactgacttcatggacataatggtaagatatttcttttaaaatgcttggaatggttctggacacaaactaaatatctaatattttagttatatattatactagtaagtacatgagacagcaactttccagaattaaatgttgctacatctttcaaaatctgaatagaacactattattggccatttagcttacaaaactaaaattaatttttatttcatgtgacttgagtgctatagtcttgaatcttcttctgattgaatttatcttcaggagcttagaagaactatttcttagccaatttagtcaatcaagtatagtgtcattaatagcttccgaaccagtctatgacaggtacaatttttctcagctgatttaaaatctcagagaaattcattctctgtggatcctcaggaaatatacacatcctttcttccaagagaaaaaagacagaatgatgataacttcattaaaattactaaagattacttatgcatatactgtaaacagtgttgaccactattcagatagttaatcttgttaatcttcaattggctgtatttgagactcctccaaaagccataatttgaactttttgagctttcttcagactgattttcttgcttatgtactttatgggaatttaaaaataatgctcttttctttccttttaaaaaataaattactgaaaatcttccttcccaatttcaacccaaactaaactttaactcaggaaggtggtagtaatgaaatttaaactgcatctttcagagtggtacaagccattcactagataagtccttattacttaccacataggaagcagatgctgtggttcttctaaattaaaagaaaaacttggaagcttcttaaacacttgactgttaagaagtcaactgtattagaaaggattctgtttctaagctaatttgtaagttcctctgacagaatgttcagaaatttaaaagaaacaagttttctccatgtgaacatattgcttagtttatatcttctttgctattctaaaatatattagtttttcattatttgaacctattctcaatctccttttttcattctctcatccaactatgcttatatactatttttaatgctcaatgtattaactagtttttaaaacaatgctcttagctcattttttttctactttcccatttagtggattaatataatagaatttatgtatgaataattttctcaagtctatcatgaagtacttcacattggtgagatacttaaaagaggcttgatacttaataattaaattatattccagaggaaggtgtttcagaagcctcttgtgggcacctgtatgacgtcttcccttttcttttacttgctgctcaaatttgacactcaataacccaaaacatcttaagaaagaaaaacaggactatttatttgagtgtagtgggcaagtaaagacataataactacccatctcttctattctcatttccttggtttcagaacaaaatattctcaagcccaggtgctgatatggatgtgacaaatagcaaacctgagacaaataatggttcctttaagggccatgcttgactactttagccatgtccatcaagattcagacattttactgtgctctccttctcacaaacccttcacccccttcccatgccctaaccaatatcctgacattccaaacaagaacaggatctcccaggtcttatatcatagtaggggcccatttcttattgtctcatttttttccctaagacccacctaaaggatcagggtatgatggggaggtgattaggatgacagagtttaataaatcttaacaattaaagcatgctgtgccagagggtactaatcaatagaaaattatctccaatgcattttctattccagaccaaaactatccaatagtcacacctaaacatggcataattttctccgtttgttaggtgaagtaattataaccaacattaatgataaatctcatatataaacttatacatgttttgttttcacatatcccaaagctagatgaccatgatataattttgaaaaatctcctatgtggagagaaaaagtagtatttcctttaatggcatgtttcagtaaagggctgcagagtaattctcttttttgcaactccctccccaatattttagcagtattttgatgaattgttagcagaagtgtatttggagtgtaaatttctcaataaataaattccccattttatatggtgttgtcacttgtttattaaagacaattatggtttatcatgtgtgacaatgcacaagtgctaagaatacaaagatgatagctgcagtcccttgcctagtgaatttcttactctatctggggagacaaatgagtaaatgattacagatcattgcaattagaatgtaaagggatggcgacttacataagatgttgagagtacaaattatctctaacccttggtggaaggaggtcaggaaaggcttccagagaaagatgaagagtgagctgagtcttagtaaatgggcatggtatgttgaaatgtagcaaaaaagagaaaggacatctaaaaggaaaaatgatatatttgaggctacaatgaaggcagaaatggaggaagaaataaacaagtggggtcatactcgagatatctttacaaaatagaatcaacaggactctatggacaatagagatggctagtttcattattagaacctagtcccaatccccggtttttctttcttttaactaaccatgcttatgtactatttgtaatgctcaatatattatctggtttttaaaacaatgctcttagctcaaatttgtttttttgttttttaatttcatggattaatgtaatgtttatgtataaaaatatttttcaagcctatgatgaagttattcacacttgtgagtatggagaggaatcttagaagacttctaaccttctggttggaagagtaggtgaagtatggtatcatttactaatataggaaatgtgtggatgatgaaatagtatatcatgaattcaattttggatttaagtttgaatttcctgaggtatatccactttgtttcagaaggttagatatgtgactcagtagtggaaaaggtccatttatcccttgatattctattcttctccatattttcaagagaaatttgtgatgtctggaatggatgcgccctttgcatggcctttgaaggaagtatacctagcactacatttcaaccaaatcttatttctgtggctatgatcagaattaaactcatccataagaattcagtttcaattgataggtaagcctgattggccaaaaattcttgggagactgaagtgcttagcacatactaaatgtttactgaatgaatgattggataattaaataatcattgtataatgtcagtattatacaaagatccacataaaaaaaaacttcgaagtagtgtttctgattaatcatatctacttctctattggttctctattaacttcctctaatctttcatgctcgatcatggtgcaaacaaaaatttgctactaaacagtctcttcaacatcactttaatcacctttgaacatcaagaggcagaacacaaagggtttctcactactcatttgaggcaaaatatcagataactgtctgagatgaaaagtgagaacagaatggtcaacagtaagatgcttgaataacaactaaaaatatttcatagaaattattgtagtgcagcctcaaaaaaaactttaaaaataatgggtgcctcgaaaacttagcataatatatagccaatgcataccaactaggatgaaaaaggcatatcaaccacagaccctgttacagataatcttgtttaaaggactttccaaacactctcttatcttgcccattattgctgcttttaaaaataaaaaacaccataaataatatttctacttcttatctatcaggtcacttttctatctatcctgacatgaagcaaaattttttccagaaatttgttctaattgtcagagacaattcttgtttaccaaatggcctttaaaagactaaagggaaattttcaaagcatttaccatttctttccctgatgttcagcattgtgtaaataatattaacacacatcattatctatgaaatccctaagaacatatttccaaaattatatacataaaactatattattttattcaagtaactttttacagcacatttgataaatgagactgccttatatgagaatacctctataagtaaggaagaaaaaagaacgtttgtgaactctaattcatacacagctcagaaggcattttctcttagagtcttatattatattttatatatttaacatttatatttccattttaatcttgataattaaaagtttcatgaatctcagaaaacatgtctccgaatcataatggcttcaagtaaaatgtagtaacatttctaaactgattgaagcatcccattaaagtccttatgatattttcttgcatccccctaatggtcttcttattgaatatatgtggtagaaagtttagatattaatcttcaagtcaatttaaatggtaaaatgcctgtcggatggttctttctggctaagatgtatatctacagcaaagtcaacctctgctctgttctaagtagtggtaggcatagatatatctgcatcagaatcactggtcttaaaaacaagatttgttaatacgcccttaaagttaaacatgctctgatagattaaagcagaaaatctatcacgagttgagtaaatagatgtcttaaagagcagtaaacccaggagaaaataatgctgcaacatttcaggttgatttttatctgaactgcatttccccattaagcaatttactcttgagatttaaattaataaaattttaaaagttttaatttgccattcattcatcttttttttttttctgtttgagacacagtcttactccatcacccaggctggaatgcagtggcgccatctcatttcactgtaacctccacctcctgggttcaagcgattctcgtgtttcagtctcctgagtagctgggattataggcatatgccactacacttggctaactttttgtatttttagtatagatggggtttcgctgtgttggccaggtcggtctcaaactcctggtctcgagtgatccacctgcctcggtcttccaaagtgctgggattacaggcatgagctaccacgttaattgataaataataattgtgtatatatatgaggtacaatgtgatgttctgatttatggatgcattgtagaaagagtcaatcaacttaattaagatacctatcacctcaccaatttttcattgttttgtaataagaatataaaaaatattttcttttggcaattttaaaatatataatacattatagatgcagggcaggtgagccccaaagtgaagcttagcctgcaagtgttcttggctttgcctaggaaagaattcaagggcaagccaaaggtacataaaaatagccttattgaagaggcagcattacagctctggggatgttaagctctgtgactgctcctgcagagcagcgctagtccataggcaaagagtagcatctcaggacagttttgtagtcatatttatacccacttttaattgcatgcatattaaggagcagtctatgcagacatttctaggggaggagtagtcatcactgagtcacatggaagggggcagtaactcctgggtgttgtcatggcaagggttaattgacatggcacactggtgggcatgtctgattgaaagctgcttttgccctggccctgttttagctagtcctcaatctggtccactgtctgaactctgcctctggagtcaagtcctgcctccttcctcatttcctgccccctcaaagattagatactcctccttaatcttaacggactgcagaagggtaagattcattttctgtaactgcttcttgctgagtttatgggagtaggccctgcctagcactggaggagtaaaaatctctagatacctgctgtaaggggccagaagcaggacacttccattctccaggtcagtagatggaattgcttggaagccttgtgccagcactgtttttacttggtaaaatcgtggtaatctaaaacaggggtccccaaaacagggattcccaacccccaggccattgactgttattagtctgtggcctgttaggcctgcacagaaggatgtgagcgatggacaagccagtgagcattattgtctgatctacacttcctgttagattaacagcagcattaaatctcatatgagtgcaaaccctattgttaactgcgtgtgcaagggatctacgttgcatgctcattatgagaatctaatgcctgatgatctgaggtggaacagtttcatcctgaaaccatcacccctatccacacccccgaccccaggctgtggaaaaattgtcttccatgaaaccagtccctggtgtcaaaaaggttggggaccaccaatgttgaagacacaaactttactaggaggttaaataagcaagggccaatattagtaacaagatagcaaccaagttcctaggagaggtaaaaaccaggtaagacttgggaaggcacttttgatagttggccagatatagctggggtcagtgccctggttatatctatgtaaccaggtagctttctcatagaccttttgaatgttaatctcaacttgtccacggttgttaatatatgtgtagcatgttttattattaactttacagaatccactgtgttcagccggtaaataatccaacactagtctattatcaaaaactacatttgccaaatggtctaaggacacttgaattccctttaatgcctgacctgtgttggtagctaaggtttctagggtttgagtcaagctccttaggattgacttatggtagacaaagcctccccaaggtgctgctagtcccatcactgccttgattcctgccggaatcaaccctattgctagcttacttctggtattcgtgggtcttatgaaataatggacagtgacccctgggggacaacgctggccaatgtacattcatctctgttccaagtttttgatgtacaggggaaagctactcctaagacaacaggtgactccctagggagttcctaaaggttacagtgtttgacttcttcccattcatgaccagaaacaaaaatgagcccagagggggcacaaacagaagccctacagggtgtgatgtttatcctttgcttccaagttgtgtctatagagatattttttccctgttccaatgggggtggcaggacaatctttatttttcagaaggggggtactcctacctttccagactaggcagtgatttttcccttgtatgttgtgatctggaagaatgcaccatatatggtctcctaacttacaagtggaatcccatttactttactgcagccttgggaacttgccaactgtagttgaatcaaagaatcacagggaaacttctgctgttgtgtcattaacacaacagtgggtgcaaatgataaactcatttgtgcactggagatatagatacacaatttttcaggtccaagtaatagtggcaggaggattcaggtataatccgttaagtggggagagttctatttaccaagcaggggtttgaatatttcagcatcactatggttagttaggtctggggtaaaaaccaggtaagatgtgggaagtgagacttgtagtgagtgattttccaagtaagccataagatagacctctctagcctgggaatgttgatgaaaaatccagcaactgtgaagatgatttcctgatgcaataattgttgaaatatttactatagagttatgttcccacccatactggatcatagtaactaggggagcaaacaggatgaacagtgacatcgtgattcagctgggccttaacgtggtctctatgcccaacaaagacaaaagagatgtttcccaagggattggctaaagtgatacaaaggaagtattacaatcaggaagaagagaaaaattgtagctcccattcccacccacagcatcatgttactacttctggctgagatgttgattctttaaatagcagaggtcccccaaaggttcacagatgtaggtgttggtgtcccccttttgtagctgtgactcgtaagacataggttaaccctggacagatgtactcagctaggtattccctgaagtttaacagcagagggggtactcaatgacacctgataagggcccttccattttggttgtagttgatcttcaggggattcttctttccaagttttagcaaaagtaagtctcctggctaaacaggggagctatttttcctctctgaagaagagtaatattttatttttatagtggaaagccttttgaacctgacctaaattccaaaagggaaaagggaagtttgtatagctaattactataagctaagaccacagcagctaaacttgtccacagacaagtaatttttataaatacatttcctggctcctagtctctggctcccacactgctaaaaaggggttcaagggccaataagtgtccacccacttccgctctgatccaggccagaacatccaactggctacaagtcccctggctccaaatgccccagccatgggggtcccactgagggacattatggacccagggcaggcagcacatgaccttgtcatcagcataggacaaaataaaacatggccattgatgctgcctctagcacaccatgacaaaaagaggtaatacaaaacaaaaatcaagatccatgggccgaagggaatggagttgagcaggtacccactagccccaaaattccttctaagcaacttaagaatcaaaaaccaaaagccaaaatgagattacccattgaggaaaaccaacagcatagaattaagctgtatttggaggaaacactgctcccacagatctctaggacaaaacactttaccatcagaccacaacagcagtcataaacagaggagaaaaattaacaggagctgacaaaaaagctgaaggagagagttacatggatctgcatagctttcaaaagaaatatattgcagaattgaaaataaaattttctggtaatttagcaaattaatacctttagaaaatttgattttgatatttaggccatttgtaaaaagtttttttacaaataattttctttaatcatagcaagtttttaattttacacaaagttccctttataaattccccatttatgaatcttatcacaaattacacagactatctaaaacttgcttgaaatttctgacttgtcctatactacctctttcttttttgtgtgacggagtctcactctgtcgcccaggttggagtgcagtggtgtgatctcggctcactgcaagctctgcctcccgggttcatgccattctcctgcctcagcctcctgattagctgggactacaggtgcccgccaccactccaggctaattttttgtattttttagtagagacagggtttcaccgtgttagccaggatggtcccaatcacctgacctcctgatccacctgcctcggccttccaaagtgctgggcttacaggcgtgatccaccgcacccagcctatactacctctttcttaaataaccagtcatgttactctaggacaaaatatgactatacaagatccctcttcatataaaattactcttttattatatgctttcttggaaaagaaaatacattttttttgacagagtctcactccaccacccagacaagagtgcagttgtgcagtctcggctcactgaaacctctgcctcttgggttcaaatgattatgctgcctcagtcccccaagtagctggaattacagatatgtgccaccatgtctggctaatttttgtatttttaatagaaacagagtttcaccatgttggccaggctggtctccaactcctgaccttaagtgatctgcctgcctcagcctaccaaagtgctgagattacagttgtgatccactgcacccagccagaaagtactttttctttccataacattctttacatctctctttttcactcactggttccctcatattttgaaactcccttttaataacttccaaattagacaaaaattattttttccaaataaaggatatatttctttggcacattttatataaacctagaaaggaagaaatcctgaactgcccagcagacattgacattctataggtgaggattattctatcattttaagactttaaaccacacaataagttcattatttaagcatcgattccgttctttcacttttaacagttttatctagaccacttctaagaaacaagataccatgcaaaacatgtcaccatttaaagccattttaaccattttaaagccaatgaacatcagtgatttacttagataaaaattctgttaaattttagaagacataatattctcttcaaactagtaagctttgactagtcttatttaatttatgagtgctcttttatttataagccaatttcaaagcatgctagacacaacacatatcacaatgcctgtagatagagctaaagaaacacactagataaaatgacctatacaagacaactggattcaagttatttacaaaattgggacccagctgcctgactaaattttgtttgcctcaataggtgtggaaaatagaaagagacagggaaggggattccatagcatcaaataaagaagggaaggagtgaactgcattactcaagggactatcccggagtccctaaggcaccagagagctcacccagtagtggagacactaaagaaaaatgttcaggcagctgtttatctgccactgtgggaaactttccactgggtcttgggtccaagactcccagtaaacttacctgagcaagacagcttgcatcttactggggacagtgaaagagttagctctggagttggtggagaactttttttctgtctctcaccagggatagtcaaaacattcttattgtcaatggccctcttgctcatagcaggcacactgattctggctctggggcccccaagttgatagctcttgtctgggcatcctagacactggcttcactacattgactcaagatgggtaactctgagggaaaagagactaccccataggcagagagtagcagctcagggcagttttgcagtcatatttatacccactttcaattgcatgaagattaaggtgaagattatgcagacatttctatgaaaggggttgtaatcactaggacattgccatggaaaggggcagtaactcctgagtgttgtcatggcaatggtaaattgacatggcacgctagtggaagtgtctgattgaaagctgctttcactgaggccctgttttagctaggcctcaatctggtccagtgtctgagtgccacctccagagttgagttctgccccctacctcattattattgactgtgatcgccatgagaacaatagattactaaaacttattcctccagtttaactgaaactttgcacccttttatcagcatcatcgcttttcccatctctccctctattctctaccctctggtaaccaccttcctattctctgtttctatgagattgacttatttagattccacatataatcatgcagtatccactgatgttgcaaatgacagaattttcttcttttttttaaggctgtatagtatcctattttgtgtgtgtacgtgtgtgtatatattatatataatatatataacatattttatatatatacactatacatacatactatatatagtgtatatatatatacactatacatacatactatatatatatagtgtatatatatatacacacacacacacacacacaccccccacatttttaaatccatatatttgttgatggacacttagtatcttgcctactgtgaataatgctgaaatgaacatgggagttcaaatatctctctgacatcctgatttcaattcctttggatataacagacgtgaaattgctgtaaactagctgaaaattgctgaatatggtaattctagtttttttgaggagccttcatgctattctccaaagtgcctgtactaatttatgttttcaccagcagtgtacaagggattccttttctcctcattctcatcaacacttatcattcatctttttgataatactcattcagacaggtgtgaggtgttatcttattgtagtttaatttatatttcccacatgattagaaatgtcaaacatcttttcacatatctgttggcctttcatatattttcttttgagaagtgtctgttcacatgctttgcccattttaaaataaggtgtttgttttctgttattgaaatgtttgagtcctcaaatctctttgcttttagccctttatcagaagtatgatttaccaatattacctcccattccataggttgtctcttcatttttattgttccgtttgctgtgcagaggctttttagtttcactcaatcccattagtttatttttgattttgttgcctgtacttttggagtcctacctgagaaataactactctgaccagtggagttcttccggtgttttcttttagtagctttacaatttcaggtcttatattaagtcttctatcaattttgagttgattttatgtatacactgtgaaataagagcccaatttctttctctgcatgtgaatatccagttttcctggcactgtttattaaagagattgttcttttcctattgtgtgtttttggaacacttgatttttcctttttaattcctttgctaattcattgaatgtgacctttatatttttattttaaaaattaatctatgcataatagggtataaatggaaacatgccattgacattttgtttgcttttaatgcaattaaagaaatttggaaaatatagaaaatataataactataataaaaaataaggctaaaatccctatcattacaataaacatatatgggtgtgtgtgtctactcttatattgctactcactatttgaaacatattccatcatacacagccaattattacctccattagaacatcaagtctattatttgattttgtttgttaaaatattttttcttatataaatttgatttcatatcatatattttatagacctcaatcacaaatgtctaatttgaatattactgtcattgggattgaaaagttgacataccatgatcaacacaagcatgctctgtttttagctttatctattgatgtctcagtagactgaaaactttctctctgactctaattaagccttatttgctgaaacataatatatacaattacgtgggactcagaattgtgacaaacagccattcctttgtgttacatgaatgctcttaaaaaaagcaactacggttatcaaacagtggttctcaaatttcaacatgcatcaggtacacctggaagattaaatttacatttctaataagttcttatgtgatattgttgtttgagaaccactgccttacagaattctcccccagtaatctactcttgggcttactattgctgcctaaatatagaccttagggagtacgtaggcttagaccatggatagacagacatatacagacactgtattcattaatatatttggatatgtgcttaactgtgaaatgtcttcagatttgaaatgggtccagtatcttaactgaatatacgaattcatgaaactggaaatgtaaaagaattaaaagatgtttatattttattggtgagatttcatcattaagacctctttgcactctttctgtgcttcttatctgttgattaacaaattctaataaattatccttttatgcactatatgtggtgaatgatgattttatcccttcagagcaataatttgtacatctaagtggccatcaggatcatttgagaaggatgttaagtgacaaattcctgggccccacctccagagtttctgatttgataggtctggaatggagtccaagtagctacatttctagcaactccccaggtgctgctgctgctgctgctgctctggaaagtacactttgaggaccattgcactagaacctagactgacaaggacttctcagtgggaaaacacagacacacaacactcccccacatgctgaagagtttgtgaaacctgatgtgtgtgtgtgtttttttaattcctcgtattttattttattttttcataggttttgggggaacgggtggtatttggttacatgagtaagttcttcagttgtgatttgtgagattttggtgcacttatcacccgagcagtatacactgaacccaatttgtagtcttttatccctcaccccactccctccctttcaaactggtccccaaaatgcattgtttcattcttatgccattgcatcctcatagcttatctctcactcatgagtgagaacatacaatgtttggctttccaatccagagttacttcatttagaataatagtctccagttccatccaggttgctgtgaatgtcattaattcgttcctttttatgtctgagtagtattccaccatgcccgacctatactacaatttcttcatcaactcattggttgatgagcatttggggtgattccatgtttttgcaattgtgaattctgctgctataaccatgtctgtgcaagtatccttgtagtataataatttcttttcctctggatagatacccagtggtggaattgaaggatcaaatgatagttctacttttagttctttaagaaatctccaaactgttttccaaagtggttataaagcttacattcccaccagcagtgtagaagtgttctcttttcactgcatccatgacaacatctattattttttaattttttgattatggccattcttgcaggagtaaggtggtatcatattgtggttttgatttgtgtttccctgattattagtgatgttgaacattttttcacattttcgctggccatttatgtatcttcttttgagaattatttgttcatgtccttagcccactttttgatgggattttttaatttgtttgagttccttgtagattctggatattatttctttgtcagatgtatagattgtgaagattttctcccactctgtaggttgtctgtttactctgctgactgttccttttgctgtgcagaagttctttagtttaattaagtcccaccgatttatcatagtttttgttccatttgcttttggattcttgttcatgaagtcttttcctaagccaatgtctagaagggtttttctgattttatcttctagaattgttatagtttcaggtcttagttttaagcccttgatgcatcttgagttgatttctgtataaggtaagaaatgaggatccagtttcattctcctacatgtggcttgccaattgtcccagcaccatttgttgaatagggtgtcctttccccactttacgttttactttgctttgtcaaaagcaatctgtaagtatttggctttattttggggttctctattctttcccattggtctttgtgcctatttttataccagtaccacactgttttggtgactgtggccttataatatagtttgaaatcatgtaatgtgatgcctccagatttgttctttttgcttagtcttgctttggctctgtggctcttttctggttccatatgaattctaggatttttttttctagttctgtgaagaataatgatggtattttgatgggaattgaactgaatttgtagattgctttgggcaatgtggtcattttcacatattgattctaccctggtcattttcacaatactgattctatccatccatgagcatgtgatatgtttccatttgtttgtattgtctgtgattgctttcagcactgttttgtagttttccttgtagaggtgtttcacttccttggttaggtatatttctaagtattttaatttttttgcagctattgtaaaagaggtcaagttcttgattcgagtctcagcttggtcactgctggtatatagcagagctactgatgtgtgtacattaattttgtatcctcaaactttgctgaattcatttatcagttctaggggcttttgggagaagtctagggttttctgggcgtataattatatcctcagcaaacagcgacagtttgacttcctctttactgatttgaatgccctttatttctctctcttgtttgattgatctggctagaatttccagtactatgttgaacagaagtggtgggagtgggcatccttgtcctgttctagttttcagagggaatgctttcaactttttcccattcagtgttacgctggctgtgggtttgtggtagatggcttttattacatttaggggtttcccctgtatgccaattttgctgagggttttaatcataaagtgatgctggattttatcaaatgctttttctgtgtctattcagatgatcatgtgatttttgtttttaattctctttatgtggtatatcatatttattgacttgtatatgttaaaccatccctgcatccctagtatgaaacacacgtgatcatgatggattgtctttttgatatgctgctggatttggttagctagtattttggtaaggagtttttgcatctatgttaatcaagaatattgatctgtagttttcttttttgttatgtccctttcttgtttgtattagggtaatgctggcttcatacaatgatttagggtggattccttctttctctgtcttgtcgaataatgtcaacagaattggtaccaatttttggggggggggcaagagttagtgcattttatttattttttattatactttaagttttagggtacatgtgcacaatgtgcaggtttgttacatatatatatatatatatgtgccatgttggtgtgctgcacctattaactcatcatttagagactgaaatggtaataaaaaattaccaatgaaaaaaaattccaggaccagaaatattcacagcagaattctatcagacatttaaagaattgggtatatccacccaattcctggaattttttttcattggtaattttttattatcatttcagtctcgctgcttgttattgatctgttgggggtttctaattcttcctgatttaagctaggagggttacatatttccaggaatttatccatctcatctaggttttctagcttgtgtgtgtaaaggtgttcatagtagccttgaataatcttccatatttttgtggtgtcagttgtaatatctcccatttttgtatctaattgagcttatttggatcttctctcttgtttccttggttaatcttatttatcttttcaaagaaccatctttttgtttcatttatcttttatatattttttgtttgtttcaatttcatttatttctgttctgatcttagttatttcttttcttctgctgggtttgggtttggtttgttcttgtttgtctagttccttgaggtgtgaccttagattgtctatttgtgctcttttagactttttgatgtaggcatttaaggctatgaattttcctcttagcaccacctttgctgtgtcacagactttttgatagcttgtttcactattatcattgagttcaaagaatttttaaatgtccatcttgatttcattgttgacccaatgatcgttcagaagcatgttatttaatttccatgtatttttatagttttgaaggttccttttagaattgaattctaattttattccactgtggtctgaaagagtacttgttatcatttcaattttctgaaatttttaaggacttgttttgtggcccattaaaaaagctattccgatgatttccaggatcttttcagttttaaaattctttccttttgcattataaaatttataatgtcctactgctcttataccaaattattatcttgtattaaactttaatggacttacttaatgagtctttataagatcacctaaataaaagtttttccagtgaagatctttatatgtgttatatgccccaaataatattacacttacaaattttacaaaagtcaaattttatgataatgacttatattgtcttgacaaagttaaaatataataaatctctgttgaggaacaggactaatttcctcatttgatctaatagagcagtttctgtgacataattaagcaaattatgaattttgtgaataaattcatgaaagttcagtttgttacttgtatttggaaagtttacttttttctacttttacaatgaaaattctaaaccacataatatataggctttagcgcactctagattggtttttgatatgtttatctcacattgtagatgtagttatacagtttaatataaatataacagaaagtttctttatgaatgaattaatatagtaatttgacaaatatctgttaaaatatgttaaatctatttacagatatgtggatcagaaagattattaaatgatattatttcactgttgatcactgttgattaatcatcttaggaagaaatttggtataaaacagattatgtacaagcctttattgacattattcaataatgactgtggagctagaattgttaacaggctaaactatatagacttatagaatgtatatatagaacttatatatgtagaactatatatagttcattgtagacctctgactattgatacatatataaattctgaagctgagcctgtagatgcatcactcccatcctccagtctctgcctctgttgtcacacagtattctctctgtgtgtcttcatattacattccctctatgtttgtccatctctgtatctcttttcctcttttgatcataacgctagtcatattggattagggcccaggataatgatctcatcttaacttaattataactgcaaaaactctatttccacacaaggcacattcataaggtactgggcgtctggacttccacatgtattttgggagacagaagtcagcttctaatggatagatagtataaagagaaagctgaataactagagagatgttatgtgaatgctgatgaggttgatataggacatggcatgtagacaactaactcggaaaccaaattttataattggacagctttgtgggaataggcaggtgtcctgtgtttatcacaacttggttttataaatagcagaactattaagtcaacattttcttaatctagttgggctttaagagcacaactgaacacacatattttcacacaattgtatgtgtattttagggttttttggtgtttccattcatgtttcttagaggattgtgtcaatacatgtgttagattctcagaaagaaatatgactatgtattatcctttcctaccactggagagaatctccataaccttgattttatccttacatttagccagagcacatagctatgtccctaaatcacatttattgggccaaaagtgactttcctcttattgaactgtgctttgtattgtatctctggtgcatgttaagagcagtaggtggggttctgtaaaagccatcacacatttagggtaaaaatattgctgaggctgttatttacattaacaaaaggttatttacattaacaaaaggttctcagccttttgttctgagaacccaggaaacaaatttatctcagttatcattgccagtgattactctgcttctcttaaacagagtaagtatttacatcttaagaacactgtaaatggtttaacatttgtgcttttttttccgcctgaatatcagaaagatgagaggtaaatttgcaacccaagtcaaagaaactatgcagtaactgtaacatgtattttgtgtttaatacaattcctaaatttatatatttttctacattcatttttgctcaatttctcaattttttaccttatttgttttacttatttatctaatgagcaaaaaaagaatgagagcctatcttatcaccatgtattaggaatcgcaccaattccctgcattcaatgatagatacacatgaccactgtccccaaatatctcacaatgtagaaaagaaggcattcacttaagttgatacttgcaatagattatgactaacataatgataaagagatctaccaagtagtattagcacataaaaggagtaagcaattccgctgcatcagaaaaaggcttctgagaaagagacagctaaactaggccttaagcagaggttagccaaaaaaaaaaaaaaaagaaagaaaagaagaggaacaaaaagaaaatagtgaggggactaaaccctgatgatgaaaaaagtcaaagaacatctagatagagagatactatatgtagataggaagattcaaaattatgaaggtgtcaattctttccaaattgacctatagagtcaatgcaattatggaaaattcccagaaaattattttgtgtgtgttgacaaactgaatataaagtttacgtggaatggaaaaagatccagaatagcaaacacggtaccgaagacaaagaacaaagttggaagattgacgctattgaacttcaaagcttattataaagttttaaaattctttccattttttctttccttggcctcaagtagtttatttgtgtgtatatgctgttcagtgctcttctgatgacttaatgtcaccttccacacatctccagaactcccttcctcttctctgctgctctctgctctaccttactctgatctgtgataactgactgtcttggcctttccagactaccagctccatcttataagctccgtgatttgctaggcaactcattgctgcactaaggccttgtaactttctccaagcactaagcggaagcaatcacagggtacatctcatttgtttcccatcactaaagtatcactgttctttgttgtctgatgttcaatatctttaaaaccattgttttatgtattttgtctgttttccttaatttccagtatgaggagtaattagacccctgttatgttatctttgctaaaagaaaaagttactaggatagttttgaaattaaaagaaggcagtattaatatttatctcattacagtagagcatacatattatgtttacctttcccaaaagccaagtgaacaggaacttaaaaagaaagggaaagtgatcaatatggtcaaatatgttcattagtcttggaaagtaatgggaaattggtgaccagagagactaatccatagaatggtggagctagaaactagattacagtgaattaatgatgaagtgggagtgagaagtagaaaaaacaagtaaagatgatattccttaaaaagttgagttgaacagtgacagacaggtactagatggcatttgtaagaaaacagaatcagagaaaagtgttgactattcaaatatttgttgatgcaaaaaagagagaaaattaaaactgactatgaatagagcagaggctgacaaaatggcccacagactggccactagtttttataaagttttattggaacacagtcagtcatatttatttacattattatctatggctacttctatattcacacaaatgaagaattgtgagagactatatggcctaaaacctgaaaatatacactatctgacagttacagaaaaagtttgccaatcttgcactaaagaacttagccataagttacacattctatagaatttcaacaaaaaaggataggtggggtctacattgtttcatttttattttcaaatatattatatcatattcaataatgttaatttaataagaattgtatgactcagcctttaataatttttttacttttttctaggcaaagaagtcaagcctaaacctccacgtatgttatatgcatgctcaataaacaaacacgtacatatgtacatacatacataaaacaaatcttaaatgcatgctgttatttatcttgatttcatgttgaatattttgcttaaagtcaaaggcttgttttgtgtagacaatgtactcattttcttacatgtatttctgagaaaatgctataccaaaattttcctttatcttttattcactggaagcatctttccttaccttgtcattaaaaatctcagctcagatttccattattttctcaaaaaaaatttttttgagacagagtctcactctgttgcccaggcagtgggcagtggtgtgatctctgctcactgcaacctctgcctaccagcctcaagtgattcttgtgcctcagcctccccagtagctgggattacaggcacgcaccaacacacctggctggccttccaaagtgctaagattacaggcatgagccaccatgcctggctctcaaaatatttcttactggaataatagtgaggaatctgttgttacgtactagtttgccacaatcataagaatatggttaatatgacatgaacttttcgaagttaataggagattgaaaccaatgaataacatagaaaataattatataaaaataaatatgcacaagtatataggaaatgaatatctttctataatcattgttactaatgttcatctatatttttagaactacaaggaaaaaaggaagagaagccaggtatgtatattttatttatacacatatatgatttccatgtttagaataaatagcacaatatctctttgcaaatgtcatgtcctagtacaaatattttatcaaattttatccttgaccaacttaaaaaaaaactaacaaaatatatatttctctatgctacccatttctagaaaaacctctatttgcataggtgaaatatctgagaaatttacatggttcagaagaagtaactaagtaattgaattgattcccacaaaaccaagattttctctgattattgtaggacacagacattcaatcagcaaaacatctgctctcatccttctctcttttgaggcttctgagtcagatgaacatttctgaaggctacagtaggcagtagaaactttttcaaaagaacactcaactgtctggttctgaacacagttaaaattttgtttaatgtttcataattgtattattgttgtagggctactgtagtaaaattccacaaactgggtggcttaaattccacaaactgggtggcttaaaacaacagaaatttattgtctcacagttctggagagtagatgtccaaaatgaaggtgtcacaagggacatgctttccatgaaatctgtagagagaaatccttccttgcatcttctggtgttttccagcaatccttggtgttccttggcttgtagatgcatcactttcaaactctgcctccatcatcacatggaaaccttctccctttgtgtctctagctctgtaaacccttctcctctaataagtacaccagtcatattggattaaatacccaccctactgccccatgaccacatcttaactaattacatctgcaataaccctatttacaaacaagttcctattttaaggtactggaggttaggatgtaagcataccttttggagagatgcaattaaatccataacagtccattctctggctggcccaaaatttatgtcctccataggtgcaaaatatgttcaccccatcccaacatttctaaaagtcctaaccattctagcatggttctaagtccaaaatttcatctaaatatcaatcaatagttcaaaatctcattatctaaatcatctaaatcagttacatataaaacttggagtatgattcttccttcagcaaaattcctcttctctttttgaacctgtgaaaacatgaaacaaattatttactcccaaaataaaatgatgagatacgtataggatggacattccccttttaaagggaagaaattgcaataaaataaaaagaggtcctgagtcctaagcaaatccaaaacctagcatatttcaaagcctgagaatattctttctggctcagtgctctgtactctgggactggtggaacagtggccctgtcctcttagctcagtgtgctgacagccctgccttctccaccacaggaggtcccattaacccaggcgtttgaattcatggcttttctctggagtcattatcccttcattttatcatgtctctgtcccttttttgtccaggctggcattgtttttgcttctttaaaattctcgaaaacctgactagtgtcacattcaattcatggggcgtctaagccattagataagagggtcctccacagatgtttcctggataaccacatctctatttctgtcttctgctgaagtggctccatgagtcatacatctaacctctttagcaaaagtttgtccaaccacaaccttggctctatctccatggcacactgtctagataggctgagaattttcaaatcagtaagtgccagttcttattcgattaacggtatcttcttcaatttatgtgtatctttcttttcacattttattataaacaacaaggagaaatcagtttgcaccttccatactttgcttgaaaatgttcttagctaaatttttaagtattcacttactatttccatcttccacctaacagaagaacacaattaagctaagttttttgccactttataaaaaatattacctttcctttagtggccaataacatgttcctcattttcttgagacctcatctttaaaactcatatttctagcaacattctacttctacttacaataatatatatctatatgatttgaatgtgttttctcaaaatttatgtgttacctgtgtaataaatagtattgacagctggagccttgaagaggtgattaggccataagagctcctcttttgtgaatgggaacaaggccattataaaagaggctccgtgcagtgttcagctagcctgctgtcttccccttttggctttgccctgtaaggacacagcattccttctctctgaaggacacagtaacaaggcattatctccaaaccagagaccaaacctgctaataccttaatcccaaacttcacggtctctagaagtataagaaatacatttctgttctatgtaaattacccagtctgtgatattctattatagcagcacaaaatggactaagtcacaaatgtatcatttaaaatgacaagagctttctctatagctctcttgagttctttctgagccctcatcagaataacctttaatgtcaatatttctgccaataatctcttcaaagcaatctaggctttctatattaagtgtctcaaaattattctagactctacccattacccaatttcaaaaccacttttacatgtacaggtatttgtttcagcagcacctatgttcctaaaccaaaattgattagtttccttggatggctacaataaaatatcacaaattgtgttgcttaaaactggagaaatttttctctctcacaattttggaagttaaaagtccaaaatcaaggtgttgacaaagcaacacttctttttaaaaccgtagaggagaatatttgtttgcttctcctagcttctggtgttttctggcaatcttcggtgtttcttggtgtgaagatatatgacttcaatctctgcctctattatcgcgtggtcatcttctctatttgtgtctcttttcctcttcttataaggacaatagtcatattggattaaaaacctacccttctctagcatgacctcatcttaccttaactaattacatcagtagcaaccctatttccaaataaggttacattcttaggtactgggggttaggactcaacagattgtttgggagaacacatttgagccataacattatttgtctcaattcctaaatcacgtaagtacccaattagatctatttcaaagagtctcttccaactcttgttgttaaaataatttatcttatgttgactttggaactattttctgcaataatcatcttagaaaaaagtagaaaatttagatttaaaagaatgagctatagcaacaatttcacagacaagtgcaaagcatgtttctgtttcatgtttaatagtccatcattggcaaaccagtgtaaaactggtttttttttgaaacggagtctcgctctgtcacctaagctggagtgcagtggcatgatctcagctcactgaaacctctgcctcctgggttcaagcaattctcctgcctcatcctcccaattatgataaccaaataaaattatttctaaaaattaattttcattctagtttattttttcaggttttaaattttctgccttttctctccctcagagccccaaattaaaaaagaagcaaaaccaggtaacatgagctttattttatatagattcagagttgacattatctttattttattaagtactaaaagaggcttacatctcactagggagacatgcacatagtctccaagttcctcattattttgtcaactccattgctcaacatgattttatagcactggattaggtgagaatgggaatattccctagactaaaacacctagaaaatggccttaaataaatctcaacagagactctaggtttctggagacatttctaaggtttttatgaaattaataataatcatgcttaacttatggctttattttcataattctggtggctttgtttttataattctgaagtatttccagtaatataccagaattataaaatcataaagttatagactattgtggtttgaagggaatgagagcaagaatttattaagcatctattgtgagctaaggactagcataggatttttactttcatcatatcattatgagaaacagacagcatggccattattacctatacttaatatctgaagaagcagttcaatagatcaagttcagaaaataagttattattccaggattttcaagttaatcaatgttgaagctaggggtctgccccgtgtctgatttgcaccaaaccctgggtacccccattaagagattgtccctaaaatgctatcattttattagaaggtagcattgacctaaaaaaaagtatgacctttccaagtctacattgttttttagtgtttaagtcatacctctggtaccaactagcaattgacctgaggcaagttcaaaaaaaccctcaggctctatggtagctatttcttcattataaaagattacttagcaagattcttcaatatcaacaaatcaagaatacaaatctagacacatattcagtagtacctcagcccctgaattctcaccagaacttacctggcaactgatcataagcttgaatatagttgctcttgtgatatatttacaatatattaaggatcataacagccttgttacattacaaatattattatgatttattagtattttattatttattttcctgattatatttatctgctgtaggtggatatgttttaccagatataagcattttgtatttttgccagttttacttttctttaaccagaaacccagtactatttaaagctagttatgcctagttctatttacaataaccagttgtatttgttattgttaaatactccattttgcaggtaatttaatctaatatgttatttatttattttagctatatctgaaaaagtgcaaatacacagtatgtattaattttatcttttatgcttagactttcttacgaaaaaatattgaaacgttttcaaaatcatgtattttcaacctgtgcttttatatttatgttttattacagcctgtgttttgaaaactatagtttcaaaaattttgtaaataagaattcttggcatattgttttcatgaactaaaacctttaagttttacatagaaacaaggatgatatgaagatttcagaatattttttctctatgggcacatttgctaaaatctgctagctattttcccagcttctaaatacctaaaaaagattttctttttattattttcagaacaagacatagtgaaaccagaaaagactgtttctcatggtaaaccaggtattttgcaggtggtatttgtagtctcaaataacctctcaatgttctaattttagcagaaggaagagtttagagtcaagtctaaagttatttgggacaattcatgtcttaagtcataagcttctagaccatctccaattttagtcatcttcagaatttttttttgtgctgagaacttaaccagtgagatgtaactagacaactagtcttcccttcccaccagagagttagctttgcacaaaaaccatagtcacccagcacttagatgaatgggctctatactttctgttttattctgatttgggcaaggcattctgagcaaacttgtaattcagattggcttattaaaatatgatcattttagactctccaagtcccaaaaatgctgaagaaatcaacatttctccatgcttcttttcctgactctttattttcttcacccttccttccctttcttattttctttttattcctggtcttgcattttgtagaaagtagaagtaagctaatatgttctgcttgtaaaaaaaagatacataatttatcaaaacaaggttatgaattaatttttatttaagaataaaaacaagtttttatttcagctaattaaatatgaatttaattttgaggctacccaagccctgattattctgtagaatattatttttcattccaggctgaaatatgtacccaatttgtgaatatagttaggccagaatctttgaaaagtgaaaaacatacttgctctaaacaaatcttaggaaatcctttgcttacttttataaattgtacttcagaaaatctgtatacaatgggttttagtctgtgtgatttgttttgcatatgcttttaaaaaaactgtgatacaccaacaacagaaaatataggaataaggaaagcagggctggagtgtggagaggtgagaagagctgtctgtattgacaaaagcagaaccttagaaacaactttcagaagctcctcattaaatgaaacattgttattttcttatgtcccaaatattagccaacttgaggtgaaataaagagaagtgacagactttagtctctgagcgtacatcaaatgcattgtcttgtaggaacaactcttttacttcagttacaccaccatgctctttaaattctctgttatccagtgaaactttctacttaggatatttgatcagttgattcatacccagtgtgaaatgcttgagaagtttaatttcatgtagtatcagggcaataatctctttactttgacccaaacatctttgtctatgaaaaatcactgagaacaaaggacatcccacaaaggcatcaactttgttcttccccagcttcacactgtaagaaatttgggttctccacctattcctgggttcccagggaggtatcagtacaagaagataaaaaattgctccttcctattctaatttaataatagtaagggaacatatattttataaagcagtacctctgggcagataaatacactgaaatacagtgaaggcaaaaaatagggctcatattggcatgttagggaacaatttaagttaggaaaacttctatagcaagatagctgcaaaggacatttcagctggacagattttctttgtgctttcatccaatttgaatagaagatgtttttgctgttttattgaggcaacaagtttttcttggcattggcactatttcaaaagaatacaaaaatcatggttgaaatatgtcactgatgtattcaaatttcctacttgtgttaacattttttcctatcacagaagaaaaagttctcaagcaggtaaaagctgtcacaatagaaaaaacaggtaaataaggtattttatatttttttctatgtctcattatatgttatgtggtgcactcatatgtgtgcatgcagacacacacacacacacacacacacacagcccttcactgaagtgtgtaggctttcagtaccataacttctaacattctgaattcttgtgaataactaaaaatatgttcaatataatttttgttaaaaaataatagctagagtagcataactttaagtgtgattgagctaagcttatgtgtaattcatgagaaaatctatataatgcattgattaccatgtatacttaggtgtttaatcttatttttaaaccacatttcctcaaatcttaaaattacagaagtctgaaactttctactatttataaattagctggaataatttactttcatggaagctccatagagagggatatggttatataactttaaagtctgccttagagaatgatcaacagaacataaaatattaaagtaaaaacactccatctatcattagttcatatgagaaagaaaagatacatactcttgcaattcagaagtttttcctgtaaggaaaaagaaaacttatgagtcttgaaatcaattcacatctgagtcactgaacttcctctgtttgattccaagacagaaatcctacccacctcagccattaagagaatcccatctcttactaataatcattccaaaagaaaaactctgtgaaacatgtttttccctgagataatcagataataaggatttaaatagtttcttggaggaaaaaatataatagaattcaggagagatccaattattcctagaaattatagactagtttataagtagaaagaaagaaatctcataaggccgttttcacattacttcatatgaccattatactttcttccgaccactgcctaagtttataattttagtaaatgttcctttaatttgcaccctaaggtattaatatggccacctgagtatctcattcagttgtatggatgtttgggaattatgaagaagctagctcaatgtatttgtgactcaaatatatagattgttttaaattttatgtgcgtagcatgtgtcttactagttttttgcagtttgattaatgtatttgctgacagtaaaatattagtggtcaaagaaaacaggttaagtttaagctaaggaggtgacctaaaactaagaataagtaaatacaaatactaaacagttattttttccatggtttgtactcatcaatatgccatgtgcttgcctccattctccacagccaagcccaaaccaacaagtaagagatgaatagaataacacctgagaaatatcgcttgaccatttcagctttaacaattttgcttagtttttttaagaaaaatgttattttcagtgttgtctgtgtctaaataactgttaataataaattaatgttattgctatttaattgttagtgataaattaatgttattgctatggcattgatttaacattcttgttaaatcaatctactaattaatgattaataattaatgattaattaaatcactactaattaatgattataactatacaaaagaaatatccagaagtctgtcactgtggttaatattaaaagagggaatccatataggctataaaataccactcacagtaagttaaggtaggttggaaatcttttaaacatacgtaatgaataacagaaaatgaaatgatatacaattgtcagtgttatgaaccatatactgtttttaatttgtttgctttaagctgcattaattaaactgtaggtaactttggcatttagaaatccatttaattataaacattttgccatttgtccattacaatgatgaaatgtccttatgaatgtggactttgaagatccttcatttcactgtacaggtgtgacacagagagtatagtgatgaagagtttaaagatgacttttggactcaggaaggcataaatatttacccactgtggtagcaaatatattcaatattgtgtcaaaattgtgatgttggtcgttgaatggtgtacatttgtgaaacacaagcttagacaaatgcatgaatggctgttggtcaaatatattctggctcttgcatgcaaaatagcttcacaagacccaaaggtgaacgtgtgacacagcttaggaatacatataagtggtttaggctatatagcacaaatgaatgactctaatcagaacacattcacatcctagaatctgtgaattgtattttgaatatatattttatattattattattcccttgatttattattaatgctgttataacagtttaataccttgaatattggctgcattttcttttattttgaatgcttatttactataacatttatgcaaattcagttcatggaagtttattcttgaatgctatcagttcctaatgtacgaatatctgtttagtctgatgacacctggagtcccacatcttcccacctacttcagtgttggtgcataatttgggggaaaagtagtaagtttagagaaactccaaattcaagagtgagggaaagaaaggacaagtaaacatcaagaacagctcagaagaactgaccatagaggtcattagaggtaacacttggtctgttccagagtcctactcaattgacagatattctcaatcccattcaagatatcccacatatatggttgactttaaattccacttttgatgaaagagaatgatctctttaaaatttttaattcaaatatttttcagagaactaagagggatgtcaattactcatacatttttatttctttttgtcatatcctagaatagttgagattcagctatgagagttttaagaaaacctggaaagggagggtggtacaggtcaataaaaatacaaaatgtggcactctctggaatacagcagatttagtttaaattttcaataagaaactagtgttcagcagtgcattgcttctaactggcaagaaggttactaggattcaaagaggaaaaaagaggagttgataaaatgtcaaagacaaataccatccactaaaaatgtccccaaagaatgattcaactttcagcaaataaaacaatattcttattctcctttttgccatattctatcctcttatacaacacagcccccaaagggataaaaccctaatactgtctttcagccaaatgtagaaaaaagccttttcctgggtgtcctgagaaagaacctaaccctgtttataatttttttatggcaatatgctttctttgtttcaaattacatgaaaatgactttggggcatgcctcttgggtaaactgaggatcacttgcaaatatataaataagaaatatttgccaaagaatccacagattgccagtgaattttgatttctttctctagaaaaagctgaacatcgagaaagagaacctccatctataaaaacaggtattttaccatttttggtttatattctgtcttatgttcactatttttattatattcaaaaattaaagtaatgcatacaagtcattttcactgtgtttcctggtaatgtgttgtcctgtggttttgtagtgtaatctagtttatctgacctaagggcaatattgttgtcaatcaaacatagattgccaaacatgcaattatgatagagcaaaattaacaaattagatttgattttatgattcacaagttccttccaaaatattcagtatttcactgttgtcagtattaatataatttatcatacagattaagttgatagttttaaaatatcttgtcaaattacacaggttaaatttcacaaattgtgaatttcagcttgatatatcctcttaaaagagaagttaccccattctaaaagttagcttaattcttttaaaatgtcattcaatttttacaatatgtaatatttcacatggttcaaacactgaggcatataggaagctaactgcaaaaatctctctcttttggtaaattctaccagttctcatttcaaaaatatgtgatgatatccagaggtaatcactgttacttctttttttttttttgagacaaaatctctctctccaggctggagtgcagtggctccatctcagctcactgcaagctccacctcccgggttcacaccattctcctacctcagcctcccgagtagctgggactacaggctcctgccaccatgcccagctaattttttgtatttttagtagagaagggattcactgtgttagccaggatggtctcgatctcctgacctcgtgatccacccacctcggcctcccaaatcactgttatttcttaaagtatccttctagcattatctatctaccagtacaaatatatatatattataatatataacatatataatatatcatatatattatatataatacatattataatatattacatatataatatatcatatatattatatataatacatattataatatattacatattataatatatacatattatacatattattataatataatacatattataatatatattatatataatacatattataatatatatattatatataatacatattataatatatatattatatataatacatatcataatatatatattatatataatacatatcataatatatatattatatataatacatatcataatatatatattatatataatacatatcataatatatatattatatataatacatatcataatatatatattatatataatacatatcataatatataatacatattacatataattatatataatacatataatatataatatatattactatatataatatataatacatattataatatatataatatataatacatattataatatatataatatataatacatattataatatatataatatataatacatatgatatataatatatataatatatataaacacaaaatgtatctacaaaaaaagtatcaatttgtattccctctgttagctattagttattttacttaattttagatgattcaatcctgcaatcatagctaaatcttttctactttttatgaagaaatagaactttagatgtacgatgacacagttaacgtttttagttaatatattttagaagacatgttatattggaaaaaaatagaatgtctttacgattttttttacctaccacccattcattcttgagattttataaaggaaccttattgttcaacatacgggattgggagagttagtataaattaatattaataattaatattattagtataaattaatattaataattaatattattagtataaattaatattaatatgtattccaaaaggactgtggcagaatatatattttatgctatttcagaaacagtaagaagttcagatttttgtgagcattgattaatattgtatcaaatcaaatatgaggtttacaggaataaaaaagagaccaaaaaagattccatactttcaggctttactgctccatgagaaactcattgggagtatgatatgaaaattattaaaaacacatttcctactgttcattgttgatataagtttagtcttatttttacaataaaaagcaaaaataggaaatataaagggctgatatgtcacccatagatagaaaattatcactcattttctttttttttcttttttcctttttagacaaaccaaaaccaactccaagtaagtgtaccattttagaattttaaaattgtcctatttcattgttttaatttcacaatttctttgagttataactgaagttaaatagtatggtctgtttgttaatgtaatagccattatactattaccatataagtgagtctggttgacaaaggatattgtgtgcacaggcataccttggagacaaaaagcacaactaaaagaaaatgggtagagcaagaagccctagaccaataagcacatgaagagatgtttagtgattcaaaaaatgcaattcaaggaaaattagatgtcattgtcctggcatacctcgggggtattgcaggtttcattcagaccaccacaataaatcacaccattttttgttttcccagtgcacataaagattatgtttgcactatagtctattaagtgtgcaagaggattatgtctaaaaaatgtacatagcttaatttaaaagtattttgctgctaaaaatgttagtgatcatctgaaaccagcaagttgtaatacttttgctggtaaaagtattgtctcgatgttgatgggtgctaactgatgaaggtggtggtttctgaaggttagaaatttgtggtgattctgaaaataagacaacaataaagtttggtacattgattgactctttgacaaaagatttctctgtagttcgtatggctatttgacagcattttactcgcagtagaacttctttcaaaattggagtcagtcatctcaaacttggcttctgctttatcaactaagtttatggaatgttctaaatcctttgttgtgattttgacgatgttcacaacatcttcaccagaagtagattccatctcaagtatccactttcttttctcatccatgagaaataactcctcgtctgttcaagtttgatcatgacattgaagcaattcagccaccacttctaattcttttgttgcttccaccacatctgcagttacttcttctactgaatccttaaacctctcgaagtcatccgtaagagtcaaaatcaatttctttcaaactcctgttgatactgacatttggactccctctcatgagtcaaaaatgttcttaatagcatctagagaggtgattccattccagaagactttcaatttactttgcacggatctatcagatgagtcactatatatgacacctacagccttatgaaatgtacttattaagtaataagacttgaatgtcaaaattactctttagtcccacgggctgcagaatgtatgttgtgttcacaggcatgaaagcaatattaatctcctcgtacagctccattagagctcttgagtgaccaggtgcattgtcaatgagccataatatttgaaaggagtcttttttcttagcagtaggtctcaacagtgggcttaaaacagtcagtaaatcatgctgcagacagatgtgctgtcatctagattttgttattccagttatagaacacaggcagagtagatttggcataattcttaagggacctaaaattttcagaatggtcaataagcattggcttcaacttcaagtcaccagcttcactagcctccaacaagagactcagcctgtcttttgaagctttgaagccagatattgacttttctctctagctatgaaagttctagatgacgtcttcttttaatagaaggctatttgttaagttgttgttgttcttttaaagacagggtctcactctgtcaccaggctggagtacagcttggggatcatagctcactacagcctcaaactcctgggctcaagtgatcctccctagaaggctattttgtctacattgaaagcttattgtttattgtagtcaccttggtcaattatcttagctagatctggataactttctgcagcttctgtatcggcatttgatgcttcatcttatacttttacgttacgcaggtggcttcattccttaaatttcatgaaccaacctctggtagcttccaacttttcttctgcagtttcctcacttctctcagccttcatagaattgaagggagttagggccttgctgtagattaggttttggcttagggaacgttgtagctgctttgatcttctattcagtccactaaatctttctttgtctcagcaataaggctgtttccctttcttagcatttatgtggtcactggagtaacacttttaatttccttcaagaacttttcctttgcatttacaacttggctaactctttggtacgtgaggcctaactttcagcctatcccagctttcaacatgcctttctcactaaacttaatcatttctagtttttggtttaaagtgagccatgtgcaagtctttctttcttgtgaatactaagaggccattttaggttactaactggtctaatttcaaaaccatcgagtctcaggaaataggactagaggaaagggagagggcttggtgaatgagagtctcaatacacacattcattaagttttaccaccttatatgggtgtggtgtgtggaacaccaaaataattacagtagtaatatcaaagatcactgatcacagaccaccataacagatgtaataataatgaaaaatttgaaatattgtgagaatcaccaaaatgagacacagaaatgtgaaggaagcaaacgccattggaaaaattacaccaataggcttaatcatacagggttgctacaaactgtcaacttgtaaaaaatgtgatacctgagaattgcaattaagcgaagcacaataaaatgagtatgcctgtattacatttattaatccttgaacatgtatttattgagcacctcttaggtctatgacactggaccaggatgtatgagggaatgcctatcatgttttctgttgatatacctggtttgctaacacatttaccatgataactaatacctgtgcaaataaacaaacaaacaacaacaaaagaaaaccaaaacaaaacaaaaacaaaagacacagtaattgtgtctctctcttatctactttcaattgtttgtttagatgtattgaataaacacagtatggagatcttctaacagttattgtgtgggttgagaaaaattaagagcacataatatatgtcctcaatttatttaattttaacacattagctttttattttctaatttttttaaagccctgaggtacattttattttgtaattcaaaatcacggggctttcctggacatcttaaacaatagtaaatatgcaacaataaacagtgaagctgtttatttaatcctgttagaatactcagactgtaacctggattaaaaattgagcatttcaatccaaagtgtatctggatgttgtatttatatgttttaatacccagaactaacctgttttcttaacagcacatgacagattcgttaataatgcagctacaggctacttcataatggattcaatgccaattttaaacattaagtacagcctttaggctggagatattctctagtatagtttgtaatactgctactaatatgaacactattgccaaaattaagggttggaagtcaaaactagaatgctaatatgaaacatcattataaagccattttaaagtactatatttttatgaaacattatttattgtataccttcattgtcataaaatattttaatttttttttgaattttgaaaatagctactcaaaatagttatgtaagactgataaaactgataccacgtttgtagaaaacattgatattttatgagagatatttcttaaactaccagagaatttttattttctggaaatgttattatttgaaattatttgtgacacaaagttttttttaaaaaaaactttccaggttatacttagaaatattaatctgtaagtttactgaaggaacaagaagaaagcatggttctgtatgagcataggcaaaaggcaaatataattttatgtcttctatcacttatcagactgtagtcaatatgaactgagtttgtttttattaacttttaatctcatcccatgaccacactcaattgcatttctgacagcatcttataaatgaagctactttaataaatattatatgaatgaatgtttgcatgcatcaatgaagattaaaaatgtaacagatttataatttgtaactaagaaaaccaattttgaatttagaattcattaattatatcgtatgttttttaattttttacatttcattttattttatttttaacttggtaggtacttagtagttgtatatatttatgggtacatgagatattttgatataggcaagtaaatggggtatccatcacatcagcatttatcatattttttgtgttataaaaattctaatattttagttattttaaaatgcacacactaaattaatgataactgtaatcagcctgttgttctatcaagtactagatcttgtttattctatctaacctattctataatatttaaatataccattttagattaattgaatatttgttctattttcaaaatagatgtctagttacagctatcagaaatattaatcatcagtacatttctttgccattttgagtatgtgtgcctattgtaatttaggaagaaatatcagaagataagtttcaattgtttgctactgaataaaaaactatactttttctttttattttttttcctttctttctacattctttttttttttttttctaaagaaggaacatcagaagtcacagaatcaggtaaatatttactttttcagaggagataagatacagttgtggaaacagtatgtaaatttaagtttctagatgtataacatttagaaaatcccttagctgctcaaattccagatattctgttctacagaacaggcataatgacttcccaaaaggcttgttataaggagtaaatgatgcaatgtgtccattcttaccgcatacaaacttataagtcacccattaaatattgtttttcttctcacttttgtctaaaaagtgtagcaagaaaattattatttaccaagactgctttgaaaactggatccacattttgcttagaaatattatgttacatttttattgctttaattcattagtttacttatgaatccatcatgccaggcaaattcttatttcctaaaggtaaaaatgtaacatgtagttttttttcctattgtttctagtttaaacttgttaacaaaggcatggcttatcctagcttgtcttcaaagcataaaagaaaaggggaggaagtgggtagcagggtcatgcctgtaagtaaaccaggctactcaggagggtgaggagggaggatcccttgagaccaggaatttgagggcatatagaaagaccctatctcaaaaaaagaagataaataggaggaggaaaaaaagaagtaggaggaggaagaggaggaggaaaaaaagaagtaggaggaggaaaagaagaaggaagaggagtaaaagacttagaggaggaagaggaggccaaagaggaggaggaggagaaattttgaccctataggtgactacataaacagaatgaccaagcataacaaaaatgaaatgagagagccctgactccctccactcataagattaagtctcatctccaactgtttactccaagaatgagtaagaaagtcatgttttttaaaatgatggtttcttgttgtttttctttcccctaggaaagaagaaaactgaaatatctgaaaaagaaagtaaaggtaaaaatgacattttaagacatatacatcaaattagccacaaaaacagaggaacaaaaaacaaatttatacaaattatatgatttaaaaacagttgatgaaaatgaagacactgattttatagcacatatcataattatagtacattacagttcatcatgcaaaacatatagttattgcatttttattaaatatctaaaaggatcaggaatttagaactgaaagcagactctacctgttactactaaattaaaactacagacttcttttcatattactactgaactgtgaatattgcctacataaaattcaattcctcaccttaagaagacttgttaataaatatattactctgatacagagaaagtgggaaagatctaaaatcaacaccctaacatcacaatgaaaagaactacagaagcaagaacaaacaaattcgaaagctagcagaagacaagaaataactaagatcagagcagaactgaaggagtgagagacacaaaaaaacccttaaaaaaatcagtgaatccaagagctgtttttttgaaaagattaacaaaatagataaaccattagtcagactaataaagaagaaaagagagaagaatcaaatagacacaataaaaaataacaaaggggatatcaccactgattccacagaaatacaaactaccatcagagaatactataaacacctctatgtaaataaactagaaaatctagaagaaatggataaatttctggatacacacaccctcccaagactgaaccagaagaagttgaatccctgactagaccaataacaagttctggaattgaggcagtaattaatagcctgccaaccaaaacaaaagcccaggaccagacggattcacagacgaattctaccagaggtacaaagaggagctggtaccattccttctaaaatgactccaaacaatacaaaaagagggaatcctccctaactcattttgtgaggccagcgtcaaccttacaccaaaacctggcagagacataacaaaaaaaagaaaatttcaggccaatattcctgatgaatatcgatgcgaaaatcctcaataaaacactggcaatccgaatccagcagcacattaaaaagcttatccaccacaatcaagtcagcttcatccctgggatgcaaggctggttcaacctacacatatcaataaatgtaatccatcacataaacagaaccaatgacaaaaaacacatgattatttcaatagataaagaaaaggcctttgacaaaattcaacacctcttcatgctaaaaacactcaataaactaggtattgatggaaattttctcaaaataagaagagctttttatgataaacccacagtcaatagcatactgaaagtgcaaaagctggaagcattccctttgaaagccgacaaaagacaaggatgccctctttcaccactcctattcaacatagtattggaagttctggccagagcaatcaggcaagagaaataaataaagggtactgaaataggaagagaggaagtcaaattgttactgtttgcagatgacatgattgtatatttagaaaacccaatcgtcacagccccaaaactccttgagctggtaagtaacttcagcaaagtctcaagatacaaaatcaatgtgcaaaaatcacaagcgatcctatacaccaataatagacaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttgggaaaattggcttgccatatgcagaaaacagaaactggacaccttccttatgccttatacaaaaattaactcaagatggattaaagatttaaacatgccgggcgtggttgctcatgcctgaaatcccagcactttgggaggctgatgtgggcggatcacgaggtcaagagatcgagaccaccctggccaacatggtgaaactctgtctctactaaaaatacaaaaattagcctggcatggtggcacacaccagtggtccagctactcaggaggctgaggcaggagaatcacttgaacctgagaggcagaggttgcagtgagccaagtatcatgccactgcactctagcttggtgccagagtgagactctgtctaaaaaaaaaaaaagaaagaaaagaaaagaaaaagatttaaatgtgagacctaaaaccataaaaaccctagaagaaaacctagggaataccattcaggacatagacatggacaaagacttcatgactaaaacagctaaagcatttgcagcaaaagccaagattgacaaatgggatctaattaaagtaaagagcttctgcacagcaaaaggaactatcatcagagtgaacaggcaacctacagaatgagagaaaatttttgtaatctatttatatgacaaagggataatatccagaatctaataggaacttaaacaaacttacaagaaaaaaaaaacacacaaccccatcaaaaagtggttgaaggatatgaacagacacttctcaaaagaaggcaaacatattttaaaaagctcatcatcaccagtcactagagaaatgcaaatcaaaaccactgagataccatctcacaccagttagaatgacaatcattaaaaagtcaggaaacaacagatgctggagatgatgtggagatataggaatgcttttacaatgttggtgggaattagttcaactgttgcagaagacagtgtggcgattcctcaaggatctagaaccagaaatagcatgtgactgagacttggaaccaacccacatgcccatcaatgatagactgcataaagaaaatgtggcacatatacaccatggaatactatgaagccgtaaaaatgaatgagttcatgtcctttgcagggacatggatgaagccggaaaccatcgtctcagcaaactaacaccggaacagaaaaccacacactgcattttctcactcaaacgtgggagttgagcaatgagaacacatgggcacagggatgggaacatcacacattggggcctctctgagggtgggggttaagggggagggatagcattaggaaaaatacctaatgtagatgatgggttgacgggtgcagcaaaccaccatgacacatgtatacctatgtaacaaacctgcatgttctgcacatgtatcccagaacttaaagtataattaaaaataaataaaaaaataaattaccctgttactgtttcttctatacagaaaaagcagacatgaagcatcttagagaagaaaaaggtaattttttaaaagaataaaaaatagaatgcaaagccctgaagctaaaatattttaagtcaaaatgtatttatatcatatgaaaaaaaacttttctaaatgtatgtgatgagtgttagcctgagtaaaagaagaaatatggtaagtaaaaaacacaataaaaatgattgtgtagtaacggcagtgtcaaagaagcaatggatggtaagccaacccatgcaaataagcatcagtttgttctgccattgatgagcaaagtataaactgaatcaaaatgctgccgtttttcttaacattgggtttatttatttggcaaactacaccatataagatgacaattactgatttgagtataattatcataaagcttacaaaggtcttaattatcaaatagtttattggagcaggaggaaagcattcttagacatatcagaattattgtcaataacaaaataactcttttttgtttatctccaaatccagttaatcagaatgacccatttttcatacattctagttaattttgttcctacattcatgttatacctctgtttataaaacaatgtctagtgctaacatttatttttgttaggtaccagttggatagaaaaatttttgaaaaccaacttgagaaaatatttataacacttaaattatcctcattcgttgatgtgagacaaaattttgatggaaatttactttaaaaatttatattttaatttacattttccttattaacagtctcaacaagaaaagaaagtcttcaattacacaatgtgacaaaaggtaatcttgaattacgtaactactatgtttgtatgaaaacatatgaattatgttgttgcttaatattaatattaaattattttggaacaaagaaatctagaagatgcaaacttctcttaatagcagaggaagtggacaggtagaaaatctagcagaaagcttatatttcaatagaaaataagaaaacatgaagaaatcagaactattagcaacattaacatgaacaaatattctgttacacatcagaagaaaaattatcaattacaaagacttttttagcatgaataatgtcaaaagtaatatggtagtaaaaataaatattactgggatttatttttatctatcactaaataacatatagttaagatcatgaatatattttttattgcttataaattagacctttaaattaattcaacctagacacaaaataggcaaatgccagcatgcacaatgcagacatttttttcttaaaaagagaatgatctattttgctgatattatcataaaactgtaaataacgtttatactaaattatgtagccttggcaacataattttagggaaattcaattactttaaaaaagtgctttaaattcgaaggtgctaggtaaacatatcataactaagacaactattttcattcatagcaaatacataaatctctagtagggagagaaaaagctttgtttttcactgactcccttttactgctcactgaaatgtgtatccctgaaatgactagacatatctagacatacctttcacacgtaaaattattaatgtattcataattatcactaatattaagaggtaaaactttcaattgaagggcaattacatttgtagaataatataggggcacaatttttatattgaaacattcttttaaatattgtttaatatcctttgagataatcagccagaaggatgagaaaaaaataaattaattagaaaatgtatggttataccttttcctattgtttacttgattcttagtaaggcccaattatcatgcccagtttaaagatgaaataagtgcaataagagaaaatctaacatctcaagagtatttatatggtacagacaagatttggctccaagtttgtatgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgctctagtgtttgggacaataatttcaccttagttattttgtcctaaatacagcttaataagaaagcacatttctttgaagaataataacctctcattagaataaataaattattatgaaaaagtaaacttactttgcatgttgttttttaagatgtattttatagtctggtaattatttattttatctatctttgaaagaaaaataattctaaatgatatattttataaagtcttggaattttaaagaaaatatttagctgttacataatgcaaagtaattttattcaagctaagtataataatagttgagccaaaactcttaatttaacaaagatcttgattttagtaagagtattttaaaagcataaatattttgtgacactttgatgaatagcttttttgatagctgacatattttcttagataaaatagattaaccaagatattcaaagaatcagccaggcatagtaactcacacctgtaataccagctactcgggaggcagaggagggaggattgcttgagcacaggaatttgaggctgcagtgagctgtggctgtgattgtaccacttcatgtcatcttgggcaactgagaccccatctctaaataaaaattttaaaaaattaaaaattataacaaaacaaagacttatgttgacaggcaacagatgactgtatttcttcattgattcttaaataataagcaagaaacaaaataattagatatttttataaagtccactgatttataatttccttgcattttatctcagttaaacaaaacttatttattttctctttttagcagaaaaacctgcaagagtatcaagtaagtacggtttgtattaatgacaagttctctttgatacatagtatcaattttaagatgaaattcataaaatatttttatttttgaagtgttcagtatagtttattctaaactgaatcctctgacaggaatttattagcttttattgttacttacgttgaaacttaaaaaaaaaactatgttatttgaaattacaacttgtaacagaaatatcttattattttctcaagcctgaaaataaaaatgacttgcatttaaataaataaatgttttcagtgattaaattcaagtgaaataaaataattctgtatctgcctttaactgtcaatcactagaaatttgttaaagaccacatatggtcgaacagtgatgcttttgctgctgttttctagtgttcgttaacctaaataaaattgtgtatctaagaaacctaaattgtaatttaattgtatagctataatttaattgtaaacctaaattgtgatataattgtatatctaagaaacctaaatataattgtgtatataagaaaaacagcatagttaggaatggatgtatctcctatagtataaaccacagctcccagaatagattctctagaatatcaggatccaggtacagatagaaattctatgtatataggatataactgtaaatattcttacaagttcctaagattcaaggaaataacaatttatccttttttatttccatatttatgaaaaaatattctaaataagtaccacccaatacaaatataaaatgtgacatatatgtaattttaattttaattacatatatgtaattttaatttcatatgtgtaattttaattttaatatgttattttaattttctagttgacacattaaaagacaaaacaaaacaagtggaaataattttagtaatattttattttatgtaacttattttatacaaatgttatttcaatatataatcaatatagaaaagtatttatccctacattctttttttgtattgagattttgaaatcttatgtgtattttacacttacactacattttatcttgtgctagtcacatttcaatttcccaaatccccatgtagtcagtggctacagcattggatagagaaggtcctactgtacccaatgttaatattgaagacaataaaaaggaaccattaaaatatgataccacatgtcattcaaaggtctttgattacaggtgatcatagacttgcttcaggaatttaaaaaaaggaaagatattgtaaggacacaaaattgtcccactgatggcaaggacaaaatgtatagataaaaggaaaggcccttggaagctgccctattccacaccattcccctacagccaaaggtaatgagagctgactacataaggaggtaatgccaagatttttgccttgaagaatggttaggatttggatagctggagaaaaggatagaaatgactgacaaagaaagatagcatcagaagtattggttgaagttgaggtgtagtgttggaaagaagtgggaagtaagcacatttcgggtgaaactgtcaggtagagaatattcaaggccaaaatattttagaatgtgccacagaaagctatggtttacttcctcctagaaggaagtaaaaagtcaaggaattattgggacacctaacttcatagtaatagcagtagtagtagtaagagtaagattatgagcagtaactgaaaagaaaaatatatcagaaagaaaaatatatcatttaaaatatatcatttctgtgatccatattaaaataaatgatcagagacatcatggaatgattgtttaataaggtggttttctgagtatatgaagcttatttcctctatagcacatattattgtttttattatgcttttttaggagcaatcatcaaaaaactgtcttaggtatttataaagaagagcatactatatatatttgaaactaaacaagtatcattctttttccgaatccttttacagcattatgtatatgtat

SEQ ID NO: 14544 - DNA, 4552 bp, Human
atggagtctggctctgtcgcctaggctggagtgcagtggcgcaatctcggctcactgcaagctccgtctcccgagttcatgccattctcctgcctcagcctcccgagtagctgggactacaggcgcccgctactatgcccggctaattttttgtatttttagtagagatggggtttcaccatgttagccaggatggtctcgatctcctgaccttgtgatctgcctgccttggcctcccaaagtgctgggattacaggcatgagccaccgcgcctggccctctatgtgatactttctgttgtttcattaaaaaatatttttactggccgggcacagtggctcatgcctgtaatcccagcactttgggaggccgaggtgggcagatcacgaggtcaggagatcgagaccatcctggccaacacggtgaaacctcgtctctactaaaaaaaaaaaaaatacaaaaaattagccgggcgtggtggggggcacctgtaggcccagctactcgggaggctgaggcaggagaattggtgtgaacccgggagacagagcttgcagtgagccgagatcacaccactgcactccagcctgggcgacagagcaaggctctgtctcaaaaaaaaaaaaaaaaatatatatatatatatatactgcaacccatcattttgaaaacactatccaagaaagtaatggttgttttttgtttgtttgtttttttgagatggagtttcactcgtgttgcctaggctggagtacaatggtgtgatcttagctcactgcaacctccacctcccaagttcaagcaattctgcctcagcctcctgagtagctgggattacagactcccaccaccatgcccggctaatttttgtatttttagtagagatggggtttcactgtgttgggcaggctggtctcaaactcctgacctcaggtaatccacccacctagacctcccaaaatgctggaattacaggcgtgagccaccatgcccggccatggttggtttttttgagaccactttatatttaggccaaataggtatgtgtgtgatgggggtggagaggatgacaagtagaatgaaggagtgatgtttcactttgccagactttaaattaattacattgcatggagctctattatgcaatactctctccatactgctgaaaaaaataatctgcaacttacaatttgatccttgagttaccaaccagtaacacttgttctttacaccctttctcattccctaagtcattagaaagcaccagttctaactccaaatgatgacatggtcttattttatctattaaccataagcttacagattctagtgaagaaaaaactttaggaggctacatggtctattggagagtgtaggctctgcagtcagaagatccctacccaggcttctgtctttctcagtaagacttgggaccacagcaaggtccgcaatctcctgaggctctgttttctatggttgggataacatggtaagttattttcttctaagtagtcacacatggaaatcttatctaaaattttataccattaacttttatttcacttattaactcataccattaatactttactttagctatgtttggtatgcatgagttaatgagtgattagagtactatgagcagcacaggtttagaaatgcctatttgcctatagtgcagcctcttacataggcaaaataaaagtcaagtaagaattttattttatttttttaaaatgcaaagtaaaatgtgtctttaaaactctcccaggaggtgaagggaagctaccataacaccaggtgggaaggaagacatactgggcttggctcatgctttaattagctactgtgtaaaaatgttcagggattttcagttatccgctggcacccagaggcaatgggtaaggttaactggagctagagccaatatttttttcttcctagaaggagtaacagcagcaaacagtaggagagaagatgccaagttagaagtgcatatagctctcttccacaggaggcctacatgccgccacttgtgctgccgccatgtctctagtgatccctgaaaagtcccagcatattttgccgagtagtcaacaccaacattgatgggtggcggaaaatggcctttgccatcactgccgttaagggtgtgggccgaagatatgctcatgtggtgttgaggaaagcagacactgacctcaccaagagggcgggagaactcactgaggatgaggtggaacatgtgatcaccattatgcagaatccacactagtacaagatgccagcctggttcttgaacagacagaaggatgtaaaggatggaaaatatagccaggtcctagccaatggtctggacaacaagctctgtgaagacctggagcgactgaaaaagattcgggcccgtagagggctgcgtcacttctggggccttcgtgtccgaggccagcacaccaagaccacaggctgccgtggccgcatcgtgggtgtgtctaagaagaagtaagtctgtaggccttgtctgttaataaatagtttatataccaaaaaaaaaaaaaaaaaaaagtgcatataaagtcagctttcctaggccctgaatcaagaaacgtgatggtttgccattgtagctattggtttcaaacaagagccaagattgatgtctttcttatggtctgttggctaatcccagtatgaatggccagttcagctagaagaaacaaacagtcttgaaaaaaatagaaaaagcaaagaaaaaaaagacagctttccaagctaagtaacatttgtggtcagtgaaataataatagaaatctagtaatgctaaagtaaaacaaattttcagcttaaaaatattgcctttattcagaatcataagggtttttttaaaaaaatcttaccattatgaaagttaaaaaaaatatagcactcagtacaatgaattactgcatttaatattcaaacacttaaggcacatttctcacagtttacatgtgagaatttagcatgatccaaactcaaatatccatttctcgtatctttcaatgtctgcagcagacactgacttagaaaccttttttaaagccatctcgaaatcctccatagttgtaggcatgtgcatttcttctttggaaagatttcggatttcctctggagtcaaaccttcaatgcgccttctcattgccatcaaggacgcatccctaggttttaagttaaaaacaacaacaacacacacaatgttactttggttaaatgaaaacctgttaatagaaaaattttcaattgatctgttgtagcattctctaattatattacatatatatgtagtattgtatagaaacttattggaatacaaagcctgttgtgattgatttttaagcagttaaatcttctgtaatgaaaaaggatgctaatttaaataattaatactgaatataaaatcccagaaaaagtaaaagtggggttaaagctagcaatttgaatttcattataactattcaataaaatgaagaataagcatcacagagtcagaagagaagagaaactgttaacaagaaaattaaatattttctccatgtagaggaaaagctaggtaagttcagggtttctccttttctcatttgtgttaaaaaaaaaaaacaaaacttcagattcaaacagctcttgccttttaccaagttttatccttaatagcagccaccatttatgcaaagggatagcaatagagctgtttgatgtatacactttagctttaatcctcagaaccctgtgtggtatgctcactttagaaaggaggaaacgagcgcagtcaagcccctggttaattaagtgtctctactaatacttagattaggacaaaacctacttgaaccagctggattaaagacattctttttttctttttactgctattctgtcacatttaggataagttcactgagaatgagactgtattctgtgcatatgccaagtcaatatatttcacagtcatttcgtattttataatatagtgaacaaaggcaccaacaatttatttaatccaagacaattactgattttctattttacacaatttatcctaacattagcttcttgaacttgtagctttcaaatgaactgtagactcttcactgacatgaaagataccagatatcttaccagcacctgctaacaccaacaaaaccagaatttgtgaccctgactacaaaatgtatgtggggccgggcatggtggctcacgcctgtaatcttagcattttgggaggctgaggcaggcggatcacttgaggtcaggagttcgacaccagcctggtcaacatggtgaaacaccgtctctactaaaaatacaaaaattagccaggtgtggtggtgcatgcctgtaatcccagctactcgggaggctgaggcacaagaatcacttgaacccaggaggcaaaggttgcagtgagccgagatcggaccactgcacttcagcctgggtgacagagcgagactccgtctcaaaaaacaaaacaaaactggaatgtgggtctttattcatcttttttttttttctt

SEQ ID NO: 14545 - DNA, 27757 bp, Human; identical to SEQ ID NO: 12407
  misc_feature (1)...(27757): n = A,T,C or G

SEQ ID NO: 14546 - DNA, 818128 bp, Human
  misc_feature (1)...(818128): n = A,T,C or G
ctgcaacatgctgatctatcttcatgcttcaagactcagatcattatcttctctgggatgtctcccaagcactgccccagaaataacttctcctcctataatacttaatcataatccttggcttacatgcttgtttcttctcattgactatgaaatcctcaagacaaggtatataacgtatatatctttaatcctaatgcccaattgagctcttagaaggtagtaagctcccaatacacatttgttaatttgaagcaaaaaaaaaaaaatagctaatcattcaaaaaactgaattatcacaaatgtccatctaaagtactatatttacacaattaaatgctatacagccaggttaatgaacagactaaaattatatgcaacatggattatcgtaaacataattttgaatgaaaaaggcgagacacaaaggagtataaagccatacaattccattttcataatattcagtaccggcaaaataatcaaagttgacagggtactggttatacttggaggcagtgactgcaaagggataagaggagatttctgagattctgataatattctatttccttctctggttgtacagtgtgttcaatttttaaaacactattgggctatacagttaaattgtgcagtgtcctgtacgtatattacacttcagttaaaagcttccatggaagctacacatagttcccaaaagacaacaaaacaaaaaattttcaattattttaagcacaaacaattttgttcagctgtcttacaatcgaatatgtaagaataaatttatggctaattagcatagagttatatgcattttcataattaaaacttccacgagtacaacatatgttaagtattttaaatcagtttttctctttcctcaaataaggttgtgagtcataattcggaaaacagtttagcatgtaataatttagtgttttattttaaaccaagctgaagccacataaagcagaactgctcaactgagccctatccaaatccttgacccacagaataagaagcagataaaatggctgctacttaaacaaaacaaaaaccttgtttatatttttgtcctctcattttccataagtatactttaattaaacattttaaaacttgtaactttaggttatatacttactttagttggttctcaaccagggacaattttgtccccacccccaaccccccagcatatttggcagtgccttgaaacatatttggttgtcacagctcaggggcgaggtgttactactggtatccagtgtgttcaacaggccagggatactgctaaataccctacaatgcagaggatagctgctcacagcaaagaattttccaaacctaaatgttagtaatgctaaagttgagaaaccttgctcagatataatgacataatgttgttagaatttttattttattcattttaatgtatgtatgtatgtatgtatgtacgtacgtatgtatgtatgtatttgagatggagtctttctctgttgcccggggtggagtgcagtggcacgattctcggcttactgcagcctctgccttccacgttcaagtgattctcctgcctcagcctccctagtagctgggattacaggcgcctgccaccaaacctggcaaatttttgtatttttagtgtagacggggtttcaccatatttgccaggctggtcgcaaactcctgacctcaagtgatccgcccacatcggcctccctaagcgctagggttacaggcatgagccactgcgcctggccaggaatttttgaatcagaatttttcttgttcgattttaatctcttatcatttagagattcttgaaatattgaaattactttgttcaaagtgaatgaattttcttaaattatgtatggttaacatcttttaaattgcttatttttaaattgccatgtttgtgtcccagtttgcattaacaaatagtttgagaactatgttggaaaaaaaaataacaattttattcttctttctccaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaaggtaattttattttctcaaatcccccagggcctgcttgcataaagaagtatatgaatctattttttaattcaatcattggttttctgcccattaggttattcatagttccttgctaaagtgtttttctcacaactttatttcttcttaaccctgcagttctgaaccagtgcacataagaacatatgtatatatgtgtgtgtgtgtatttatatatacacacacacatattgcatctatacatctacacatatagatgtatagattcaatatgtctaaatgtatataattcacagtttttatctttgatttgaaattaattttagattttacttgagaacttcacaacttcatataattttaaaaactgaagaccagattgtggaatcataaaatctaaatctaaatgggaatcacttttttaatctgtcctggttacctacctggagatttgagaagagtctttaaaaagaagaatccattttcttagggaagatctggattgccagatcagtctcaccacttcagcctctacttaaaggcattatattcccccgaagcaatgttttgttttagctgatttgtctgggggtgtgggacgtggtgttggttcacattccatttggttgaatagacatccagcttattccagtggcttttcataccgtcctactgtgatgtctgcttattactgattacttcccttggctgactgacatgctctgattgtgcaattggattaactttcatggttttagttttaggaaagcagctcttttggatctatttcattttagttgtcaagcagaaggtgaaaggggaagagaaattaatatttaatcattccctgttatgtgccaagtattagatacatttacagccactattttatttaatcttcatatcagattttgacaatggttgctattatcctcattttacacggtcacataatcaaagggaaatgaaattggtcctttatcaatgattcaggtgctttacacatgtaaattagagtccaatgtcaaacgtttatttctgtgaaacaagaggtttacacctgaacaagaaataaagtataaaaataaaatatggcgtaattcaataaacaaatatggagcactgactatacatccgatgttttactaggtatttgggattcaaaaatagaaaagagtgggaatcatttgaagatggttataccctagaacaatgaactcagtcttttcttggaaatttatctttcccaaatgtattgagtgtcatatatagtaatataattgataattcattcgaaacatatttagtggcattttcttattaattaatatgcatgagtctattttctcctgaaagaatctagatcagtgctttcaaatagaactcccgtgatgatgaaaatattctgcatcatccatttttgtaacgactagctatttgtgccttttgaatacctggagagttggtcgtgtgactgaggaacttgagattttattttagtgaattttgattaacttgaatgttaatagcgttgtatggctaatgggtactgtagcagacacagtaactttagttgacaaaaatgaagtgttaacaccatggtgattttggaggtcttgggaaagggcatacactatgtggtggtgaatgagttcgagaaatttagggatatgaagtaaaaaatgaggactccagaatgaaactacccaaatttgaaccacacctttgttgcttgctagatttgtgtcctgggagctggtatttaacccctttgtctcagtttccttccatataaaatgaagataattggatctacctgatataattattataatatgaagataaactaagataataaatgtgaaaaggttagcacagtgcctggcactgtgtatattgagagtcaatactctcaatgtcagttacctcttaagatgataatgcaatttctcagcagcaagctacggtatgctatggcatgctatgatacccaagaggctgatgaatttgttcacattgttctatttctgatagagagataggttttcagacactaactttatttggagtgttgctttaccatctcacatttttctcttaaaaaatttatgagggataatataatcgtttattttctacagagatttatctactgagggggtgagtgtttcagtcaatcagctctgtgctcagatagaaaactgttggtatttgaggtaccactgggccctcggtcaagtcgcttcattttgatagactaatcaatagaagcaaagacaaggtagttggaattgtgctgtaattcattttaaacgttgttgcatttgtctgtttcagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggttagacattaaccatctcttccgtcacatgtgttaaatgttgcaagtatttgtatgtattttgtttcctgggtgcttcattggtcggggaggaggctggtatgtggattgttgttttgttttgtttttttaacctgaccgtttgctttggctatatgttttgttgtggctagaaaaaatgatgatggtgaatggctttacattaatgaccaaatgccaaaatttataccacaattttttgcataaattattctgaagaatcagactgaagaaatggcgaagtatttaattcagtggccaggcatgtactgacagtatttaagctgaaaggacgtggtctggttctagttaaacaagtgtcataaatcaaaattaattattcacacctgtggtatggacttaataattaatgtacactaacgttcgccacaagtttatttatttacttacctactgatttattaacttgtgagttttcatctttccaccttgcatactatataaatctaacagtaatactatttattaaattaatacatatttattttatataaagcaagtggtacatatgaatttatagtaaaaagcaacatcaattgatccagcactattcattcaaagacaatcatttccccactgtattttcatggcatctttgtcataaatcaagagaacttgtatgtatgaatctgcttctggattctgtatcctcttccatttgattaaatctgtactttaacaacagtacttcactggcttaattacaatcttttttttaaaacaatcctaccgagctataattcacataccattaaactcatttaaagtgaacaattcaatcgtatttcggtgttacttttttaaggtgtgataaaatatataacataaaaaattgtcattttagtcatttcgtgtgtccagctcagtggcatttattacaaccatcaccacagtttatgccccacccccaatttttttttttcttttttggagacagagtctcgctgtgtcgctcaggctggagtgcagtggcgcgatctcggctcactgcaacttccgcctcccaggttcaagtggttctcctgcctcagcctccctagtagctgggattacaggcacctgccagcatgcccagctaagtttttgtatttttagtagagatggggttttgccatgttggccaggctggtctcaaactcctgacctcaggtgatccgcccaccttggactcccaaagtcctgggattacagcgtgagccaccgcgcccagcctccaaaattttttattactccaaccagacagtctgtaaccattaagcaatagttcccctttctctctcttcccatccgctagtagcctctggactactttctgtttctatgaatttggctattctagatcttttatataattggaattatatatttgccactttgtgtctgccttacttccctcagcataatattttcaaggttcatctatgttgtagcatgtgtcagaacttcattcctttttatgactgaataatattccattgtatgtatatacgcaatcattttatttaaacattttggatctggttgtgtaaaccttccactttgttcttcctattcaagattgccttggctacttttggttctttgaataaattttagaactatattgtctatttttacataaagccttccaggatattgattgaaattttgtgaatctggagctcagtcaacatctttacgatactgagtcatctaatttgtgaacattttgaattgtgtcaggttatttattgtattttttaaattggtgatgctgacattctaataacagatcatttacacgactgataaaatatttaggaactaaaataagtaccaattttatgacattaaaaccataatgtgcgcttaagtgtctctatttcaagcaggtagttatttgaaaaaaaaaaatcccttcttggtttctacctttaatgattgcaaaacatctgtgtaaagatacagacttttatgtatggagggaaggtggtgtcccagcaattaaattttatagctacataacaatacaaatgaaatcatccctcataaaaagagaacaaggaggaaggatacccaaaatgttctacaatatctcagtacatcttatgacaaaaagaagaacaaaaattataattgtaggaaatgtgagagaactatctaaaatatacaatagcagctttgtgggttgtgaaagagtcaaggttttatgtgtcctgcaacagaataaaaagtcaaatttttatgatagaaaattaaaactgaggttacgaacaccatcatgtatagacttatattactacagcatccataatatctgtttcctatgccaaaattataattttaatgcaatgtctttgccattaaatgccacaggatttggaattttattcattagtcatattaaaattatttaatcatcttttctccatccatatgcctctgtatccctgttagtttagatttagggatagaaagcaaatgatcagtaccagatttaggtaaataacacaagtttttttaaaagtaaaagaaaatggcttataacactggcagacagtcttgatcttcattaaatctcaagctcttacttattacaggagggtagaaataaagcggaccccctccctgtgtcctccagccctacccttcatccaaaggttagagtgggtgatataattggaactagtgggtcatagttactgtgacatgaatatgtcaattccttagtacatagtatctccaaacatatcctaatatcataatcagttggcaggtgactttctccacagctaactctaatatgctgcattctgcgtattgagccaactgaccccttactcttgtacctttattttatttttttttttatttattttttgagacagagtctcgctttgtcatccaggctgcagtgcagtggcacgatctcagctcactgcaacctccacctcccgggttcaagtgattcttctgcctcagcctctcgagtagctgggactacaggcgcgcaccaccacacccaactaatttttgtatttttagtagagatggagggttcgccatgtcggccaggctggtctcgaactcctgacctcatgatctgctcacctcagcctccgaaagtgcggggattacaggtgtgagccaccgcgcccggcctgtacatttatatttcattactgaagagagaaaacagcaggtgaagataatatagctatttctttaagggagtggtggacagggttgctttaaactgaatatagccattagcgtaaatttatgggtagcttcatgcaatgaaggctcatgaaatgatatcctcattcttgtctaatacataacttgaccttttacagcctttaacaatgatacccgtaagagccacaaagtggggatgttattaaagctagcctctgtgttcctctctctgatcatctcattctatgatcttcacccacacttctgactcaggtgtttttaatatttatccctcttcatatttctttgtattttctctgaacatgcatgtgggtgtaggaggctctctcgccatcatcatcactctcttcctctgtgtttctcacttttaggctaattttcatctatgaattgacacgtatattataggaatttatttttatatatttattaggaatcttctttttgttttttttttttttttgagacagagttttgctctgtcgcccaggctggagtgcaatggcacgatctccactcactgcaacctctgtctcctgggttcaagcgattctcctgcctcagcttcccgagtagctgggattacaggcatgcaccaccacgcctggctaatttttgtattttaagtagagacggggtttcaccacgttgatcaggctggtcttaaactcccgacctcaggtgatctgcccacctcggcctcccaaattgctgatattacaggcgtgagccaccgcacctggccatgaatctacttttctatttgcatatttgccactctttttctgccccagttgtttatgtaacacattctcttctgctctccttccctgaccccgttaatcccagtttcatctctttcatgtctttttattttgtgtcccctttcctcattcttcattgctctttgtatatgttatatgtgggtatttttttaactacccatttatttaaaaccaaaatatgctttatcattctttatttttgaacaccgagtcctagaaaggttatgtgacttatttgagaccatgtagctttctatttaaatataaaagtgattccaaaataaacagtaggggttttaaccttttggtgaagctcaagtgatttttatgtggataatatcctaatattaaaatggggatttattttcttttaaaaaaactatatgagtttttgctttggtttttgccctttttgagaactagatgctgtgttttaaaattactttctagaaacttctctgctgtggaacatttacagttgtgtaatatagcaaaacatgtttatgttgtttcagaattagttaaaatcctactatttttaatgtcaagtaattttacaggtggtgtacgttatgcattcctattagttttaataaatatgttgtcattttgttaaataagtttaaatttttcatcgcattttacatgtaaacagtaatttactatctacacataaaataccatttacaaataagatatactgtttatatgtaaatggtaaattactatttgaatttgttactgcccagacagtataaaatggtgcacataaagaaaaaagcattttggaaaacaattaagaaatttggctggaaagtgaattttagttaagtgcatcttattcactttaccgaggaaaaaggtaggtttacaaatacaacatatataacaaacctttaatatgggaataatttttgtaatattgataataatacaggtattattttcaaaaaatcaccaaataaaaattatgaaagtaaaaatacagtgcaactcctagcacaaactatcttccacaatatacagttggctgtatctaaatttccagaaatctggttcattttgtattaatctctaatcatgttgcttctaaatatgtatctgaggagtaaacatttcagatttattttcatttgtataaggtaaatgaatgtttagtctttttccagacgtatttgctatgtaatgacagtcattattagtcgtcagtataaatgtgaatagcaaaaaggagaaaattaaataaagctagagcttggctttccgactccttgctcaaaaatggacactttgtccaatcaatttcctatcacaagatgacgattaatagattgttctaatagttaccattcagtcctgcccttaacgtgatgttttttcaaccaaataatagaatcttcactggcattgttaccatattgactggtatttatggaaccccggaaaaaaaaatgctgtaaaatatatagtaggaagtataataatcattataggaaatcatttctctagctggaagtcttagcagggaccagatagttccactggagcttttatgtgctcatgattttctcccttgaagtgtatttgtaacacagttcacacagtttttaattttataaatctgtgtgctaaaacgctattatataagaaaacgggccgggtgtggtggctcacgcctgtaatcccagcactttgggaggcccaggcgggcagatcacaaggtcaggagatcgagaccatcccagccaacatggcaaaactccgtctctattaaaaatacaaaaattagctgagcgtggtggcatgtgtctgtaatcccagctatttgggaggctgaggcaggagaatcacttgaaccagggagtaggaggttgcagtgagccaagatcatgccgctatactccagcctggcgacagagcaagactctatctcaaaaaaaaaaaaaaaaaaaaaagggtgttcacctatttattgggcatatagtctgatagttcccagaaacccattatcttgaatgttttctttatgtaagttcctggaaatccattatttggatgttttctttatgtagttaataattacagcaaagctgtaattaaattatttattcaagagctatctattaaaggactactatgtgccacattctgttctaagcatatcataatcacttcccacccttcccttatttaaaggacatgcataattttatagggcttggcattataaatattcatatctctaatttatagttgctaaacagtttgaagctgagggttgggggaagggagtagtaatttaaagtttataacataagcatccttgactttgcctcctataatttcacactgacatgaggtttattactaggttgtgtgtcatgagtacatctcaatttgctctgactgttctggtttttgcctgttatcctatcataatttttaatagctccctctttcattgtcataagtattccactttagaagataaaatatatagagagggtcactctagttatgagaacaaacatcaggcttttagagctaggcttggtccagtgctcaataactattattatcatgattgcttttgttcttagtagcatcatcgtccttgtcatcatcatctaccttcctaatactttagttcagctgagaatttcggcctatccaagaaatctgattgccattattaccgaattaatcactctttaatgacaatagtatataagaatacgtgacatttaactttccaaattattgaaatgttacgctgtgtatggaaaattctttctaaccgtgttttttctctactctcaaatcgtaacaatcgtcaacacagaagaagacttttatgaccaaatttgtggaatttttttccccatacaccaaacagcaggcaccagctgggtgtctctaattcagtcctgacactatccacccagagatagtgtcagatcccatagattgagggctcagtaccgaggtctgcctcctctgcacccccctagcgcacgcgcgcgcacacacacacacacacacacacacacacaccagtctcaagtccaggcctctggaacttctgacccatgggcttcaagttggggttcccatgaccctctctttgggttcaactaacttgctggagcagctcacagaactcaggaaaacactcgctttcacctgtttatgataaaggatattgcaaaggacacagatgaagagatgcatagggtgaggtatggttggggtggagggacggaaaggggcatggagcttccatgccctccctgagtgcaccaccctctaggaatccccacctgttcagctacccggaagctcactggactctgtcctctttgttttttatggaagcttcatgacatcagcattccttccccaagggtatatggtgggaccctctaacaggaggtttttaagacctataatctgaaaggcgagggaacattaaagtgaaaggagagcaggagaaggtcagaggcctgcccctgagacccaacgcaaccaacattataacaaaaaactgtaacaagggctatgggtgttatgagccaggaacctggatagaaaccagtatgtactataataccatataggcaatgccaagaatatggatcagacactttacaaacaaggaaaaagtaaacaggagtgatgaggaggtaatttactgcaggcattaatgatgagattatgaattatggattccacttgctaccagctatgtgatcttatacctactctgtccatacctaagttataacatccataaaattcaaatactaaaagaagacacttccccaggttgtggtgaaaattcaatgaggtagtaaatgggaaatgtgtaacacagtatctggcatattgtaattgctcaaaaaatgttagattaaaaacagtaggagtaatactaaaatagaaaaatgcaaagagcaagcacaaaatcatctctgattctcacctccaaattctccaaaagtctcaccttcttaatcaaagttgtaaatatggctcttggggagaaagctgaactatgtgctactattatgaatgcaacaggtgaaggagaggagagttagaggcagcaagacaaccaaatggctctcgtggaaggcacagaggattttcagccactgctctcctattccgctgatattactttcattttctatgaccaactagcatttcagctaaaatgtgttggaaaatgatagatttttctcctcctattgcctaagaagcccaacaaagccagcattgttttcaaacaccagcattctcacttttaaagtatgaacataattcagaggacttttaattctgaacatcgtttttatcaatctattggcctgattgtaacccagaaatccaagcagaaagcaagtaaactttcacactgcttccccatcccttccccctacctttatttttgacatcagtttccctcattttggcaaagtaaaggaaaagcatttgtagaaggttacactgaagctagataattttctattaggaaacctcaccaaatacaagataatttgttcattccaatataataatgttttaaaaaatataacaaaaatccagcataaattgtgaagcactgatacttgtgtaacaactaatttccatagtgaaacttcattgttgccactatctacatactgaaaatgtatatcaagcatgtaaatgtgtcacttaagtatgctgtgccctagattttatttaaaagttaagctaattttcaactaaaaacaaattcgactattcttagcaatctctcctccccgttcatgatggatttaaaatgatgaagagtataaatgatgatgaaaagagaaaggaggagaaaaatttcataactctgcatcttcagtgtagcatttttaagtaactcctttattagcacaaaggtgtttgcctgaagcaatgacttctagaaaggagaagaaatgacataataaaaggggattttgctaatataaaatgttttttctttccttttgtttctgcaatgcttttacttacatagcaccaaccctgagactagagggagtttccttcctttctaataatttaataatcgtgaaatgatattaaatggaagttttcatatgccaactccttaaactgaggttaaataaggaacaaagattaaaggccatatttaagaccacatattgtaaattctaacccagtttcatttattatatcacctgcaaagccaatatgccatacaaaagtaaaataacagggtgatttttattaaagatcagaatcataccaaaaatgaacttttctgtcaaatctttatactcatacatcaagatgtgagtttatttatgtagctaaaataacttaatactaaatgctgactactatattcatgtcagctgacccctagtgcttcaaaccatagaaaagggataccaaatgctgggttggttgtgtattccatttttgccgtataccacctgccaaggcttataacagatctgtaatgggtttcttaccttttattgtgtagaaaatggattgttggattaggcctggggccagtgaaccatggaaccccaggtttgcaagaaagagtttatcaccctttgatgttatttctgtctcgtgtcagctgagaaggatgagctagattatctgaaagtaagctggatgccaaaatcagcattcccctcatttatccaccttatggttcggggcaagaccactgtatgggtaacaaaagggctgataagggcctgatggagaaatttggtttttctcccttttgattggcttgctgatattagaaccaattacaagacattgacgagagcatttcattgtttgttgctagagaaaatccatcaattttgttgtggaaatgaaagcatttgagctgaatgttgcacttataatttgtgaacattttcagttatcaccgggacaagtatagtccatctttggcatggttggccaagtgtggtgggaaaagagatggaccagcaaatgggccggaaaccaaagtcatcaaaagggtatttcaagaaaactctatttgttctgatggttacattctgcaggcaacctgtgactgatgactgatgcttatacctcaaatgcagtctaaaaatatttttttgtgaaagtgacacattctgactgtgatgtgggtgacatcaacagttttgaataggacagtacttcttggacttattgaaacttttataaaagaatgaacattctgaactcaattgcaatgtaaatgactatcatgaagattgcttctgttggtgctatgacttttgtgacaaattttagaccattgcagttatctcctagaggttgctttattgttttattttcatcagtgatgtgtattttatcagtgatgttagaatcactgagctgctggttaaggaagagaaaaaaattaatattcaggtgctatataggcccttattcattgagaacaaataaaggccaacacacaaaacaggaaaattaatagaaaagacactctatgggtaagatttcatatagtttgggagcagacaaaaactattttaattactaaaataattaagaaagatgttgaggctgggcacggtggctcacgcctgtaatcccagcactttgggaggccaaggagggcaggccacttgaggtcagagttcaagaccagcctggccaacattgtcaaaccctgtctctactaaaaatacaaaaattagctgggcgtggtggcacatgacttgaatcacagctacttgggaggctgaggcaggagaatcatttgaacccaggaggcggaggttgcagtgaaaggagatcacgccactgcattccagcctgggcaaccgagtgagactctgtctcaaacaaacaaaaaaaaaaagattaaaaaaaaagatgttgacattaacatgttcaagtctttatgctgaaactagaatgcagtatgattaaataatcatttctacttcgggtgaaggattagttttcttaaagatacccctttccagcttctcagttcgcgtgtggttaattcccaacgtggcctcaaatattctaatggtttgtgtaatgagtgccaccgttccaccttcttattctccatgcctcatctcagtcctggaaagatcactaaacttgcagttcataactcagtctagacccaggttcaacactcactaactcataactgtgggccacttatttaaatctcttagtgcctctagttcctcatttgtccaacagtgatgcattatgaagcatgtttgcccatctcccagcgtctagtgaggaactaaaaacacaatatatactatcatactttattacgaggagttaaattgtggttactattacaaagtaggttaccataaaattctaatagcagtggtaaggggtaaagatccacgtgccatcacgtagagcagaacttctcaaactttaatgtacggcaggtccttgaataatgttgtttcattgagcatcactgtgttataatattggcaagggaaaaaactgtatctcagctaggggggcactgtctatgtggggttttcttttgtctctgtgggttttcttctagtactctggtttcctcacatgtcccaaactgtgcacgttaggggaattggtgtgtctacattgtccccatgtgagtgtttatgtgtctacgactgtgccctgcgatagaatggcatccctgccagtgttggctcctgtctggtgctctgagttgccaggatgggctctggcctcccaagtccctgaactggaatacgtggcttggaaaatgaatgactgaattaatataaattactgtgaaataaaaattcatatagtattcaataatcataaagatgcgtgacaataattgatgctctacagaagtgctcagtgagctgccatattgattattgtttgtttttgaactttgtggtgagagaaggcaatcctggcagtttatgctttgcaaacatttattccttgaatgaaccaccgccactgcaaacactgtcactcactgattcaccaaaaactgggtaaataattttcctcctggtttttattaatctttctaaagtggatgtatatctcacatttatttctgagtttaatattagaagtgcttggggtctttatttagatgttggatcatgttttgtgaacacaggtatgcagtaggaacttaattcttgtttatcaattagcctatggtaagattggtttcattatatgtcattttgcctaagtcacagtttcccagaatctatcaacaacattaattgatgacttactgaaacaggaatcaccttgagatcttgttaaaatcaggttactgattcaatggctcttgcataggacctgaggttctgcatttccccccctaatttcaagatgctggttccctggtccccttgctctacttcttaaatggtagggaggtagagagtggctatcaagagtctgtgtaggagttgaccaccaatcccattcaatggaatgcatacagtgtgttctgagatactggaaaggcctttgcaaaaagattttgtctcttgatatttatgaagcacattcatccgaccacagaagatacatatcaactttgacagaaaatatgaacacattcaaatgatttatacctttgaaacatagatcgttgtggggttcataacccaagtataactttcccacagattcactcaatttccttcctctttctgtgcaatatattgtatattgcaagaagctcacctccactcaccttattcctcaggctttcttctcaactatcttctgtatagatttaaccagtgggaggcgttggcaggagattggagagcaggagaaggggagatttcagggtatttctttccctctttcactgctttgggcaacagctgatacagagtaagtggccaaaaaatactagctattattaggtcttctaataatgatcttctaaaatcactttttcagtggttacccccattgatttgccatgaatgtctcttcagacatctttgcaaagaattgagcctgactttagatactcattcaaaatcaaaatcagtaattttaggattgaggactctggtattatttaagaactcttaactgtaccaagcctcactcccatttctggctttcccctatatatcagttaagtaataactccaatagtgtaaaatttgcaatagtgttatgtaacaaatcaccctaaaacttattgacttaaaattatcaccatttataattgcacacagtctgtggggtcccgtgagctgttgtgttgttctggctcactcatacattttcagtcagctaatgggtgggctaggggctggcttatctagcataagcgcagctaggatgattcacctctgctccatatggtctctcatccttcggcaagcgctcctgggcttattctcatgcaagaaacaggattctaatagagaaggaaacaagacttcttgaagcttaagcttggagctggctcactcatttctaacacatttttttaaccaaagcaaatcacaaggcaggcccatattcagggattagggaaataggttacaactcctgatggtagcaactttaaaagtcacattgcaaaaagatgtgcatacagagaggtcaccagtgcaatctaccacaccttgcaatctattaagtttctcaccccctcacaagtaaggtattcagttaagatgcattcctatgtattcagatttctaatcaactaatcctgattctcacgtaatattgacacagtatcaatattctcaaaagccaatagtctagagggtcacaaagatcctcaaagatactttatgcaaaatcctaggagtatagaaacagtaccttggtttatgtatacattcagtatttattaagtgtttccaatatggtataatgttaaggaatgaggatagagttatgaacagacagacacttgtctttatggatcttacatttggagggggacaaacattaaaatggattatataattacaaatgcagccgttctcattgtcttttcagatttctcagggtgtagactgagctactataataaaaataccccaagtttccatgtttcaaacaatatagatatgtgtatctttcccacataaagtccagcctaggtacgtagtctctgctctaaaaaggaacacaggctagcaaggcagctatactattctcaatataatactgcatttcaaaatctccatgctggtcccacaaatatccatgcactctctttcttatcatcaagagaacacacagtgccttcccaagagagaccagtcaaagtctcattcacttactgcatccagctaaaagtccattgtctgtggatgatgcactgtcttctccatcagatcaagatatggttcctcatggtccagtgacctataaagtgaaagttatgctatctgctcctaccacaaccaattctctctttttaaaatttttttaaatttttgtgggtacatagtaggtgtatgtatttatggggtacttgagatgttttgacacaagcatgcaatgcataataatcacatcatggagaacgggggatccaccccctccagcattaatcttttgtgttacaaacaatccaattatactcttatttatttttaaatgtgcagttacattattttgacgatagtcaccctgttgtgctatcgaatactgggtattattcatttttcctaagtattttttgtacccattaaccatcccgctgccccctccccgactcctccactatccttcccagcctctggcaactacctttctactctctatgtccatgagttccattgttttgatttttagattctgcaaataagtgagaacatgagatgtttttctgtgcttggcttattttgcttaagataatgacctccatttccatccatgttgttgcaaatgacaggatctcaatcttttctatggcagaatagtactccatttgtgtatatgtaccacgttttctttatccattcatttgttgatggacacttaaattttttccaaaccttggctattgtgaatagagctgcaataaacatgggaatgcagatatttcgtcaatatactgatttcctttctttgggtatatacccagcagtgggattgctggatcatagggaagctctatttttacttttttgaggaacctccaaactgttctctatagtggttgtactaatttatattcctaccaacagtgtgcaaggttttccttttctccacattctctccagcccaggcacaaagacagcagtaagtgctggacgaccacctatgcaagacctagactataaatccagtacttctctccctctccacacccccatacccaccactccattctgagttttcaaatgtaagctaagctaaatgattcaataaagctttttgaagtcaaggatgagaaaaatcgttgctttttatgtaatcccaccatcaaagtaataattgcttagttcaaattgtggtgatgcaaacaaggaaagcaagagagcataaaacgggtggatctgacgcagtccagaagtggaggcaatggttgtttttagataattattagagaagatactgtgatttggtttgaaggcaaagctcactgaagttctctagttctagatacacctatcgaaaaattcttacccaaataaatgtctcagtgataagagcagcctttccccaaatgcctaagtgtttttgttttgtttttgttttgttttgttttgttttgttttgtttttgtttttgttttttttcaaaatcttcctctggaatggatgctgaccttgtcattgacttattcttcaccacaactcagtcatattaatcttgaaagagacagagaggccactatctctgctaataatttacataattgtttttctacaatttggtgctaattaaaatgtgaaaggggtagtgatgatataggtaaatgtaataaggtcattctttgttcctgagagcaaagataatgtcaccagaaaggattgtctgtatattcacataagagcaggaaacaggaagagagacacagtaaggtaaaatagcatactagtatatcacgtagtctggtatagccaatgtagaatatttatttcaaaaaacaaataaagataaagttctgcttcactttgagaagctgttttttttaatcctgtatagttagttcgacatgttactactctgcctggttcaaattttgatttcactctgttccagttatatatgctatgcaacaaaccactctaaaagttactggcttaaaataagatagttttacgatttctcataattctgagagttgactatgatattcatctgcttcacctgatatcaaccaagacactgggaaagctggaaagtccaaaatggcctcactcacatgactggcagttggtgctgcctaccagctgagaactcagctaaagctattggccatgagcctcagtttgtttccattgtcttctccatgtgtctcctttggcttccccacagcttggtggttgagttctgtgaagaagccttccaaaagaacaagcaccaatcttcaaagacttatcaagcttctgtttgtatcacacttgctactatcccattggccaaagccaggcatatggccaagttcagaatcaaaatgagaagggactacacaaaggcatgaatccaagaggcgtgattaattgtggggctgccaaataatcgccttccacaaattccttactagctgtgtcatctctctgtggtctcagttttctcacctggaaacaggaacaaaaatggccctacaaaaatggactgagatatattaggttggtgcaaaagaaattgcagtttgggaccgtgaattttaaatcattataactaggctcaagcacatctttattaatcaaagtaggaaccgttacagtcaacacatttttgccaagaagaaataagtgtgtttattcctgtagcataaaaattcatgctttgggattcaatgaactcttggaaagcattttcttcatcctgctagttgtggaagcattttccctgtaaaaagttgtcgagatgcttgaagaagtggtagtcagttggttgagaggtcaggtaaatatggcagatgaggcaaaacttcctagcccgattcattcaacttgtgaagcgttggttgtgcgacgtgcggtcgggcgttgtcacagagaagaattgggccctttctgttgaccactgctggctgcaggcatggcagtttttgatgtatctcatcaatttactgagcatacttctcaaatgtagtggtttcgccgggattcagaaagcggtagtgggtcaggccagcaggagaccagtgaacagtgaccatgacttttggtacaagtttggctttggaaagtgctttggagcttcttctcagtccagccactgaactgggcatcgccagttgtcgtttaaaatccactttttgttgcacgttacaatccgatcaagaaatggtttgttgttgttggcgtagaataagagaagatggcacttcaaaatgacgatacttttattttcgctctgcttatgaggcacccacttatcgagttttttcgcctttccaatttgcttcaaatgctgaacaactgtgaaatggttgacattgagttcctcggcaacttctcgtgtagttgtaagaggatcagcttcgatgattggtctcaatcggtcattgtcaacttctgatggccagccactacgcccctcatcttcaagactcttatctcctttgaaaaacttcttgaaccaccactgcactgtgcgtttgttagcagtaacttggccaaatgtgtttttgacattgcgagttgcctctgcttctttacaatccattttgaactcgaataagaaaaacgctcgaatttgctttttgtctaacatcatttccatagtctaaaataaacataaaataaacagcaagtaataagtcattagcaaaaaaaaaaaaaagtgagaaatgctcattaaaatgatgtataacataatcacatttatttaagaatgtatttcaatatcaaatggcaagttccatgaatgtgaaaacaacacttacttttgtagtcacctaatgacacatttaagaagctgaaacctgagctcagcacatggtaagacatcagtaagtattagttatcataatttttttagtaattttcctacagagctataaataaaatgaaatactttccaaacagtgataaaactataaagcagcaatacattataagcttctatcctaatctgccttcccctcagggccttaaaatgtgtcatttctgtaaatgttacctctgacatgaaagcaccaacacactgttcagcaattacaagttgattgtgacaagagcctcactctccctatttctttttctcttcctgtcttgctttcccttttccccatcctttcactcactttgataaggcaaactgccatgtagtcacaaaatcctagacaaacaagtctgtacctatgtgggcgatgctgtggatttagtaagggaaacagttccttgataaatttctcctttagccctgggtttccaacccctgtgtcattcagctatagaaatcttctgatattttctcccactggtcattttcactcaggctgccatcaaaatgagactacccaatgttctttccatttgttctgttttcttcctcgcctctgattccctgcctggtccacttagaaagtctaccttttttccttctctcttaataccaccaatctctaaatctgacttctcctttctaatcccatagagcctgccttgtcatctccaaacaagatccatcttggcctcctgttatcctcagcccacagcagtatttcacttacaacgttcgttagtttctacctcagatgtgtcaggcatttagtttgtaccaatattttatttctttttatatctacaccaagcctgcactagacggtccaaggagaaatttaactgattcctgttttgaagtcctccccactccttgggagagttaaagattcctcagtgtgttaggtaatgatagttaatatttattaataacttactgtgtatcgactgtattctaagtgctttgcactgttagaaggagaataacctaagactgtgccaaacagcagtctagaacaaagctgaattccttgcttgcctggcaagggagaatgtggtacatactaaaggattaatacatgttcactattaaattgattgattgtggtggtggtgacagtggtgatgacttttcaagtgtgggtaaagtaattttttccaacaaatccacatccacatatttaagaaaagagagacatttcattctatctttttgtgtgcctttgagaggacacccctggcacccaactcccaggcaaatgccaccatctgtgtgattttccttcatttgccaacgaaggcacagcaggtactactaggttaacctttgctttcgcaagtcttctctcaaaatagtaaacacttcagctgttggaaagctctaatctcaaactgcaaatttaaaaatctctctctggagttcaaaaaatagaaagaaaaaataaaaatctctctcttctggaacataatgtttgaactgttacatattattcacactatttcacattatgggattatgaaatatggttttaggtgttagaaaaacgaaagaaaactattatttgttaacactaaccgagagatttttatgatattcaagtaaaatgatagaatgaattattttaaaaatgcatgaatcttcaccttctgtgaagtgtcatggaggattagttctaactaatatgcctgtaagtaactgacttaatgcgtctattggttctcttaatgctgtaagtgacagaaaactggtctcaaactgatttaaacaataaatatgatcaaggttccggttttttgtttcttgttttttttttttttttttcacatttctctgggttctatttttctgtgttgacctagcagcttcacctgacttccctcttggtgacaaaaatggcctgaagccgtttcagaacccacatctgcaaacttacttttgatgaaaatcatctctttagggaccttctttcccaaagcatccaggaaagactgctctgaaactgactggcctgaattaggtcacatgctcattcctgtactaaatcacacctcacttctacagctaaaagtcattaaatctcaaccaaactctacagctgcaccacaacaaaggtagagaagtaggtgcaaagttcctcaaaggaacgtaagggtgaaagatgattgactgataaacagacaggtagacagaatagatagatgaattaggaaaagataaccaaccaatatctgtcacattgctttgacttgattttttagtcaattaatgaaactgaatggtaattttgacattacaacaatactttccaaatgtaggcaggttgtggagatcatttaaggaaaaaatgtatgaggtgttgtagcagatactgtcggtgccccaccgatatccctttagcacttaccatttttatacgtgcttcttaatttccaacttcctgtacttgcatctctttgcttggggctatctctgctcattcttgggagagagcagaaatgtagcagttatgcccctgtagagcagcagttgatagatcaataccctgtcccccttgcccttcagatctaataactccaagcttaattccctacatctttcatataagtatatatataagtatatatatatacttgaagttctagggtacatgtgcacaacgtgcaggtttgttacataggtatgcgtgggccatgctggtgtgctgcacccattaactcgtcatttacattagctatttctcctaatgctatccctccccagccccccaccccacgacaggccccagtgtgtgatgttgcctgcgctgtgtccaagtgttttcattgttcaattcccacctatgagtgaggacatgcggtgtttggttttctgtccttgtgatagtttgctcagaatgttggtttccagcttcatccatgtcccttcaaaggacataaacaactcatccttttttatggttgcgtagtattccatggtgtgtatgtgccacattttcttaatccagtctatcactgatggacatttcggtcccctccaagtctttgctattgtaaatagtgccgcaatccatcacaatgtatacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttctcccattatgtaggttgcttgttcactctgatggtactttcttttgctgtgcagaagctctttcgtttaattagatcccatttgtcaattttggcttctgttgccattgcttttggtgttttcatcatgaagtccttgcccatgcctttgtcctgaatggtattgcctaggttttcttctagggttttatggttttaggtctaacatgtaagtctttaatccatcttgaattaattaatttttgtataaggtgtaaggaagggatccagtttcagctttctacatatggctagccagttttcccagcaccatttattaaatagggaatcctttccccatttcttgttttttgtcaggtttgtcaaagatcagatagttgtagatgtgtggtattatttctgaggcttccgttctgttccattggtctatatctctgttttggtaccagtaccatgctgttttggttacagtagccttagtttcctacatcttcttttagggataacagggagtattaagattcagttgttcacattgatgacttgcatgataatataccctttattggctatcttccctatttcacttcttctcaccctgttgatgtgtcctggaatcacatcccaaaactacttgagctcaaatttttatttctgggtttgctactgggagacccaaatcaagacagttggcttcagtactcaggtacttacaaggagatcatggatatcaattgaatcagaattccatgtcatagcttttcaaatttatatcacaataagttgaaaagatgttgattcttccttccacagtattttctgtttctgtgtgtcttacattctggtgtctcaaaacatggctgcaaccagggaaggaattgaaatttggagtaaatgtcctattttagtaggtctacatttaagacatggacctgaaattgagatcataaacaaaagtagatgtgagcataaagtagaaggtgaggttggagggggaaattgtttggatttactgtaaccaatggagctgcttagtctagtcaaggaatttcaatcatttctgtggagactagatgacttatgttatacaaggatatctctggaaaattcactgtacagttttactaaatctggctgataatatgttcactcaatgttatgatgtcaataatagaatggatattgcctttaaagacaattttaaagtaaatatctcacatattcctactcatttatcaagggctgtgtcattcatggcaatataagataattcttttcactttcaaaatcttccagatgcagaaactttccaatatttgctgtagatgaaagtgtacaatttcacaattcaatgggacaaaaagaattaggaaaaatatgtttcagagagtttatttggtatcatctacaagacctggtatgagacctggttggtgttgtatggaatgaaatatatcagtctgttctcacactgctaataaagacatacctgagactgggtaatttataaaggaaagtgatttaattgactcacagttcagcatggctggggaggcctcaggaaacttacaatcatggcagatggggaagcaaacaccttcttcttcacatggcagcaggaaggaggagaatgagcaaaagagggaaaagccccttataaaaccatcagacctcgtgagaactcactgtcacaagaacagcatgagggtaaccgcccgccgtgattcaattatctccacctgatccctcccaggacgtgtgggggttatgggaacaacagcttaagatgagcttttggtacagacacagccaaaccatatcatagagtttcgaatctgaaaaacaaaagaagctaatttagtttcagaaagctgagatttcatgaaccatttaaaaattcactttataatttttcatgcattttgaagcctttatcctttaaatggaaatggaatagaactattattcgtcatttctaaactgtgcattcatcaacaattttcagaagttaattccaacatgtcttcatcaactctatattacatgttagtacactacatctctattttcatgctataattttttactttttcctcacactttcatctcaccctctcaagatgtgttaatcccctttgctcttttccccatctcgtctctgttgcctttctccccccttcctttttttttaatttctgttctcttttacctgaaatctccctcttcatcttttgctaccaattatgttcttaattggttgaagtgagcaaggtaggaaattctccattttgattccattctctcacatggtttatctttaatatgttttaataaacagtttaacataaatcttacttccaatttaacatgtaaaatttagaaaattggtgaaaaatatgcctgctttttcacccccaaagaaccaagtttaaaaagttttgtgactttgaggcatccttttccctaaaagcaagcttaacagattcttagcattcgtctctgtgtgaaattgtggaaactttaaaaaaactatttgaagtaccaacaactcaaagataaattgtctgttttaaatgcaaggtgctaaaataaaactagaagattgacaatattattcatctttatcactgttctacttaaaatttgaaaattaatgttagaaatgtgagagggtgcatgaaaccttaatggttttatcatttcatctgagtatatatttgatttcttctttctgacattgaaactttaaaattcgccactatttttcagtaactcgttaaaatatggtccgttcttatatttgcaatactcctatactgaaaaccctacaacttcaccattatttaatttttatgttactatatttgtttcttaaaaagattataatattatgtattagttgtctattgctgcataacaattactacaaagataggggcttaaaactgtatctttagagtatcaggatacatatgggtcagaagtctaggcatagattatccatattctttgcttcggggtctctcacaaaggctgcacactaggtgttggccagggctagggtctcatttgaaagcttgccttggaaggacctgcttccaaactcacctgttgttggtaagtttcagttccatgtgggttattggactgtagtcttccttttcttgttggctgatggccacgtttagttccttcggtctctaacatggcaatttgcctcatcaaaatcagtgagagaaagtgggggaggggggaaagagacagagaaagagtgaaattgctagcaagacaaaagtcccaatcttatgtagcctaattggagaagtgatatccttttgtctttgacatattctgcttgtcagaagcaagtcaaaagtcttgaccactctcaaggggaggaaattattaaaggactcaaatactaggagacagagatcactgagtgccattttagagtcttcccaccacggattatttcccttcacctgctggcatttgaaaatgcagctaatactctgggattctccaaacctaatttttttgtataattagagaagtatttgtcataatctgttaagtgtagtaatatattaagaaattgaatttattccttcatatttcaaaaagtacatggggttgggggacagctatgttgtcataaactttaatacatacatgattggaatggattatgaaatatttttctctaagagatagtataaggctgcaaccactgaggctcccaaatacagatgattcatatgtatttagttttaatgcaaagcttctcatgctgatttaaactctcatattttcatatatggtgttttattttttatataatgaatgtctataaaattcctattattttttcaaaagtattgtggcaaatatttcctagtaaaatctaaagatatctttgacgtaatttttatgctctcatttatgttaagaactcaatattgaagtaatgttctttcttatttcctagtaactaaaatccttactatattcatgaagagctgtgcctctattaaaaagcttttattgcaaacagaaatgtcaaaatacagcaaaggtagagctatgtatgattcttcatctgtaatgtaattttaagtatacattttattgcataagcagagatttatacccacatttgctttcagtattcacagaagaattttcatatgtatttcttaaaataacaaaatggctgctttggtgtggggatagtatggtacagcatttattgtgaaaatgattcttatcttccatctttttcaaatggtgagttcagtatgtttaacattgctggttttataatattgcgaatatttttgagaggaagaaacaataagagactgataagaataattcatatttgctcaaagtttaatcagttttttatttgaacaaaaacttggacgaaatgtccaactttcctttgagatcagtgctctccaatgtggtaacaacagcctaccatatgagcatttgaaatatggctagtccccactgaaatgtgctgtaagtataaaacactcaccaaattacaaaacctaagtatgaaaaaaataaaatatctcattggtactttttatattgagtacaggttgaagtgacaacaatttggctatttaagttaaagaaaatataacattaaaattaatttgacctgttttttacttttgtaatgtgtagaaaattttaaattacatgtatcgctctcattataattttattggatgtcattgttctagataaacaatggcaatgttgagaggtgtcataatagggacaattgtctctgtgaagaagaaattatatgaaccctacaacatgtattagccgcagagttgcttagaattgacttactctgtcttgttgaaaataggttttcccttaaaatctctgcctgatgtagccaaccacgattcaatgagcaaacaaaaatcttaaaggggaaaaaatcattttttgagtctattttacacacccagtatcaaaaagaaaaatataaatccacaactaggattatacgggatgtaattcttggatttcttttggtcttataatgctttatacctaggagatgttcaacaaattattattgaatgattgtagtttaaccgtcagttacattttgcagcaatacatttattagtagcaaaatctgagtgtttactaattttcatcacctaatcagcaaattagtactgctcttatatcgctatgcctacgctctactcactggttcaatcagctaattttttcagaattttatggtttataaaccactatatgttgcacagtatttcctatacattagctcatttgagtcacagaagttataggaggtggatcttgtctttctttgttcagaaagagaaatccaggttcagcgaggttaactggccttgtttaagatcagcacgttgctaggtgacagaaggtgttcacttctcactgaactttgcatatcaaaagagatttaaagaattcactttggagagcgggagttatggggtgaatattttatcatgttgtccgtcttaataatcaccaatttgatactaaggctgctagtcatctctaacgaagagaagttactttgaagttggttgattgattgttgttgattgacagaagtattagttttcagaatgaactaattcattaaagaaataaaacattgggtttgttcattccataaataattgaacatttattatgtgtatgataccagcctaagcagatacctaaaaggaatggagattactatagttaataacaatgcattgtattcttgaaaattgccaagagattacattttaaacattctcaccataaaaaaatgataagaatgtggggtaatgcatatgttaattatctcaatttagccattccacagtgtatgcatatttcaaaacatgttgtacacaataaatacatacaatgttatgtgttaatttaaaaataaatacattagaaacggtaaaagtcactaggatcatggaaataaaaatgtttacatttatgtaaatattagtaatataatagagggcatatccaaaatatagtgtcatattaataagatgttgtatgattattatagactacaaaataataaaggaatagacagaatgtttctaaataaagaatagaaattacagtgaagcggaagagagagtaaccctaaacccttcataatcctccctttgcctcgtagtatagcttggaaagtaattatgtggaaagttgagattgcaacaaaggacggtagtacaggagttgcccaaggacagacaattattttctcaaataaactatagcagaagcaaaatggccttggaccacaaaagaaggccctcatgtagacattgttctattctgaagtagaatttgcagtactcaagagaagaggaaagattattataggtggagagactgtaaacaaaatattatggtaggattcctcctgaatagagcaaggtgattgtgtttgacattgaaaaggtatgtttgggcaagagtttgaaaacctttagccaccatgctaagagatcttaaatctttatctctgagtaagggcggtggttgtggttaatgatccttgagcacaactctgtcccattaaagacagtagattcaactgcttctagcattagtccatatcagggagtaaagtgatccgatacattattttcccccagtaaatggttcataaaggaaggccttggctctgccttgtatgtctacatgggagaatataccagaatgtctagaggagcatgggtagcgtaacctttccccatatgcacatacaacaaatactgataatccactcacaggggagggactcatttttaagaattaagttttattttagaagactcagtctgatggcaatgcaggggttgaattacagcaggtagagactggaggtctacaaactggtttgagatatatattttttccggtggcccagataataaggacttgaacagacttcttgctctgggaatgtaaaaggccaggctggatgtaagaggttaggaagttccaaactgtcccacattttcctttcttctgagccctccaaactgtaccagactctgcatgttacgcacttccaaagtcgcttccacattttcgggtgtcttttcagcagtgccccactctactggtaccaaattactgtattagtccattttcacactgcggataaagacatacccgagactgggcaatttacaaaagaaagaggtttaatggacttacggttccacttggctggggagacctcacaactatggcaccaggcaaggaggaacgagtcacatcttacgtggatgggcagcagtcaaagagagagcttttggagggaaactccgcttttcaaaaccatcagatctcatgagacttattcacaatcactagaacagcacaggaaagacctgcccccatgattaaattacctcccactgggtccctcccataacacatgggaattcaacatgagatttgggtggagacacagccaaaccgtatcagtgatgcaaaataaaagaagactgtggagtaaattacacatggagaaaaggaagaggaactaggaagtatagatactgtgagaattaactctctgttctacaaaagaagaaatgggcttaaagtggttccccccaaaactaaaatccaaaggcacataagtcataatgcacactgttacaccgagtccttccagctcttaacttacttgttttactgcactacacttgacttgagttttagacttagtaaatctgaggtaaatgcagattgagaatgagaacaaaatgttaaaaagagaagcagtctcattttcttactactaataggcattgcagtttgtgtgggctctagcagggatgtttgtaccactgggatctaagcatctatttctatattataaatagaaaaattaggttgagctatcgcgactccattacaaacttatggaattagattctctggtatggagcttggatatacatattaaaacaaaataaaacaaaaactcctacccaattgattctgctgtgtgctctagttaagactgttatggttaagaaaataaataatcgctgtatggaatgtatatcgtcctattttaaattaataaaaaaaattttgcaggccttcccaccttccaactcctagagacaacaaatccagatttgaaaatcagtcatattaaatagttgtatcgatatttaccctttgtttctacgttattattttcttcaattttcacacgtatttgttcatcagttggttatgatggacttcactttttttcagtcttacgaatgagatttctccctccaaaaatcaataggcacctgctgattttatttattccaacatgaagttgcagaaaatgaatatggccaaaaatggttaaaaaaaaaaaagcctgttcttcaaaagactagatcgtcagttgaagcagaaaattatattcagtgcactggatttatgcattgttttagccttctccaaccaatttagaaatgcattttcttataaaattgagattattacaaatcctgtgctaagcagctgaaataatgtgcctatgccaaggtcatatcttaaaagtttggaggagcacactgcaattgaatataagtttataaatgtattccacatacttttctgatatattttaataatttaatttttacattttacctatattgtcttcattttcactttacctttggtggtgtttcatacatattcattgtttggaagaaattaagcagacagtattctaaagtcaatactgagtctgctaatgaaaatggttaagttaattaactaaatggcaaccttcactgaacttattcaaagctatttcccctcatgatgtgttttcctgaagaaatgatgcataaaaactaaacccctgttattcgctattcttctgtatcagcctctaaattgtcactttacatgttacaacctgttgcatgatgattaattatgacaatttaatggcatgtaaagggtaaaaccctaaaggattactcaaaccatcattccttaagaaaagaaattgtaatgcctaggttatcttctagggtttttatggttttaggtctaacgtttaagtctttaatccatcttgaattgatttttgtataaggtgtaaggaagggatccagtttcagctttctacgtatggctagccaattttcccagcaccgtttattaaatagggaatcctttccccattgcttgtttttctcaggtttgtcaaagatcagatagttgtagatatgcggcgttacttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcgatgcgggctcttttttggttccatatgaactttaaagtagttttttccaattctgtgaagaaaggcattggtagcttgatggggatggcattgaatctgtaaattaccttgggcagtatgaccattttcacgatattgattcttcctacccatgagcatggaatgttcttccatttgtttgtatcctcttttagtttccttgagcagtggtttgtagttctccttgaagaggtccttcacatcccttgtaagttggattcctaggcattttattctcttgaggcattaccattcaggacataggcatgggcaaggacttcatgtctaaaacaccaaaaccaatggcaacaaaagccaaaattgacaaatgggatctaattaaactaaggagcttctgcacagcaaaagaaactaccatcagagtgaacaggcaacctacaaaatgggagaaaattttcgcaacctactcatctgataaagggctaatatccagaatctacaatgaactccaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcggtgtggcgattcctcagggatctagaactagaaataccatttgacccagccatcccattactgggtatatacccaaaggactataaatcatgctgctataaagacacatgcacacgtatgtttattgcggcgctattcacaatagcaaagacttggaaccaacccaaatgtccaacaatgatagactggattaagaaaatgtggcacatatacaccatgcaatactatgcagccataaaaaaggatgagttcatgtcctttgtaggcacatgggtgaaattggaaatcatcgttctcagtaaactgtcgcaagaacaaaaaaccaaacaccgcatgttctcactcataggtgggaattgaacaatgagaacacatggacacaggaaggggaacatcacactctggggactgttgtggggtgggggaaggggggagggatagcattgggagatatacccaatgctagatgacaagttagtgggtgcagcgcgccagcatggcacatgtatacatatgtaactaacctgcacaatgtgcacatgtaccctaaaacttaaagtacaataataaaagaaaaaaaaaagaaaaaagcaaagaaattgtaaaatgttgttctatcagaaactcggctaattatttttaaattttagatcaaaaactcaactagttttaatgtactacttataagtcagataaaatcattttttatttttgttttctttttgtttttacatctgttagaaacgatggggtcttcaaagtaaaagaagagatttgcaatgcctataccaaattagttattttaggatactgaatgaaatggttttctatactcaataaaggtaaaagaataagcagaggtagatctggttttctgaaacttgaagcacattctaatttggcagttttctttaagtcaaagaatataacaggacaaatataaaattaggtatgaacatgattatagaaagaaaggaaatcataacagattatacgtttttaaaaagatgacagataaccacatacatcacaaaaattgaaaaaaataagcagaatgttttcttaataatgaaccatctctgcaatactagaatatacagtgtctgaaataattttttctatctttctggatgcatcctctttcagcacctcttcatgtgagagcatcagaaaataatttactctttcccccagcattgttgattaaaatttgacttctatcattgatagtttagaaaagtttattttacattttcaacttattattggtgatgtcacataaattattacaatttattgtccaatttaggaagaccctgccaagtttctttcacatatgaactgtaaaatttaaaagatcattcaagttatcttgtacaataactaatacatatttttcttttagtcatactaaaccctgatgctaaggatcacccaaactttttcagggaaagaagtagcttgcaaataaatcaaggaccatttatccttactttttggaagaaatggaaaaggataaagtgttagtttaaatacactcaagaacagaatgtaagacaagaaattggaagcagagaagttcatcctcaaatgtaagagtgaaagaatagggttaatgaaacaggaaaggggaaatccaagaaaaattatgccgcgctttagagaatctcctaagcacagagatattggcaatgtgcagatgaaatagctgtcacaggtcagccatgtcagaggtgattccagccactaagtatctactgcagattagatatttggaaagcagaatgagctctgttcatgccattactggggcttgacttcttaatggtttcaagtccccctttgactctaatccttctaaagtcaactttgtataaactcttttcaaaagtgtttatccctgtagaataagttcaaaactccatgtcatggcacacaaaactcttcaaatcatattcagctggtattgttttcttccacattccagtcataactaggatcccaagaattagcaaataaaaatatgaaacatccagaattctaagcataactatgtcccaaatactacaacaaaaaatactgaaaagtatcgattgcttatacaaaatgtaaatggtatcctgtattttataaggcaaccctagtcataagatctctttcttcttcctcacacactgtcaagcttgagccaacagagtaccttttaatgggctgcgcagaatagctttcgatagtttacccattaattaacagaaaattcaaatgagatatcctctgtgaaatcatccttctctcctgcctcctgtctctccattctttctccaggagacagaggccctccagactccatgactttgtagtgtattgtgtctgtctttattagagtattcatcacttggtaattgaattctgtgtttaaatacattttttttcttccagaataagtgttcatagaagggagggatgatttacctagcatactgcctggcatataaaaggccctaaataatttttcttttaaccagtaaccaactaaccaattcaacagttttttaaatgagtgaaaccactttttaaatttttttttaaattcatgcttcacctgtaaaaatatatagatgaattgcaatctggaactctgagtaatttatataaaagtgatgaaaaagaccatggcttcagatttgttgttttaattccagcttcagttcatacaaacattacaaagtcgcagtatctactgtgtaaaaagtttcatcccaatgaagaaattaaaatgtctgtctaatagagatgctctaatggacagcgatgtgtagacttcagaagaatctcctcacacagccttggaggcataagttgggaacagagcaagttctgtgtttgcctttcaaaggaatgttcctttccctttcattgacaaatattataaagatgccccaaaacttctgtgagtttcccccgggacgtaaggtcctctgcattttcctaacttgtttctcaaagcggtggttcccaaggcctgagaatagctgtgtctcagctctctcctggaaaccagagcctaaaatgttgccacatcatcgggaatgtagctgcatacttagccagagccaagagatgagccccactcgcaaagcccatgggctggacaaaattgttagccatttggtgtaggtcattgcactaggtccattacacaggttatctggcaggagtcccggctttggaggaaagacgtttaaatcctgtaaataaatggctggaacaccatggcagttgattgtgttaagccctcatccaaaattgctttgttaggttctattctattgctcattatcttgctgtgaagaaaattaagcttacatctgcttagggtgacagggtatcctgttgtcacaggattttccacattttaggcctatgtcacaagctcccaataaaccctcagagaagatcttttgtgttcacaggcatccaggtgtcaggcagacacagtctttgtcttcttgaagctcagtgacacgttcagggctgtgtatactcctccattccctgccagagacaaaatgtttgtggaacagtcaagctagaagggacctcagaattaatctgatcaaatgtctgcatttttcagttccaaggatactcagggaaggccctcggattctataagtagcggtagaggtggtattagaagtcaggttgcctgacttccaaacctctgttagttactgtcccttcccctgcatgcagcactagtgtaatccctcaactctcacttccctttttcgccacatgcctctctctctttccttcccttgattaccctgcctatccctcctacaagggaaactaccaccaggcatcctcatctgagacccgggaatggaggccaggtcttttccctccctccctccctttcccctttttttgtgtgacagtaacattattcaagtacagctcttccttttttcagtaccttccccctcagaccagaagttaatgaaaaatagggttgcgtgatatgcagcctgggggccaaaaatgtaggacaagcagtgtgcttcagacaaaactgtagggttctggtttcatgcacaaccttggaggacggtggctagaggccctagtatgagagatcaattaaacatggaggccagaaattaaccacatgggattaacatacgtaaggttgcttcttttcaatgagtctaggaaacacactggggacaccttgttcaagacaagctactatttgatgctccttcatacgcttgcttaaaatatttgttcagcatttatttagtgggggcaagaaaaattgatgttatgttaataagaaaacctctttacctcttaccttttattaaaataatcaacttagaagatatactaaaactcacatgacttttgacatctatggatgatctttcatttaatatttttctgctattcctactatagaataaaagctgctattgcattattacagagcgtaatgtgagccacatatgttattttaatcttaatggccacattaaaatagtaaaaataaacaggtgaaatttatttggattatatgttttatttaacccagtgtatctaaaattgtatcattttgacgttgcaatcagtgcaaaaatacagtcatgctatgtgtaatgaggttttggtccatgataaactatatatacactggtgatctaataggattataatacagtaggtttaccatacctttttctatgtttaggtatgtttagatgcacgagtacttgccactatgttagaatttcctgtagtattcagtacagtcacgtgctgcacaaatttgcagcccaggagcattaggctatatcatgtagcctaggtgtgtagtaggctatatgtaccacctaggtttgtgtaggtacacactatgatgtttgcataaggataaaatcacctaatgacacatctctcagaatgtattcctgtcattaagtgatgcatggatgaattaaaatattttggattctttttttttttcagtactatgccttcggaatccaatatgtattttacagcatatgtctattccaaataggcatattctgggctgggtgctcaatagctacatgtggttagtggctaccatattaaccggtgaagttctatgcccatcaaggctacacgtaatttacagggtataatagtattttaaaaattaatttttttctggcttttatgttgacatatcgtttccattttttaaatttttgttttattttctttcactgctttggaaacgcacaacttcttggaatgcaaattaaaagatatcaaataatgatgtagataatttgttattgctaaatgtctaccacttgaaatattcaagtttcaaatttcagctaactgcgattgcaagcttcagctagctggtcccagatggatggcccagctaaatcagacatttgtacatactggctacaaagtgtcccaaaaacagaccaggagggtcgtggatttaaaaaaatttccaccaaaggatgctgtcttgtccattttccaatttgggtaaattaatggatactgcatttaaaagtttttttatttctcgtacattgaagccctgtactgcactcaccaactcacccgttaaagcggctctgaaatacaggcaggaccaagacttagatggactggaggttgggccacaactccttgaacacctagagcagaggtcagcaaactttctataacggtccagatggtaaatgttttaggctttgcaggccaataggtctctgccacgactacttaacaccgctattgtggatcaaaagcagccctaatacgtaactacacataaacgaatgggcatggctgtgtcccgtgacaatttacttggggacacaaatttgaatttcatataatattcatgtctcacccatttattaattattttcagtttcttcaaatgttaaaacaattgttagttctcaaactgtacaaagacatatggtggctgaatgtgacccataagccatagtttgctgccctctgcccaagtctcctgttgaaatggggttatggcaacaatcctcgcagaatataaaactattttggcacctgacttttgccctgatttttttattgtttccagagaaatcaagtatttttctttttcaaatttatatccatattctctttttttctttgctctcttctcttctggccagcaggaagagaccaacccatctttgaattgtattcactttcctcataccgtcacacagctagtaaagctacaacttcacatatgccaatgccaactcttcccgatgttgtgttcaaaacctttctaagcatcaccattcccaggagtagcaattctatatgatattattattttacttgttggtaaggttaaaagttccagggatactgattttcttctttgttagccatgtttcattgagtggataagcaatatgcatttgcttcatagtataaataacaataatgcatcaaattgcaacaatatgaatattacacatagaaaagataaatgtgagttatgtaggtcatgccatttgatagaaaattttttttatatttatatgtttaaacatgacaataaaatgattccattcagatgaaggcaaaggaataggatttcttttcagtgtggtggttttctatttttgttttgttttgttttgttttttagagaatgagttttggagaaaaacaagctttctagacagaaaatattgaaattaaaaccagcaattcatggtcatattattgaaactatcaaattggtatatatatttgaacactactgattattttctaaaatgttacgctttcaaaaaatcatgaagattggcaagttttttagatgcataagcaaatagtgtagtacggcttgtaacactgttcaagataacttttttataatgagtatggtctttctctgccctgtctaatacaatgtgggttttgagcattggaaatgtggtaagtgcaactaaggaactgatatttaaattgtatttaagtttaatacatttaaatttaaagttacattttgataaattgctttgtttttcttttttctttctttctttcttcttctttttttttttgttttgttttttttgaaacaacaatctcactatgttgcctcccaggctggtatccaactcctgggctcaagcagtcctccttcctcggcctcccaaagtgctaggattataggcaggcaccaccatccccagctaaattgtttcttaaatgaaacttctgaatttgaggatacgtgattatgtggtgtagttttccctttctttccccccctgaaatccatattctgaagtacagtgatttatataaaagtaaaaagaaggagactgttttttttttttaaattctattaagaaaccaaattttaacagacacctcagggcctaaataaatatcaagttattgttatttgttatggttcttgttgcttgggtaaaactgtacagatcatgacttagttttccttgaatttttatcaaacaaatgaacaaaatgagcaaacaaaaatattaaaaatgatatttcctacgaatccaagggacatttttctgtatcagccaggctgatgctaaggtccttcaagcaaataagatcaaagatttctgattggagagtgtgggaataaagtagcccttgtttagtgctactttgtagagcctttgtttagagtacggctgggagggagggagagagggagaaaaatacggggttaatttgtaacaacacattctgtggtgtgcgtgtgtgtgtgtgtgtgtgtgtgtgtgtgtgtgtgagagagagagagagagagagagagagacagagagagagattaaattacatttaacttctttaaattttattgtcctcagggtttaaacagtatgtgaccaaaatcacattatttagtgaagagtttgtgggtaggtggatagttagatgggtataaatccctataaaatccattttagaactattgaggtttgagcaaatcaatgtcacctattcacttcatttgtctaatgcctccaggagccattaaagggcttgttacctaactttagggtaggtttagatcaaggtgaacagtcagaaaatattatccatgtactcacgtatattattaagtattctttgaccatggagttagatgcttatactgcaaacaaataaattaatgaataacagtgctgctcatgaacaccaaagtttactgaaaagtcaatatggttttagtgtggtaataagggcagagttctccaaggactgccaacctatttattgtacatcaaattttactgactttgaaatcttgctagaaatgttcatttacctcgtaatgtattatatgtttgaggtcttgagaaaaataacaaaatccatgtgtggtaatgaagtggttatgcaataaaactaacatacactgtgatttgacacaggggacttcactgttatcagatacttaaaactggaaacaatgtaggaaatatagatgtataagcatcgtaagtaaaatccacatgctttaaaaaggaaatccacttacttttaaagtaatattccgagagctatgccactgggggctgaatgtcataaaaatgatttgtaattagtcacttttacattgtatatggatttatagttttaaaatatctggtggcatataaccacaatgtatttttcagtcatatattcatcattattttattaaatttccagagggaaagaaaataaatgacctcctagtgagggatattttaccacgagaccagttgtaaaaataatcgagttttgtgcctgggaagatatctttgctaagtctagttctccagtgacattaatttattgttgttaagaaatgtgtgaggcaaaatgaactctccaaatatttcatactacgtgcattttatccaaaagaagataatggtttacatgaattatttaattggtattactaatttgggggaggtgatttttggttgggggcaacagaatatttgcctaaaatgcattcagagtgcgctgttatttagctattttcaaggtagagggatattggcattggagacttacacgtagccatacaatggccaacttcagtcaactacagaagcaatacagggcagcggctggaacaaaatagctactaggtaaatattgattgaattaattacacggatattaccactagtcctgcaattaattaatacctagccctgtctccagccccagaatccatgacatcaagctaactaacagaaaacatatcaagaattttattccttagtcctcttgactgaccctcaagagggtctaccctcttctactctgtattcctcacatcaaatttcactagtccagccgccaagtaacacctgttctgactgtgctagtgaacttggatattcacacatagcctaaaatgggaaacagagttggaaatgtcatgtataaggacataagcgttttcaaagtgtacaagaacataagcgtttttaggagatttaccttctcttttctgttttattagcgaatgattgattgttttgtatgattgttcatttaacaaatgctatatcatgtaagaaaagttactaacggtatataaagatgtaaaattcaattgtggctgtgtgtatgtgtgagtattctagcttttggggagagacaagagaagaaagaagacataagttggaagagaacagtaaaataaagaaaaaagtaataactgacggtgtctaatgaagtagcccaggtaattaatgctagagtttattagatagaatcattatttccttccagagggattaagcaatcttctctgaggaggtggaacttttattacccaaaacatgaaggattgggaagagttttatatgtgtcgataaggaaaagagatattttattgagggaaaagaagacattttaatggcagagtacacaatgtcagaggaacagaccaaaagaagtgctttgttattaggaagatttgaagaatggaagatagcgtcagattgttaagaaccattttttagataaaggcaggctaaagaagttggaggctattggaaatcagtcacacaattttaagcaagagaatcaatgagtggcagttttgaaaactgaatttgatagtggcaaggaaaatagggctctatcatcccacttactttcaaagttatgaagaaattgtagtaagctccagtcagtacctaaaggaatttattttgtgaaattgtgtaaacaaaaagcaaaccttcttttgcactcatatagtatattttctcaaagtcatatagctaaagggaatgagaggtaaaatagtacagtggttaacaggataggcttcaaagcctaacttcttgggttcaaatcctagcttggttaccatttcacagctatctgaccttgtacaagtcacatgcgtacactgggaacaataatactacctgtattatagagttgttattagatgttgttgatagatatgttgggcacattttaggcactacatacataaacctctttctatagaagtatacatgtgtacctatatttaaaataatgattttcttttttaaaagaagcacatattcattgcagaaaatttttttgaaattttaaaagtaaaatctctggtctaagtgcactaaaatgttttagactttagatatgaactacaaaaacctacctcatcgacacccaaccccactcccagagatatttcattttatttgcttgctatcagtaatgagaagacccaattcaccacacaatttctgttgtatgagactattgtattgcagtgcaagatagtgttttaaatctttgttaaatcaataggtgcaatattacacctccctgtttgaattttcctagtgaagtcaaacaattttaataggcctatacataggtcagttatagttctttcctaaatggtctattcctcattatcctttttaattgagtatttgtctttttttctactgatttgtgagaatgtttttatcttaagagtgtcaaaaagatgaattgtttttgcctttttctttggcttgtttgattttttatgtaaagaaattttatactgctatgaatgtaagtcattactttatggcttttaaattaaaattataagaatagcctcccatattttcattacttttatagttcaatttttttacatgtaacatttcattcatctggtatttagttaggaattgtgtgagataggattttaaaattaagttaaaattcaatcaagtctttattttttaagtacagaagtttccgaattcagcatttacattaaattttttgaaaataatgctaaaatatcatgtaaattattacttattggaattgaaaattccctattattatttttaatctttataacaacttatgttatctatgcttctattataaaataaatgacaagccaaccaaaatagagaagatgcttatcacaattatatcatgataatttaaacatgattttggattaatcataatccaaaaatgcatttgataagcattctaactgttcttctagtccccataaaattaacaaatggcaaacagtaatgttttaattttcaaaatattcatattaatattcattttcaaaatatgtttacttgcatgcatttcatttatattatttcttattgaagttgacttctcaatgtatattgctttaatgatactaagtattaagggtatagattgtactcacacaaataactattgaaaagcataagtttaaatagatccatttatcaaatgatgtctttttttttcttttttttttttttttttttttttttgtgagacggagtctcgctctgtcgcccaggcaggagtgcagtggcgcgatctcggctcactgcaaactccacctcctaagttcacaccattctcctgcctcagcctccagagtagctgggactacaggtgcccaccaccatgcccggctaattttttgtatttttagtagagacggggtttcaccgtgttagccaggatggtctcgatctcctgaccttatgatccgcccgcctcggcctccccaaagtgctgggattacaggcgtgagccaccgcgcccggcccagatgatgtcaattttgaaagatactggaaagtatgttttgggagggaagagggaaggaaagagtagaatatgaagtcagtaaaacctggatatttagtgccatctttgttacttactagtaaccttatgaatattatttatattgttgatccttaatatcctcacttgataattttagaaaatgttatgtacttcataggatcatgggtagaataagaaagtgaatataagtaaaatccatcatgaagtacctgaaatatgttgtaaacctaagttataatagtaattttattgttgctaatatttcagaggaatagccaccaaaccagtactacttattatttatttctatttaacatataaaacatataatattctttctgagtggtaactttgaaaagggacaaaaatattaaaaattacattaaaatcatgtataatttataatactcctttcaaggttactaaagtgtgcatgtatttctaatcattcacaaatatgaaaatctatgtgtaaatttttaaattttctaaaaaattgacaaataaaaattgtattattgtcatggtgtacaatgtgatattgtgaaatatcacatattgtgaaataaacattgcggaatgactaaatcaagctatagaacatattcattaccttacatacttattattttttgtggtaagaacacttaaaatctacttttagtaatttccaagtatacgttattgttactaacagtagtcaccctgagttacaacagataactaggatttattcctcctgtcaaactgaaattgtgtatcttttcatcaatatctcccaaatcaccccacccccaggatctaataaccaccatttttctctgtttctctgagtttgacatttttagatttcacatataagtgaaatcatacagtatttgcctttctttgcctagcttatttcacttgacatcatgtcttccagttcaatccgtgttgttgcaaatgacaggatttctttctttcctaaggctgaatagagttccattgtgtttatataccgcaatttctttaaccgttcatttattgatggacatttaggttgattccatatcttggctattgcaaatagtgccgcagtaaacatgagagggcagatatctcttcaaaatactgatttcagttcttttggatatatgcccagagataagattgctaaatcatatggtagttctatttttaatgttttgtggatcttccatactgttttccacaataattatactaatttacattcccatcaacattgtacaagggttctcttttctccacattctggccaacacttttcttttgtctttttgataatagtcattctaacaggtataagatgatatcttattttggctttgatttgcatttccctgctgattagtgaggttgatcatttttttttttcatatgcttgttagccatttgtatgtttgctttagagaaatatctattcatgtcctttgctgtgtgtcgatactgatatgtaaaatatgcatacaaaatcaaaaccataatttatttttaatatatttttaatatgtcattaatatttttcagtgtaataggatgtttttcataatatttactttaatggacgcaacatatttcattatgtaaaagcagtttattctatttggggagatttcgtttcactttttcgccagagtgacataattgaacattcttgtcataggtctctgtgtttatctctgatattcccctaggaaaattcatagaagtagcattttggagttgaagggaatgagtaatcttaaggcttttaaagtagttttatcaaattttctaaactgaagttttacgacccctagaaaagtacacaaatcataagaatagaaattcagggatttttaaaaaaaacttagtgtatccatgctactaccaccaagttcaagaattagaacattacctcaggagcccctctcatgttccctcccagttatgagcctctcccctgccaccaccctctcccaaagataagcactcttttgacttctaacacctagattagttttgactttgaaattactataaacagaatcatccagtatatgcccttgtatttgacatgtcctgctcaacattatttttgtgatattattctatgctattgcctgtgccatagttagtttagtttttctatgtatggtattctattgtgtgaatatgccacagtttatccattctgctaatcaatggacattgggctgtgtctattatggggctattaggaaaaatgctggtgtgatgttcctgtcctttgctgcatatatgtatatatttatttttaatatacgtggaagtacaatggctaggtcataagatgtgtacatttggctttggaatcaccaaaaaacagtttttcagtgtggtcatttcagttcattttcaccagcagtatataagacttctagttgatccacatattcatcaagagtatgtattttcaacctttatccttttaaccatttaggtgaatgtgaaatggtatttcattgtgttttaatttgcaatcacctaacgattagtgccatttttatatcctcttatgtgaagtcattatgcaaatcttttgcccattaaaaataatagttgtctttttcttactgatgtagaagttatttggatacaagtcctttgtcagatctatgcattgcgaatatctttttccaacctaaactttgctttatttttttctcttaacaatctttcctgataaatggagtttgatttatcagtcttttcctttatggctaatgctttttatgtcttgtttaaaaaataatacattaacctaaaattgttgagatttttttctatattttcttttgaaaactttatttttttgccttttacattgaggtctgcaaacaatctagaatttatgttttgtgtatgatgtggagagtcaaggttcatgtttttcaaatgactaatcagttaacttggtgctatttactgaaaagatcatccttttccaacttaagtgacaccatcgtataaattaggaaacgctatatagatgatttgttctcacttcaatcccacacaggcttaattataataaatattcatgtctggtggcaaacattcttaaacttcgtcgttcttcaaagttgccttggatattcttagccctttgcacttacatataaatcttaggattggcatgtcaatttctactaagaaatggttgctgcaattttgattgagattgcattgaatttatagattatttgaagagagggcagatatctttacagtattggactttctaattcatgaagaaggtagtcctctatttgtttacattttcttcactgtctcagtagtgtttgtagtttccagggtagaagcttaacttttcggtctgaattaccaaattactagcaacatatatagtcatgcatttcttaacaaatgagatatgttctgaaaaatgtgtcattaggtgattttgttgttgtataatcatagggtgtacttacacaaagatagatggtatagcctactgcacatccaggctatatggtacagcatattgctcctaggctacaaacctgtactgcatgtgactttactgaatactgtagtcaattgtcacacaacaatatttgtgtatctagacacagaaaatgtaccgtaaaaatacagtatacaaatgataaaaaatagtacagctgcatacggtatttaccatgaatggagcttgcaggactcaaagttgctctgggtgagtcggtgagtgagtggtagtggtgagcaaatgtgaaatctaagacattattgtacggtaccatacagtttacaaacactgtatagttaggctgcactaaatttatgaggacacatttttatctttttttttttttttgtatttttagtagagatggggtttcaccgtgttagccaggatggtcccgatctcctgaccttgtgatccacccgcctcggcctcccaaagtgctgggattacaggcgtgagccaccgcgcctggcccatttattttcattaatgataagttaaccttagcttatagtaacttttttactttataaactttttttttaagtttttgactctgtaataacacttagcttaaaacatgaacacgttgaacacccgtacaaaaatattttatatccttattgtagcagctttcttatttttaatatttttgctgtttaagcttttctgttaaaaagtaaaacacaaacacgcacatgagcctaggcctacatgggtcaggatcatcaatatcactgtcttccacttccacatgctgtcccccactggaaggtcttcatgggcaatgaaacattcatgaaactatcatctcataggataacaatgccttcttttgaactaattaagaatatagtaaatacataaaccaataacagttgtttattatcattatcaagtattgcatactgtacatacttgtctgtgctgtatttttatataactggcagtgcagtaggtttgcttacaccagcatcaccacaaacgtgagagtaattcattgcactgtgacatcactaggtaataggaatttttcagctccattgtaatctcataggatcacagtcagtctgttgactgaaatgtggtgaatgactgtataatagggctccaaggaagatcataaaattgcttgttttccagaactttgacaaagaccttttacagaaactaatataatagataaataatagtataacattgctgttttcctttgcatttcattgattactaactgtctggattttttcttgtttattggctgtttacatttttgtcaatttctttttatgttctttatccagttttccagtagatttttcctttttttactcattaaaagatttttttatatgctaaaattattaccctgtgtctgatatatgctgcaaatattcccagttgtcatttgttttaattttgattagtggctttaatttataagtgaatacgcatattatattcaatctttttatattctttttttgcttctaaaaggcttccccacgccaatattttattccagttcttcttactatttttatgcttaacactttaatttttctaaaatgttttgtgttatgaaatccatcttaatatgtttatttctaaaacagacacttttgcttatcttaatattaaaacatatacatttgaaattaacattcagagattgaaagaataaggaaagtaatcttgtgtgaaattaggtcaagatgtgcttagatactaaattaacacataagggaattgaatgtgtttgttttctttcaccacagggaacatgttatatgaagagcatggttttataatacataaaaggattattagaaaaatgatgtattttaccggtcaggtgtttgtgtctatactttgatgtgaatgcaaaatagtaaatataaatgtaaattaatttaaaacacatagaatctgatacaaaccttaatctttttccacgttatacattactcacacctgttatatttttccgtgaagtatttggaatactctcgattcctggaaactgttttaaagtgcagaagagcacaaaaaaaatatgtgttaaaagttcttgatttccacccaaccattaagtgatattgccaaagaaaactcttcagagcatttttcactgatggctttagatatgttataccagaataataatgattcattattaaaatatgcaaagtgtaatttctcaacaacattttgtggtaggaagatgagctggtacagtagttttccttattaaataattttttacaaaagtaattgacatggtttggctgtgtccccacccaaatctcaccttgaattatggtaatccccacatgtcaagggtggagccaggtgcagataattgaatcatggaagaggatcccccatactgttctcctgataatcagtaagtttcacaagatctgatagttttataaatgtgagttcccctgagcaagctctcttccctgctgccatgtagaatgtgtttttgcttctcctttgccttctgccatgattgtgaggcccccccccgccatgtagaatggtgagtccattaaacctctttcctttataaatcacccagtctcagatatgtctttgttaacagtgtgagagcagactaatacagtaatgcatttacattgttcaaaatataaaaggtacagtaaaaaatatctcaccctacccatcatctgctctaccctcactgcacattaaccttaattctagaaacaaatctacaaaataaattcctgggaataaaatttccaggtcaaagtttacatgctttttatagatatggccaaactgccttccacaagaggtacacaaatgtatacttcccaccagccacgtagaagagtctgcattttcccacagccttggcagcatagtgtacctgcagacttgaatttttgccagtgcaatagatgaagctctaattttcatttctctcattattaccaaggctaagcttctgttcatgcttttaaaatcctttgtattttcttttctgtgaactgtccttatcttttgtccaattttcttttgggttgttggcctttttcttattactttgcagaaggtctttcatgtgttaggaaaattagtcccttagacatgagtcacaagcatttatttttcataattgttcatttgtttttgattttgcctatggctcttttggtcatgcagaagcttttgattttttatatagtccagtttactgatatttttgtctgttaattaaagttatttaacttgaggatacaatttacatttttttgtggttgactactatagacatatactgcttcttacattgaaaaaataataatcctgaatttggaaattgtttttaacaaacttttggtgaaggtccatcatatttaggaacagagcttgtttgacccagaaatcaaaggtcagtgagaaggagcaatgtaaataaaaagttaaatagcatgaggtaaatgttatgatggtgggaaagacaagatctgagaggataaacctaaagcaacatcataattaagctgaaaatttcgtctcatgataagctatcatttcattattccagatattagtcaaatctgacccattacactgttttctgtcaggaattgttttacctctattacaaggaagggatagtatgggaggatgataaggaaaccagcagtcttagttaaatgttatacagatttctgtgcttatatatgaagcctaaatgaaacgtgaacaatttcatgatcagataaaaaggagttcatcgctcagttttagagattttaggaaaatatgatggctattatctcagtagcttcagagtctagaggcatttagatgttgttagttgaagctgtaaaacgctttttacatctacttgtgagtagaaaatgatccaataaaaataaaatgtttagttacctcctttaaaatgcttgaaaaataagttgaggacatcattagatcatgtattacagacgtaggagtatatttgtaacatcacctacatcacacatacctgtgtgcgcacgtgcgtgcacacacacacacacacacacacacacacacaagagttcagcaccacaggtgtagttatggatgtgaactcacaaaacacaaatcaagcaaagagaacaatatctcaattcatgattcatggacattctgtgctatctgaaacacaatgcttcttttgcccaactctcacccacacagggaaaggctgccaggaatgagaggcaagaagtgtgcaggtcaccttcaacaggagccaccacctgtatttcccatcagtcttttacaccattgtagtcacgtggatccaaggactgtattccaactgacagctcctgcgatgaggtgcagttccacacgacaaagccaggcccaacatttcccattcatcttaaagttagtgtttccaaggaaacagtgctgtgggagcctagggtcagtcccagactgacctgcaacagcccaggctggatgttaatcctttgcttatacagtctcatgaatttttcacaacatatatacatgcatttacaagacgtttcactgtacatattgtttacgtatacaatcttgtttaaaattcatttttctgtacattaattgatttttttctcgacaactttctctttttcatctcctaactcttgcatccaattaaacaatgtactgttcattagtgacttattttaaaagtatctaaaacaattgttccaaagcatgtgacattgtttatgtgacacactggtatattatctagtttatttttaaaatcttctctattattattcataatatattattatggaacagatgtatattataaaattttattcatattgcagtgtaatattttgtattacagtggtattgttaatagtctcgtaaagagctatcattacaagtttaaattctttattctgggatgccagttttaactcttgatattctgaagaaaatagctttactcttgtttattctggctctgtttttttgttttgttttgttttgttttttgttttttttgttttttttttgtagagatgggagtgttgctatgttgtccaggctggcctcgaactcctgggctcaagcaatcctcctgcctcagcctcccaaagtgctgggattacaggcaagagctacagtgctcagcctatcctggctctttatttacatgtaagcttgagcaataatcactgctacttaataactttattgtcattcattatcatgcagagtattgctctaaggtatgttcagggatgacgttactgagtcctaacagtaatcctatgaagcaggtgctatcattgtccccaatctacagaggaggcattgagagttagagaaaacttggctaaaatgttaggcaagaactagaaccagaattgaaatccaagtggcctaactctagacctcacaatgcttaataccatgtcatgctgcttcctaacctatttaatgtttttttcaaccccaacgtcatcacccatgtgtgatagtgggatcataataatatctatgtcgtagcattgttggatggattaaggaagtctacaaatgtgaaacttccaaggatgatggttggcatatactgatctcttaataaaaataacctataatcattctgttacagtctactctaatccaaatgttctttttacttctcatctcaaccacctgcttctgtttactaggactcacaaactatagctcacaaaaacgcataacttaccaattttccttgtacatgaagggacttccttttacaatcttccatgacataaaagaaagctagaagcaagtatagtagaagaaatgattgctatacaaacaaaattatagttggtttggttttaattttaggatgcgcattgaataaaaatcactcatttgggatttagaagacctgtgttatatatctggtgctaatgctgaataacttggcttattcatttttataactgcaaaggaagcgcgtatggcatataatacacaacacaccagtatatttagtaactgagtgaataaatgaaagatgtatttctttactttatcagttgcagttggctatgcctttgtgtaaggtgtgtgttttgaaattccaaaaaggtattagtttctttaaagcaaagaatttttgtagcaggttaatgaataattttgaatacattggttaaatcccaacatgtaatatatgtaaataatcaatattatgctgctaaaataacacaaatcagtaagattctgtaatatttcatgataaataacttttgaaaatatatttttaaacattttggcttatgccttgagaattatttacctttttaaaatgtattttcctttcaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttaaggtagggaactttttgctttaaatatttttgtcttttttaagaaaaatggcaatatcactgaattttctcatttggtatcattattaaagacaaaatattacttgttaaagtgtggtaaggaagactttattcaggataaccacaataggcacagggaccactgcaatggagtattacaggaggttggatagagagagattgggctcaactctaaatacagcacagtggaagtaggaatttatagccaaggagcagtgtaggagtcagtagatggaaaattattaagaggaaacatcaggggtaagtgggattctggctaaaccaacctcacaggattcttgctgaagataggccagggttatcttatcagacaacccttggggaatggtggagaatactgagggtgatcaggtaccaaggataaagggttcttgtaaaactgacaggcttctttgctgaacctggattttacaggggagtgcaaagatgagcccaggcgaaggttcagaagcctgactaaagtttagtcaagcagggaatctttgtcatcatcatcattgttgtcataatgataataattattattattttactagaatatgttgctttttcctcagcatttactagaaataaggtcttcattaaacttatgttactagaatgcctgcatcatatttgttactgtgattcattttctatccctgttttaattgtgcttaatacatattcatagattccttatccaaaattgaagttgtttatgagattaggttcctaaaatataatgtctgggctcttttgtagacattgtaaagccctctcagactgactacactttacctttctatcttctcattctgccagcaatctccccgtatagtctggccacatcaaattacctggtacctttccatccatgtaatttcatgtcatacctgtgatcttggttttctctcttctttaaatgacttctttcagtttattttgatataatgaattttcttccattctttaagaatgaattcaaagtcattgcgtcttccaagttttcttccgtaccccaagtagagttagaatccctgttaggatttcttataaacctttttattcatctcccattgttcatatgttgatttacacttaaattttatacacctgagtatttcattacacatctgcactgttctttgagtgcagagggcattctcttatttatctctgcttctccactcatatcatacacactcagcctaggatccagtaaatgatgcttacttgtgagtgtttttaagtcaatgaataaagacagtaccaagacacccagaatacgaatgagatactgcaggtaagcgtaaggcttcagacaatcctgccaattgaacaccactatctccttcttctagtgtccttgtaaatgctgattgatcttcttttctccctttcaaggaatctattccaaagattctttcaatatgctgccccgttttgcgtctccttatttgccaaaatctttaagtagccaatcaaataaaccgaatcgttgaaattacaatctattaatgaatgtattgttgggcaacttcagagtaaaaaggataagtaacatttttgagtagttttttcttttatttaattgactttaattgttaaatttatttactgtccagtattgtaaaaacctaacattttaatctccatttagctgttgttttgctggaactgagagcaaagggaaaaggaagtttgagaatattctagtgaagaggaagtaaaagtttcgggaagatgggcatgagtaacaaggagatagagggaagtttgctacaactaaaatgagttagattagcaaaatgttctcgactatgtttaccttacttcctcctgacacttatgtctaccattctgatagctactcctcaagagcagatggcactgtggaagtcacaagtagacatcatttcactagcacaaaactcagcctgctcagccagtggcacagtcttgggttcagtctgatgattaaatttacgagacataataggctttacccagtaacaaatttagttagctttaagaaattatacaggatgggtaacaacagcctgcacattaaaggcacagtggaagtcttgataccaagacgtggcttctgatgtcccatcaccctgaattttagtcatacatgatcacaaggggcaagactgggtgcgtacaaaacacatcatcgtctcagggaagccatcagttctaggatcctgaccatttctccacttagctagtacatattgtactcagaggtgtttgactagctcctattcaccagtacaattgcatctcatgaatactgatttttcactgctcaataaacaaccccaacaagaaagtacagttacttggcccaatacacaataaccttagccaaattctcaattatcttatatccagtatattcttaaaaagtaactggcgtaatattgcgaagaggaaaggtcataaagtctttcctcccaaccagaaatagctttttgtagctcacggtaaaagcacattctactcttttaaatgcaatctttggttaaaatgtgcctctttattataatagtttaaaaaatactcaatgctagctatctctcttcctggaacacatttaagaaaagatttttttttgaatcccttggtacaaatagatcctgtttactcaatcaaaatgacttttgtcccagtctgtgccccccggaatggttttcaaataatgaaaacctgcattgtgtcttcgattgtctatggcccatagggctctgccaaatgggtccctgcagtttgaagtgaaagccatactcggctgtgttaatcacttttctttatcaaagctacaagtcaccactcactgctgtgtgtagtttctgagagtcatgatatttgcctcctgcagcttgttttaaatcactgaggggagagggagctgcttttttcctggcagaaaactccttggcttcagtcctctgagcacattccgagtttcttatctctggagtgcagacttcaaaaatactcttttagcctttttcttctgcttgtggctgtgttcaaggtggggggaggggaaacataaaatcatagatttgatgacttgagagtttctcccaaaaattctcaaacccccagcttataattaggaaatggtgacctgtgtgaataataatttaccttgttttttatccctctttgtctagcttccattccttgtcactaataaatgatttattaagattgcacagtttttctgatttaagatataggatattagtccttacagcctgctgtattcctctgcttaaaggaattaaactatttttccattaaagaaagatgggacactagactttgctttacttagtttcaaactactgaacaccaaaaataaaatttttaaggagttttgagcacatgcccttttttttaacacaaggtaaaaaaaaaaaaacacctttactaaaatcttaagaaagagttaatgcaaaggaagtagatatacgaacagccacgcccctagctccaaatcctaaatgtaaagaaacttgccttgtctggccatggtggccatagctgcctcggaaacaaagggtctgaggccttgccattcgggtagtttgttttctctagtcaaactctgagcacacctgttagaaaaatatgtaataccctctctctgtgagcctcagttttgtctgcttggtacttcactcttattgatgaaatgcagctagctgtgtagtgaaacccagataaaaaaaagctttaagggctgtgttctaatacattgtttatgctggagtgaaaattgactgcacattgcttggtttgtgcaatttactcccgaaatattcctattcaggaaatcctgcaaatagcaatattcatcttgaaaatcacctcacagaacccttagcaagctgagaaacataatcaatgagatcgtgatgtagagggtgaaaattaggcgtaatcacagccctttcccatcagtcagcccactagaaggcatgcctttgaattttgattttcaaatatactctcaatttagacataaaatatgttgatttcagatttcagaaatgataattgaatgctaagatcccgggaccagtttagaatttctataaagggtcttatgtttttaacctttaatgaatgctttcaataatgagctagaggtatactatttatctgacataagactgactactgctttccaaactttttattaaaatatgaggtgtggcgggacacataattttatgttaaggcttagtgactgaaatactttcatcttaatcacagggagggggttttttcctcccctcaagaatcactttccttctgtggtttataaataaacatgacatgtggctctgctggctcttccttgcagtataaggagcataattgcccataatgtcaaatccacactaaaaactaccaaaggactcaattgtagtgactgaccattaaagtcactgaacactgtgtgtgttcacactgctgtgagtgttgtcaaagaaaaatagcactagacaacagacaagaaagactgtgttcaaaacttttgcaatagaggagacagattgaactcaattctgctgaaataaaaggcaggagagcctctaagtgctgagatgagttagtgagaaagtactagatatcaggagggaggttagtcaatgtgcttatttaggccatctgtgtttgctgattggcacttatcaaagttagattcctatcctcccaacagaagactagcagattggggcactatcttttttgatgattctatatcaaagtgctagctcccaagtccttgagaaagtttattcctgaggtataaaagtggcaagaggctaggagaatatttttgtctcaaaaaagtagagaaataatatataaagttttctagagtaaatgctctaagaaaaggaaggtcaggtctaaagtcaggaagaaatctgtctcaaatgtagtcaaactcagggtatttttaaagctttctttgtcaaccctccattttgttcaagggaaaccagttttcccattgaaaaacttaggaacgccagttcatctagttcatttcagcaggtttctgttgttgaaggactagctgaacgaactctgacacttggtagtaatcagacatttcatgaaggagatttccatgaaagttagaaggaagacgaagattaatggttgaagcagactgcaaactcagtttttgagtccagagggcagcaagtcaaaaagattcctagaagctgggctgtaggcattctcagatggtagagtgaggatggcagtagcaatccgatggatttcttggagcatggcacggaagaggttggagtttactgaactttttgcatggcctacaaagcagcagctccaggcatgaaagttgtctatacataatttgctgtggtggtgagtcctttgtagtttatagcaagtcatccagcttctgcttgcagggcttctttagatattgtggggaaatggcagctataagacaacctagagaagagagtccttatctcagtaataatatgggcagtcacgttttagttctcagtgtcaccaagtcaggatggtgggagaaaaatttgaaatgttaatttggagaatcgcagccagattgtaaaggaaataaactgaaaattggtaaggacggacaaaatgtgtaagacagcaggatccagatcaatttacaggtaggtaaaaaaaaaaaaaaaaaaatcatgtcgtttacaaagaaatgcaaaatagatcaaagacaatgaacaggactagaatctgataaccccaagggttactgaaactctatctctaccatcacccttttgatcagtgttaatcaaagtaagactttccttgtttataaaataagactggcctatttatttatataggggtagcaaaaatggtaatttaccaaataggctattttaagtgtgattagctggaagttttcatgaagaatcacaagctgaataagtttcagagatatactgtacagcatagtgcctatagttaacgatactgtactgtacaattagaaatttgctgagggcagagtttaagtgttcttaccacaaaatactactactctcttttaggagcagtggtacataaggtgagaggaaacttttggaggtaacgcataggtttatggcatagattgtggtattggttttgtatatatactttatctccaaactcatcaagttctatgcattaaatatgtacagctttctgtttgtcaatcatacctcaataaagtagtttaaaaaatatgaaacctcagatttgattttttaaaagtctccaaagtttaggaaggcaagtcaagaacttgacatcagattttacctgaagtaaaatacctatagattcagctgaagtgttctgttttccaggttcctaaaatacccttggtttcctgggtctcctaagaatagaccttccttactcagttgtaagattgggaattctgtaagccaggtaccgggacagttttcccaaaaggggcttatattagctccatatagtcaagagtagctccttaaaactggtcacatctgactctatgcacttaattctcaaatatgacattccagtcaaagccttggttatatatttttttcaattatgtcttgttacctaaatatatttattgagcctatgcaaataattatattgccatgaaaataagaatactcggtaagaatttctgaattttacagggatcaggcagggataaaaagattaatgtttcattctgtttacaaaagcatactctaaattctcatgagttatagataacttaagagaaaaaggaaaggcgtttcttgtatttagcaaacagaacattaaaacatgaggaatattttaaacaaaagccataatcaaatcttttatcagttcattcaggcccatgtagttaattcttgtcttgcttgatcttgagttagtagtttcatgaactcatcagcttcttcacagagtttcataaatcctgactttgtccaatggtataatctcgaagttatttaagcaatggcatcagaagtctgtgtcccagagtacctgtcgtagtacttcctatgggtctcaaagatggtcctgttttactgaagatgatgcattctgacctctaactgattgtaagagcactcagggaagcatcagcataaaccaaaaactatctgtgaacgacaaaagacttaaaatggccataattaaagatctgattcattcgacaagaaattttttttttccctggtgccatgccacattttaaaataacaactggagttaggactgatgacataatattattatcggataaagtagcaccaggatgtgtcatggacacctagagcacctagagcactaacaaagttctaaggatttattataatttttcaagtatttatactaataatagttgacccatacaactataacctagtcaaggttcagcatctcttcttgtcaaagctttttatgcaactcaacataccaaatgaacctagttatttttaacatccttcattttacaagggtgcaggaacaaatcctttgaaatttttcaaaccaatctgagattaaaaaaaattttatttaagaattgacctgggaaaagcaaaatatcaaaggttgtaaaatgacaaaaggtttgaatacttggctgaataggatcattgctcactatgaaagaatgcatggctacctatgtaaccaagatgacaataaaagatttcaaaaataaatgtagaaggccacatgacggtaaaagtttttagttctttccaaagagaaaacactactttctaaaaaaattcaaggacatacaaaatcaacacaggtacttattctgataagaaacaatatttgtttcctatacagattacccaaaatataaaaaaaaaaacaaattttgcaatctcttattaagagaagaccaatagaaaagatgaaaatgttaattagtttgaccgaaataattgttttgcaattttgtgtgtgcgtatatatatatatatatatcaaaatatgttgcatacttaagtatattcaattttatttcaaaagagcagaccaataatccaagaatattttatcattttttaacaaaaagaaactacaactcatttttgatcaatacactgttgatactaagggtcatttgtaagagtttacatacacataaatccattccgttttagccagcattggctattaacataagactctccttccacaaatcttctgccatttccaatgttcattcagattttgtcctataccttcctcttcctcattttcacagtcattttaatttaggacaaagttattctctttttccttaacaaaaacacatccaacataccttgtatattttgcatacaaagttgtttccctttacccctaatgtttctggaagttttatttacatatattgattatatttttaaccattagtaagtcttattttatagagaaaactaggaattagctaagtgtgaactgtttgtcatataccagtatttcatagccaactagcaaagcttatgaatacaagttaaattcacctactcaatatgagggctaaaagtttacatcaatatttgtggaggagccttttaagattttcttttgccctgatatgtaatttatggaggctgtgttctaaaatttgagtaaatgactgaggagatacctagtggccatctgggtatctccaaatcccatctgaacgtacacggtatccagtctgtttccaattagctttttcaacctcaggtggttgcttctggggtttgagttttccagagcccccagtagtggcagggagcataacgctttagagaccatagagagttgagagactggagtaggaagagaaaggtctgtcatggatggacaaagagatggagcaggtacgggtttgaagaggaatatgctgaaggatttaagggagctaaagggaagatcaaaagtagtcaaaggaagaaggaggaatggtggtgatgggaagggagaggtcttagatgagccagcttagggagtgcttatgttttcggaagaggccattgaagttcatctttagtaaaaatcaaactaacaagaagagaagcctagtttgtgccatagaggtgaagcatctaatcagcagtagtcttcagaggaggagaaacagaatagtgagaatgtctcctggaggaaagaggcaccgaaggaacagcaacaacaaaaaaaggaaacatgaatgaggtctctacaaacgtgatctgtacagaaaatgatttctctaaatactgaaaatctgaagttgaaccaaatgagatttcaataagaattttccatgttctaaaccaatgatgcttttcaaacaaagaagcctgggactctagactcaagaatatactcagattactgagaatcaaaatctgatgttaccatgcttccacgctttcgtgggtaaggagtcagacttaccaatggattcccaattaatcagtcaggagtgtactcaacattcacaaaattagctttgcagaggttaatgtcattaaattcactttagaatggataattcaaattcaaatagtaactcccttagatagatgtgtactagctcaagttcacctgttatctgatttcatttttaaaaaaaattttttaaaagtggtgttcgggaggtaaggaacaaggaagagacctttagaaaaaagtttcagtgttttatattggatatgaaaatatcagtggaatgtgtcctgaaaaacactggatgacagttactggacaaaaagacaaattattcccttttaccatgcaactgaacacagatttattgaatgtttttctcctgagtttaggttgcctctgggcaagagtataattctggcttgataacaccttgaagcgtgtttgtttaagtttgtggatagtttcatctattagtggaattaggcatctgcttctctttatgaacactgggtaccataatcttcctcttactttttgttttttctactcaactccaaaaaccattgctgagttgaagtagaataataaggggaaagaaacaaaagactaagtttgaatcccagtgctgacacttactggctttacgatattgtttaactcacttaccctttttaacctgaccttcttcttcactaaaaatgaaaaattgagtgaatttccctgggactctgttagataaggcaaaactaagatgggaacacatttcctaaggcgtagaaaaagacagtgaatgggacctttcttgttgtatcaggagttatggtaagaggtactaacaataaaaattaggctttcagccaggcatggtagctcacgtctgtaaccctaggactttgggaggccaaagcaggtggattgcctgagcttgggagtttgagatcagcctgggcaatatagcaaaaccccatctctactaaaaatagaaaaaattagccaggcatggtggcacgcacctgtagtcccagctacctgggaggctgaggcatgagaattgcttgaacccaggaggcggaggttgcagtgagccaagatcacaccactgcactccggcatggggaatagagcaagacttctttaaaaaaaaaaaaaaaaaaaaaaaaggccttcaaaatacccctacagcagcaagttggtaccagaaaaacactccaaaaaagggagtagatggtcatgagattttcatcgttcaccaacctaacttgcccatataaggaaaaggataaacttgagaacagtttcttgaatgagaattcctggaacagatcattcaaataggactaacaatttgttggacatgagaaaacttctatgacttttactgttccctttcttatgagggaggggagaagagtgcttttcctctttgccaagccaaggaagagggcttcaaagaacctctattatagtggcattcagaccattgtatttataaaaaataaaaatattttagaaaattgaatatctgcttgcacattttaaagatgacatctattttctgcccttgggatacagtaaatattgacattttaaaagggtttatagtacagtttagaatgtatcccgtggaatccaaataccattgcaatataatgtctaccatcatatacttaaaaatacatgaaaaagctcatatttaataaatagaagttttatattattcctttttatttaaatcatatttttcaacttccccaatgaattgtattctaatgtgataaatatgtgatacatatttatgctataaagttttattagccactctatcataattctttataaaattatatttatgtggacttaaattcaatttttaaaaacaatttcctgtgactacaaggctctaagtatttttaaaattctctagattgagtagtatttaaagtattaataataaatacacttagtaataaccaaataacctaaatatatgtaccttttgataaataattattaaacatactcagtggatagttattgaaaatgaatctattatgagatggatgggtatttgatggtaccttgagtaaagaaggatttcagtcgctaatattttgaattgtacttttatttggcataaatgtatcttgactacaatgcaccagtgggataggtcagagaggtgtgcttttattttgtaaagcggaagaaagtctgtcattaaccaaaaagtgggcaagaaaattggaatgaagtgcctaccacaggaacaaatccagtcaaatcttttttttgtttgtttgtttgagacggagtcttgctcagtcgcccaggctggagtgcagtggcgtgatctcagctcactgcaagctccgcctcctgggttcacgccattctcctgcgtcatcctcccgagcagctgggactacaggcgcccgccaccacgcccggctaattttgtgtatttttagtagaggcggggtttcaccatgttagccaggatggtctcgatctcctgacctcatgatctgcccgcctcggcctcccagagtgctgggattacaggcgtgagccacctcacccggccgcaacatgctgttttaatgagcgcctgggtgcgggcagcctcaggcctaaaatggcgttagccccaagtgaggactggacaaaggttttatagtctcctgtaaacaggaagtctcctggcctgacgtaactgctgcattgtacccggatggcctctttctcgatcttcagaggtacttgtcttctggccggctctcttcctgcttctgctatttcgccggtgcatgctgctcaggcaagtagccttgtgccttaggaatgggcctgagaaaggaggagttactcatctccttaagctttcaggcccgggagagaatcttacaacccactgatgagttatgaaatccatttaatgggtaaaataaaatagaataagatagcatagggtaccaaagaatataacgcaggttattacattgtgttacgtgtggtatgcttaagtgttgttttctggaactgttgttatcatttgtattgtacttcatttttgtttcgaattttaagataatctgcacagttttatagaaaatgagttaattagtactgtatcagtgatgtcatactgggttaattattacaaagttgggggtaaatttatccctgtataacagactttaaagataatataaataggccaggcgcaatggctcacacctgtactcccagcactttgggaggctgaggcaggtggatcacgaggtcaggagttccagaccagcctggccaaggtgatgaaaccccgtctccactaaaaatacaaaaattagctgggcatggtggtgagtgcctctaatcccagctactcgggaggctgaggcaggagaatcccttgaacctggaggcggaggttgcagtgagccgagattgcaccactgcactctagcctgggtgacagagcaagactccatctttaataataataataataattttgtttatttattgaatagatactttcttccagtacaaaattcaaaagcattgaaatcctctgttgcattgttgtctttcagccacacagtttctctccccatgtgctgccaaggttttcagtttcctgggtagccttccaagaataggatgtaggtgtgtgtgtgtgtgtgtgtgtgtgtgtgtatattattttctactcttgtcctcttaaaataaagccagctgttagaatactataaatactgtttctgcatccttcaaaagatggttcttttgaagcccttttccttggcttggcgagggcagaaggaaaagcactcttcttcctccttcataagaaaggaaagactaaaatgcctgtgtgtgtgtgtgtgtgtgtgtgtgtgtgtgtgtatagcactcttctccctcccttataagaaagggaagagtaaaatgctgtgtgtgtgtgtgtatatatatacacacacacacacacacacacacacacaggtgattattttctgtattagtagttaaagaactgtctctttttttttttttttacagttgcatactattctgttctaaggatataccataattcacttaagcagcactccaattagtgagcctttagtttgtttcgacttttggctaagataagaaaatgtataactttgtgcacatcattttacacgttgcaaatatatctatgtgataaattcctagccgtcgaatggctgcgtcaaactggcatttgtcttgttagtacattttgccaaattgctcttcatagaacatctcgtcagtattaggaaaggtttcttttccccatacccgtgcccactcagtgtgttatcaacctttttgatcttctaaacaagaaaaatggtgatatctgtcattttaatttgaattctttattcattttgtgagtgaatttgaattttttcatgtgttgcagaatcatttttatttccttttctatgcactgtttgctacttttttgttttttgccaatgttctcttttgggttattggtctctttcttactaaggcaaatatagtttacaacttgaagtaaaaacatggttttctatgataaaggttttaatgaatgttttctacaacagacagattctagtcttaaggttataacctgaaaacatcaaaactaacctttgaattgcataggaatggtctttgctcttcttagccatcaatcctggacagaagttcaacatgatgacaaattgtagcacaagtagagatttaaaaaatttttaactaatatgtaaatatttgctttcattttcttatttatctaacaatacattgatggctagaacagggtttgtctttgcaaagagcctgtgtcaactgactcccattctttcaaaatacattacctaaagaaggtttgtggcttctctttgcattgcattttctagccaaatctgaaataactatctggaagcttaacattttattcccacacttatttttccttgtgaaaatcaaaactgcactttcccagtcttcatgagtaaccacaatggtttgccatttgacttgccagttgtattagcatactgagatgtaatttatctgcatcaagagagttaattctgagcagctgggggctttctaatctctttacccatcttggacaccagttccctctcactgctatttgttttattctttgcagttagaataccattcctcttgacatacaagaaacaaacccaatagaaattaaaaggttccaatttctattttccattcaccaatattataccattttctcctaaagcagttctactctctcctagatcattctcttgcttttgaaataaaccttaaaaagtcattttgtcaccctaaatatgtttatactttcttgaaataatgcttttactgcatattagaattttagtttttacttagcagtccttcactactcctttagaaggaaatttagataatactttgaaggaagttatgagagaacgtcagaagccatgctatcagttttttttttttatgtactctaaagaaaactctgctctgcccatgggtgtcatctctttctgattctgtgtggaggagaaaaatgggaacacttccaatcattttcaaacaatttctgcttaagtggatgaatggaccacctggtttactaactataatgcccaggggatggctttgattggcagacagaacgcggtgcagaaacaatggaagttaaatgaggaaggttttaaacttgcaagttacctcccttggtggcattgactgttggtagaaaataacacgttgggatttcagatacattcagacatgctctgcacttgcaatttgcaatacttaaaacaacacaattcttctaatcataactttttaaaaaatttggccacctttctccattgtctcataaagctatattcatgaagctgtttattcacaaagtcgtatcatttaaagataagtgttatatccataagtatgtaaatgaattaaaatctgggaggctaacacttatccattccttattctactatatcctatctagagccatgcttcttaaaatttaatgtgaaactgttatttctggtctgtggaaccacagtttgaaaagcactgtcatagattcttaagtagatacattttcatgcatacaataaatatgcaggagaagttaaatgggtatgtccgggagtcaaatattgattctcagaatgaaaacttcttcatttatttctcagtgatcttcataaccctttcccatactgggcagtgagaaaaaattatcatctcactctgaaatagtgatttcaccagtctctttttatgggttgggacctcatggataatgaccagtcttttagatttccttgctctcctcctgctcctctccaaaatggcagctgggttgacagatgaggaagcattatacatgacctgagatctctatgcaggtacttgcagtctcctctgaccctctgctctctggaacagtgcctcttgtctgcctgataagtctctaccctgctgaccttgtggctctgagcttgtattttcatcaggaaatacggttctctgctgactatatcagttactaaagggattcttaaatctctgagttactgctgaagaacacttagaattctaaatttgtaattatgatacctctaaaaacaagcgtgattatccattatgtataaggatgccttccaaaaagttggagcaacttgaagccacttgttacattgtcatttagtggaggagggagtgaacttggtgtttacaggtagaactctctatcaggtgctgtgaggaaaaacaaaagcaagataaactgtggccataatctttgttactttatttcccaatggggagaaaaagacaaatatatatatttgtcaaaactgaacagatgttatttgaacattatactgtatatgccattataactataatgtatataatacatatatataaattattgaacactaaaaagaacactttaagaattatctattttattttttttattatactttaagttttagcattaggagaagtatctattttaaataaagctatttcactcttcagtttccatctcaagaactcataccaatttaaacttccactcatatttgagagttgagaaaaattaccaaatgataataatatattatctaaaaaataatttaaagatgcatgtctctaacaaaactatgtaacattctgaagggttttaagtaatacttcatatatcctaattcagaataaacttagatgttatcagtatgaaaatatatcataaagtaacatgattctctccaatgaagatgtaatcatccaaactttatgcgttgaatttacggcttagaaatgccatagcaatatgtcctcttgaatatacaattctatatactgagatttcacttagtatattaagttctgtatcactgaagagtatattatgattctaattaacaaatacaattctattttatataagtacccctatcatctactaggcaaagttagctgatgttactatgcatttttttgtcagctgtactcaacttataataactttgtattccaaatacttcaaaattgccatatgcttactgttttcctattcacatcattttcccccctattcttcctgaccctcctttgagcaatagtgtcagtgggattagactcatgcattcacatactgaatgaatgaatcagtatgtgattcatgatatagaaaatttaaattccttatatatttcatatatcatatatatgatatatgtatctgtgcatataggggatattaaacacttctctgtatatatctgacatatattttgaaaaggaaacaccgtagggccaagttaactgcttcaattattacttagtgtaaatgcattcagtttgttctgtaatttcaaaatgatacatataaaaaagtagagtttgcatgtttaatacatctgaagctacagtttccaaattctgaacactttggtgacccccttgacacaatgaatatttggcagttaccgaacataacagggcacaaataatatagttaatgaaaacatccataattatttaaattaggctattttaagaaaagttttaatttgaacattaaacagcttaaaatcatttataataattgattatgtaacatgctggtcattaaaatgagattggtattctctttttttttttttttttttttttttttttccgaggtggagtcttgctccatcacccaggctggagtgcagtgctgcgatctcagctcactgcagcctccgcctcctgggttcaagggattctcctgcctcagactgccaagtagctaggattactggtgcccaccaccacacccggctaatttttgtatttttagtagagacagggtttcaccatgttgaccaggctggtctcaaactcctgacctcaagtgatccgtcagcctcagcatccgaaagtgctgggattacaggcgtgagccaccatgcctggccaagattggtattcttgacattaataattttggtaagcattaagaaggcaaaacatggaagcactcacaataatgtataggatccaagtaaaattctccttactgaaacatgaaactacaaagccatgtgcgcatacttttaatttttaagatttgtttgaaggaacttttgtgaatgacaagtagagaaagtgtggatagatagcatctctgtctttaaaattatttgatgaaataggtgataagaaacacaaaaattaataattcatgtgacctttattacaatacgtcttctggtattagcatagtaataagtattagtgatttacataattggagagataacacaaatacaaattatgcacacacacatacatacatacacgttcctgtgcttcactcaaaactgaacagatgttatttggacattgtactgtgtatgccattgtaactaaagtccaatttgttagagatagtattgttattttattatctttagtatcttcaatgagtccattatgaatagtagcattaactttgcttatgactagcttaaatagaactttggactccataaaaatacgaacaaagatttttaatggctttagaatacagaagtaatctggtaaaagtattcttgattttaatagaaaccaaacaatcaatgtgcccgttagattaacagtgaataatcagattgttccagctcttcactaatgaacaatgctgaaacaacattctctgtaggtctcctcagatagacatatgagaacacctagaagtggaattgttacctcattagagtattcacatttttaattttatcatatattgcaaattgcttttccaccagcagcaagaagtggcaggaatttattattttaatttgcatatccctggttgaacaagttttcaagtttgttggacagatttttccttctgtgagttgactcttcatatatttaccccaattttccgttggattgtttactttctcttaccgattaatatgagttgtctgtatattctagattctagtagagttctggattatatgcacctaatatataagtctacaattccttatccaaaatcttatcgttgacttttcaggagactagtgaaaatggctacttagtggaacatatggaaatcatgagttataagtgtataaaggctaagtgcaacagtctaaagacctggtatcacagatgaagactgacatattgagtaaaccaggaattggctttattacataatgtgtcctttttcttgatttcagaaacccatatatttgctgtttcctgtacatgtttaggaagagtattcagaagagagaatgcagatatattgttgctgtttttttttaaaaaaatacgagtttaattcaattacccatttgattgcttgagtttattagttatggtagcacttagaaagagttgttttagataatgactatgattttggtacagaacctaatagtaaaaacaaaacatctttaattttatttaaagtgcatgtcagtcatgaagtcagaattgaattgctcttttctttgcttttaatgaaaattagcctaatggctgttttatctttaaaaagcaacttctagtgtttaataataacagatttaagtaaatattctgttaagacttaaagaaccatgtccaattactatatggataataacttagagatgctctatattggtttaaaataatgcaaatatcactggccactattcagagatatgtcaaaatcacttttgtttaatatgtgcctttctagtccttagatctactgtattccctaatccttttggggtatataatccagagatattaggacccattcagccagaaactgaaacatgccatgatggttagaattcatcagaaccacactcaaatgaatgttaagagacatagcgtgataaaagtgcatctgaaagagtatatgaacagatgacattacatacaatgttgtatataagagaaaggaaggaaagacattcatatcatgtcatattaattcatgtacactgaaaatacagaccgtgaacagacattctttcatttgttccttcatgtattcaataatagaatgcttctctaccacagatgattccaggggaatttggcaattgctggagatatttgtggttgtcacacatgggggaggagaaagtgctactggcatcttgtgcatagtgaccaggcatgctgcaaaacaccctgcagtacacagggtagctcccgacaagaaataattatccagtcccaaatggcaatagggctgaagctgagaaaccctgattgaaactcacattacatcctaatcgaaactactttgttccgttctgagccgtaggattcatcaaataaaacctactttttattggtacaatatttaaatccagagaccctgtagcatagtaattatgtatgcaggatttgcctcagaaagactagggttcaaatctcagattcaccatatgttaggttgtgccctaggcaagtttctgacctttcgtgactctagttttttaatctgaaaaaatggtaatagtattgctgagaggctctgcaatggagattgagattaattaagatgatttatgttaagtgcatagcagagtgtttgcacttagtcagtttccaacaaatggtagcagtattacctttacatgtactaaatcatttcatcctgacctactatgaaaagcctgatcactttccatattttactgtttttaagataccattgattagagtatgcattgttattttatttttcaccaagaaaaatgtgctgccgttttagactatgacacgctatcatttataaaacgtgtcccaatttcagagcagctaacctgttgaaataaaatgtgagtcttataattgattattgtaaaacacaacagtaagtcttctttgattaggtgcaactgaacaatactatgaccacattcagtagcaaaggcacttagaaggatataggaatatagcttagcaggaaggtagcatcgggtatctctctttagtaggatgagtatgcgtagcaatctctgaagcacccagggagccatccaagagctattcactttgcagcacctgtccactctctcatgacatctcaggtgcacaggaaggaaacaaatcgagatgctgggtcaaccctggcctagaagccttatgcatcccagaggccaatgccttgtaacatagtttccaaggtcctcaaaaaggacatgcttagttacaagaattgttgtacttggggacgccccacaattatggttttccattaggtatttatagttcatatgtagaacacctaaccaaggtgtaatttaccagtccccatcatttttttttttaatctgaagcaatgttgcctgctcacacatttgacattccaactttatcagttttctagggagaagggagctagaaagttgatcaaagtacaaattctcatacagatggacaaagggtgtttttaaccctttactcacagtaatatctgttagtttcatttattttatatttaaagatactgaaacctgaaacttagagcagttaaatgacttgccccaactcatgggctaataagcctagaacccagatgttcttatttctagactgattatttccaacaacactgtaatatcctaaagcaagagtcagcaaactatggtccaagggccacatttagtcctccacctattttcagaaataaagagttattggaacacagccacatttatttgttcatgtattagacctgactactttcatgccacattggcagaatttgagtttggcccacaaagtctaaaatatttactatatggtgttttatagaaaatgtttgctaacctctgctctaaagtataattacaaattggccaggtgcagtggctcacacctgtaatcccagcactttgagaggccgaaatgggtggatcacttgaggccaggagttcgagacgagcctggccaacatggcaaaaccccgtctgtactaaaaacacaaaaattagccaggcttggtggtgcatgcctgtaatctcagctactctggaggctgaggcacaagaaccgcttgagctggggaggcagaggttgcagtgagccgagatcatgccactgcactccagcctgggcgacagagcgagactgtgtcaaaatagtaaataaataaacaaataaattctaattataaattgtttaactctttctatgagtctatataaggagtttatagaaaagcatttgtttctaatgtttgattattaaaaatacccctgtattttttattttattttaattgacaaataataagtacatatatttatgaggtacaatgtgatgttttgatatatgtttacattgtggaataattatgcatacttgaaggattttagagccacagagcctgaacctaaccgtttctctacatcagtgttggccaacttttttctttaaaaggccaaatagaaaaatttcagtcagtttttgaggcttcatgggccatttggtctctgttggaaatagtcaattcatgctaggattggaacctagataaccagactcaagagcccatactcttcaccagtaaggacttaggaaggcagcaagacctgggagtaccagtttaaatgaatgttcttctaagcagtgtcctgtgctgctattaaaccagaccagagctttggcccttagttaagaactgtatgtataaagttttccaaaataatggcttcaggttttcacaaagtccttccatccaaacaatgcagattgtacccccttaagaatctgttcttaactgccatctgttctctgcattcttaaagtctaatcttaatacagcagccagaatgatctgtttaaaaataagtcagatcacatcactcctctgctgaaaactctcctatgcttcctaatctcactcaggataacagccaagatccttccaaagatgcaggacctatcctcctccatccccaactctatgactatcattcctactactctccccttgctcactagattccactcaccctggtgtccttttttttttaattgaacatacacatacactcctgccccagggcctttgcacttgctgtctctgcacagattgttctttcctgagatagctacttgaatcgttccctcacttccttcagatctttatttaaataccacctactcagtgaggctttccctgcaggcactttctaaactctccacatgccacctccctttgccccatacctaagtctcttattcctatccagtgctttacattttgttctttagcacttttcactctccaaagcaccttaatttctcttttactacacattatcaccattagaatgtaagttttatgaggacacaaaaagtttgtctgttttattcgctgttacatatctagtacctcaaacaatgtttagcagacaataagtaatctgtcaatatttatggaatgactcaagtgattttttggaagagttttggtaatatttcatttgccaaaagaattctgccaaaaagactttgaaacccccactttaaggtggagagcttccatagaggcttctggatgttacttgatggtcacacctatgcccactctttcactggccttgaacatttcaagtatgcagcttagtagattatatcttcacagtttcacaacactttccagtttaaaaatcaatgctgcattatgctttgtatatttggacagattatttttgaaatccataaatctctaagttttttttttttaagtctccctttggtgagctgcccttgattagttcaaaatgggaagagagaacctgtcattctttgtcaatcaggttggcacgtacttgacagcatgcagttatagtgaaagagagctgtgttgcagtggtctagcaaacctaattgtagttaagtaaaagaacagtcacccaacatgagaggaaagacaaagaaactcaactgaacaatgttgtgtttttccatccatcagccttcatttgtcagagtctgactgacaatctggactgcagaaatcaggctctaacacaatattgattccatttcatattttgtttcttgctacactttttagcaaacagtttctgtatggaatgagagatagtgcagtcaatatatgcgaccagggcacatttatattaaaggcttactttggtttttttgtcccagaaatcacatattgtttgtttgttttactataatattgtaattgtcagctcttgctgcagtaacaaacaatgacaaaattccagtgacatataacaacaaacatttattactcactcatgtgtctgcagatcagctgcagctttactccacactatgaatcaagttaaggtcttttcattctagaatatggatctgctctaaatgtcttctcatcccaggaccctagcggaaagagcagcttttatatggcatattattctctcatgatggaagataagaacaaggggaaccagcaaatcttgaactgcctttaaagttccagctaagagctgccacacagtcccttctgtctgtccatggtctattggtcaaaggtacacagtcaagcccaaagtcaatgggaagggaagtatattcactgcagggcagccatattaagagaggaaatgaataataatgaactgacaaatcaaccatagtatccacaaatgtcttaggatttcattgattcccaaatgcattttttagtatttcaacacctctgaacttgagatatatcgtacaatagataatgtttacaaagtgtaggtttttttgttttttggctttcttagtttacataacaatagtggcccttatcatcaatgatagattagatagaaaaactgttaattgtggggttgacaaaatagccaaatggtagaaggcactccttataagtaagtaagttatgagtgggagctaagtgatgagaacacatggacacatacaggggaacaacacacaatggggcctatcagagggtggaggttgggcggagggagagaaccagaaaaaataactaatgggtactaggcttaatatctgggtgacaacataatctgtacaacaggccctcatgacacaagtttacctatgtaacaaacttgcacgtgtacttaaaataaaagttaaaaaaaattaagtgaatggacacttaatgtttacaaaaaagttgtcatttttatcttgaatttcttttttctgtagcaatatttatatctcattcagatcagcttatttgattagaaaaccaagcattaatagtagatcttatgtctatttattcacatattcatataccttcatttataaatatatattcatatatatttagaagatcaattggaaaacataagtgccattcccttatttaaaactcttgtagcttctccactacagttctgagggtggtatacaagatccttcttttctctggcttttgctttctatttctactccattacttcccattcccctacgtgatagctccgtacttcttctgcttcctgtctttgcatgttccatgttccctcttggaatacattctctctgccgtccatccccttataatgaggtgcatgagctgtttctgctcccagcctttctgtcctgaccttcttgtctatcaaacacaaaagtgatcagttcctgctctgtgctccattatacattgcactttactagttgttatacctgacctgctctaaatgtagtatatatttgtgtgtctgcactccccattcctaccccagtgaaacatagtaagcactgaataaatgtttgtcgaatgagcaaataaataaataaataaataaataaatgtttgaacatacatggaaaggttgtttatgtcctccttataatgtgctttgagatatatattcttaatatatatataatcatatattctaaggttattagtaggtaaaatgaaaatttaaagaaattgagtacaagaaaggaaaacaaggaagaattttttcctttttgtactatttctaagaacaccaaatttctagttaaacacacgcacacacaatcggcatgatgtagaattagaaatatgttgaataaatcaattattagaaaatgtaaatatatattaatttgcctctgacttgctacttttaccctcaagggttttttttttctacctcttttcatcactaatctttgcttcactgcttgtcagatcagcaactgcccattattagtaatgccatttaataagagataaataaaagtaaaggtgcttagagttactccatttcaaaaacctatcagggctggatttcagaagagaccatgaaattctcctactgttattgaaccattactccctattacctaattaatacaagttattttcttaaaattatacctgacattgtagtgaactatcaatactatgaagaaaatcaaactctcctcgtatcataaggatcttaacacctggtacacaatcttgcattggaggggacattaagaataaggcatggaggaaaaaaaaaccttaatggaaatgttctgttattagaaatgagactttttggtggaaatcccatgacgactttcttgtctgaatgttctttgaagttgaacactttctccttacacaagccggccactataattagctatgtttccattttagtggtggccttcttcaccttatctgaaatcatataaagatgtgaggccatttgcgagataaaaggtttgctcaaaccagttctctgacctggatatcagaggtttggcaatcataaacccactaagagaaaccctcagagctattacaaggctatgtaaaactttatttcattttttgtgagaagggacaggattttctctcatttatattctggaagaatattgtagaatgtatttgagttcaagaggaggagaaataattaacataatattaagaaacgtcaattttggaaagaaataataagcatatatgcacatgtgcgtgtatgcacacacacacacagtatacacaacagattcagaaagaaggaaatagagatttggtgacacatacttcctggatataatctcaactctgccatttgcaagccacatggtcttggataattgacctaatctctctcaattgcagcatctgtgaaattagataaaactttctttgtaggagtgtatgtgtgtatgaaaagcacagtgtttgacatataataaatgttttagcaactgtagcttgttaatattatcacagcagttaatatcactatagcagttagttgccattttcagcacagctaataattttagtagcattttctgatctttccatctcatgtggtttctttggagttgtttcttgctttgttttttagcttttctatgtcacattttatttgcatggagaaataacaaattttacaatttatttcacatattctttaatttttaggataattgtcagtttcttacagtttattttccttatactcactgaagaaaatatgtacgaaagaatattttcagtgaagttaattggatttactacagttgacccttcaagcaatagtatcttgcccttaataactgacctatctttgaactaataaattcaacctgcaaataaatgtagtgaggtaaattgtagaaatttatcttcaaaatggtctttctaaagtgatctatcaaaggtgcatttaattagaggtccagttctccaaaaatgtgccaaggaaaagtagccacaaagaatttagagctgaaatgaattctttcacccattgctctgtttctatagaactgagaataaatctcatatgggtacttaaaatctgtactatgtcattgaaggatgaaaagatgacaatagtgatgatagaaggacacggtaataggaaacatttcaatagagggaaatgatgtgagtatgcaatgttcattcaccagaggactaaatctagggctattttggtgacttgaacagggaatattctacttcctgcaagtgaaaaatatggacatttcatttggcatgccacctgctcttcagtccatcatgtagcaagcacccacttagtactttggagctctaagtaatacttggactactcaaatgccagccttgttgccatttctgtttattcgccaataacaattttattaattaaaatttgtatgtggatgtcttaaggaaattccttgtagttgtcaaagcagactcctgatcctatctatctgccagtgccttctgagtagtggtatctattcttcatgatttttggaactatttatgggtgattgaagaatatggagtggatagagaaggatgctagtcatttggctgcacacaagaaacacagatgaaatttttgactatttctgttcattttctaaaggtacagaattttcactggattgtacttgtaagcaattttaaaggaagaaatatccagccttttgaatttgttacagtgttgcaagacttttttaaaatgttaagaatttttatcatataggatgaattaatactctcataattttaggtttgtttcttccataattaataactatccttaaagattgtgtgtgtgtgtgtgtgtgtgtgtgtgtgtgtgtgtatttcttgattttccagagcaaacgttcccattcatttgttttactcaccttgttatagttgctcccattgtaagatatatctagtaagtttactgttgttacctaaatctgtttgctgaattttaaaaatgggaacatgtagtaaatttgggggaccacgagctagtatttacaaagtaaaccgagaacattggatataaaaccttatttcatttaacctccaatgaaggatatattcagtattattatttgtattatttcttgagcttccttgcttatctgtaatatgtaacatggtggcaccccttttcatataattctctcctcacttctattttgggtttttacatgttcttgtttcagtctcttctgctctttctatcttttcttggttcaactttcttctcttatcctgtggaggcgaatacctaattctggctctatcctcttcagtcactctacaagtatcactgggacaatattgtccaactactatttttacctccaaacctgtattcttagccttacccctaatctgcacactacgcttctttttgcaattactttctgtacatttgcatcagtgttaatcacaggcatcttgactcatgtctccaacctgaaaacattattccttccatatagggacaggctcctctgtcttccctgtacccctagacagtttctcccaagttataaaatcttggtgattctgaaaattttctttttccccatcaagtcctgccagtcctttatccacaacataggaataatacttcctgaacatccgtgctgctcctgtttgttcaataagtactcggacctctaaaggcatttcctatgtttcttccaccagccccttatccttaaaatcttgcctccaatctgccgctagagttatcatcttaaaagagtcaaatcagggttggtatccaagaaatattacaaagtactaagctcttggtatatacaatcaacttgagagaaagagagggacgggaggagagggagagagagagagagagagagagagagagagagagagagagagagagagagagactttattctgtcctctataacacctgaatgattctgtacatatttatgttaacagagcattgtactacttcaaatccttatacaagcaaaactcctcaccgccttttggcaatggaacttgcttttccctctgcctgaaatagtcttcagtatgttgacatgactcatttcttcacttcattccatttcctgaagagaggagcagtcttctgtgctcacattgcctaaaatagagcccactgtcactctctacttactctttttaatctttcttcatagcatacatatacatatatatacacacatatacatatatatacacacatatacatatatatatatatatgtatacacatatacaggcatacctctgagacactgaaggttcagttccagaccaccataataaagtgagtcacatgaactttttggtttcctggtacatatagaagtcaggtgtacactacactgtaatctattaagtatacaatagtgtatgcctaaaaactaatgtacatgccttaatttaaaaatatgttattgcagtgttcaagctgagagccaaatcaagaatgcaaactatttacaataaccacaaaaaataaaatatctaggaatacatctaaccaaagaagtgaaagatctctacagggctaactacaaaacactgctgaaagaaaccatagataacacaaacaaatggagaaacattccatgttaatggaaaggaagaatcaatatcattaaaatggacatactgcttaaagcaatctacagattcaatgctattcctatcaaactagcaatgtcatttttcacagaattataaaaaactatcctaaaattcatatgaatctaaaaaacagtctgaagagtaaaaacaatgctaagtgaaaagaataaagcatgatattaaccaacttcaaactatactataaggctacagttacccaaagagaatgggacttctacaaaaacagaaacttggaccagtagaacagaatagagaactcagaaataaagccgcatacctacagccatctgatctttaacaaagtaaacaaaaaaaaaaaaaatggggaaaggactccctactcaataaacggtgctgggatagctggctaaccgtatccagaggaatgaaactggactcctacctttcactatatacaaaaattaactcaagatggattaaagatttaaaaaaataaaatctcagccaggtgcggtggctcacgcctgtaatcccagcactttgggaggctgaagcaggtggatcacgaggtcaggagattgacaccatcctggccaacatggtgaaaccccgtctctactaaaaatacaaaaaaattagctgggcatgctggcgcatccctgtaatcccagctacttgggaggctgaggcaggagaaccgcttgagccagggagtcggaggttgcagtgagcccagattgcactgcgccactgcacttcagcctgacaacagagcgagactccgtccctaaataaatacaatacaatacaataaaatctcaaactagaagaatcgcagaagaaaacctaggaaatactattctggacatcagccttcagaaagaattcatgactaagtccttaaaagcaaatgtaacaaaaccaaaaattaacaagtgggatctaattaaactaaagagcttctacacagcaaaagaaactatcaacagagtaaacagacaacccacaagatgagagaaaatatacacaaactatccatcagacaaagatctaatatccataatctatagggaacttaacaagcaaaacgcagataaccccatgtaaaaagtgggcaaaagacatgaatatatagatacttctcaaaagaagacaaacgggtggctaacagatatgaaaaaatgctccacatcactcatcattagagaaatgcaaatcaaaaccacaatgagataccatctcacaccagtcagaatgcctattatcaaaaactcaaaacacaatagatgttggtgaggctgcagagaaaagggaacattatacgctgttggtgggagtgtacattagttcacccactgtggaaagcagtttggggatttctcaacttaaaatgcactgtcattcaacccagcaatcccattactgagtatatatccaaaagtaaataaatcattctaccaaaaagacacatgcacttgtatgttcactgcagcactattcacaatagaaaagccaaggaatcaacctagatgaccatcaatggtggactggatgaagaaaatgtggtacacatacaatatgaaatactacacaaccattaaaaagaatgaaattatgtcctttgtagcaacatgcatgcaactggaggccattatcgtaaatgaattagtaggaacagaaaaccaaataccactttgttctcacttataagtgggcctaaacattgggcactcatggacataaagatggcaacagtacatactggaaactagtaggggaagagataaggaaggggcaagagttgaaaaactaactattagatacggtgcgcactatctcagtgacaggatccatcatactccaaacctcagtatcacccaataaatatataaatgtaacaaacctgcacatgtaccccttaaatctaaaacaatagttgaaattatttaaaaaaatactttgttgctaaagcttgctagcagtcatctgagccttcaatgagtcttaatctttttgctgatggagggtcttgccttgacggagatagctgctgaccgatcagagtagtaactgttgaaaggttggagtgactatgccaatttcttagaataaaacaaccatgaggtttgctatgttggttgatttttttcacaaaagatttttatgtagtgtgtgatgttatttgataacattttacccacagtagatctttcaaaaatgaggtcaaggctctcataccctgctgctgctttaccaactaagtttacagaatattctaaaccctttgttgtcatttcaacattgtttacagcgtcttcaccaggagtagattctgtctcatgaaaacactttgttttgctcatctataagtagcaactcttcatccattgaagtttcattatgagatgacggccattcagttacaccttcaggctccactttattctagttctcttgcaattttctccacatccagtgacttcccctactaaagtcttggaccctcataggcattcatgagggttggaataaacttcttccaaacaccttgtaatgttgatatttacctctttctatgaatcacaaattttcttaatggcatctggaatggtgagtcctttccagaagattttcagtttacccagatccatcagaggaatcgctacctagggcagctatagccttacaaaatgtactttttaaagaataagacttgagagctgaaatgactcctttgtccaaggactgcagaatggatgttgtgttagcaggcataaaaacaaaatctcttggtacatcttcatcagacctcttggctgaccaggtgcattatcaacaagcagtaatatattgaaagagattttttcttctgtgcaataggtatggccagtgggcctaaaatattcagtaagtaaaccatgctgtaaagagatgtgctatcatccaggctttgttgttccctttatagagcataggcagagtctattagcataatcttaagggccctaggatttttggaatagtaaatgagcattgtcttcaattgaaagtcatcaattgcattagcccctcaaaagagagtcagcctgtcctttgaactttcgaagccaggcattgacttctctctagctatgaaagtcctagatggcatctttttccaatagaagactgcttcatctacactgaaaatctgttgtttagtgtagctaccttcatcatcttagatattagcttgatcttctggatagtttgctgcagcttctccatcagcacttgttgctccacctttcacttttatgttacggagagggcttcgtcctaaagcctcatgaacaaacctctgctggcttccaacttttcttctacaatttcctcacctctctcagcattcatacaactgaacagaattgggccttgctctggattaggctttggcttaggagaatgttgtggctgttttgatcttctgtccagaccactaagacattctccatattaacaataaggctgttctgctttgttatcatttgcatgttcactagactggcacttttaattttcttcaagaatttttcctttgcattcacaacttagctaacgggcacaagaggcctagcttccagcctctcttggctttcgacatgccttcctaaccaagcttaatcatttctagcttttgatttaaagtgagagacatgcaactcttgttttcccttgaacatttagaggccatagtacggttattaactggcataatttcaatattgttgtgtctcagaatagggaggcccaaggagaggaagagaggtagggggatgactggtcagtggagcgttcagaatacatacattaatggattaagtttgccatcctatatgggcactgtttgtggcaccctgaaactattaaaatagtaacatcaaagattactgattacccatcaccataacagttataaaaatattgaaaaagcttgaaatattgtgagaattatcaaattgtgacacagagacatgaagtaagcacatggtgttggaaatgttgctgatagacttgcttgatgcagggttgctacaaaccttcagtttgtaaaaaaaaaaaaaaaaaaaaagcagtatctgcagagccaataaggcaaaactcagtaaaatgaggtatacctgtacatatacatacatgtgtctatatatccactcacacatatgtgtatgtgtattatatgtgcatattatacatatatgttgatatgtgtatttatcatatctaatacacatatatgtatatacatgtatatcacacacatatattcatattgtaaattgaaaattttctagtgctgtatcccaatctctagcttataaatatattgaatagatgatgcagcaggtatcttttgaatacgcactccaattttagaaatataaatcttttttaaaggttggaataatataagtagtttggtgttcagtgcaaaaggttttaatgtataaatactatgaaaacaaaagttagatcaaatgtatcaaatacaaatgatctgtattgggggacagagggacacattaaatttaagggaatatgaggagaatattgacttcctatgctcgatgagtgaaaaagaaaagtgaagtgggagtgtttgaaaggaaagatgagcttttccatgctagtacatcacaggttttaatactcatagaagtttttagatttgtataggaaatatgatcctccagcctttccaagtttactcttctactggaattacaaatcaaaactaataaatgtttactatgcttcaagtgcaatagttataaagtacctgattagaggtcccacattcagatgttggttatataaaatattcatgctaaatcatataaatgctaaaacatttgtatttgtgatgttctcttggattgctagatggagattaaattatacaaattcagctaagaagaaaaatgtgggataaatggaattttagtttaaaggaagtcaatgaaaggattaattaagtataaaataatcccattttaatttgtcatagaaatgagttttctgagacattgttgtaatcaataacgtgaagatgtaaaattttgcaaaaaaaatcattacgggaaatccaaaagcagaagagtagactctgtatttaactctagcagattatttagaaagaaaatagtctatgccatgaacctttcgactgtctgcgtgaacaaatgtctctagtaatacacactcttaactcaattcccataggctcaaagttgcaacagtatttatttgcccgttcaacggttttttgtttagcacttactatgtgttaggcacttccagggatatgagtgaacaaggtagttatgggtcttactctcatagaggataattctttaggaatggtcaaaactatacatatacacataatgtgattaattgtgatgtgttttgaaggaggaagcaaaggagttggaacagtttaaataagactgtaggttggcagtgggaacaatggtctttgctatcatttttcaaaaattccaatgaatgggaatgacgactgttgcattaagttgcctgtctccctctgacccatagtgattctctattatcagagaggtagggcatgtttttcagcatatgtgataatatcaaacagattcagatggtgaaagtaaaatttcttaatgcttagaaataacataatttgatcaaatcatttggatatgttattaagttgttgtaagatatgaagacgtagctgttactactgccaatagtataaactttggattcagacctagctgtgtttgaatattaactctcccacatcccacgaggttgtgggcaagctattcacatcattgtcactaccgtcactactatcccacccacccttgcttcattttcttatctgtaaagtggcaatctgttggaatcagggttggggaaggcaaatagtagtcattatacgaatggtaactatgctatcatcaataatatagtctacagctatgatgaagctaatcagaaaacattgtctattaccagtaattagctatatcaataactatcacaagaaaagtcccagctgtcagtgaataaatagaaaatagtgctttgtcttagagaaacacatacaaaatgaatggtggtgacagtgctttaagttaacttgtcagtttatatgtgtaatgcatatataatttcaaatgtataatttagacattgtacatgtatatttggcctggtaatttatggtatacataaatgataaatgtataggttgaaaattcagttactttttttccttttcttaaatcatttttaccttgctgaagatatgctcttttctctacttccttagaataatatattttattttctcttaaagtattttgagaccatatcaccatttactacaccaaaatgtttttttgcaaatgcggtattcaagggtgaatttatagtggctggggacctatttggaattcagtaagtaaaactagattttccttattcctcatctgagatcagagctatttctacctctagcaaagacatacagtcattccgggtgctgcattttcagggaacaatgtgttttcttggcaaggggcagtaagaccatcaattaatagttcttcatgtaaagtagctaaactactgttataaaggaagtgaaatttgcatacataaccattaacacatgaggttagttatgtacaattttgaccaaagtgcctgtttgctgctggtatttattataataagaactggaaaaaaatagtctatctcaagagcatgtgctgagcacccgtaaattgcaagagactgtactgggcagtatgagattatagtaatttgggatttcctactaatgaactgagagggaacaggtacaaacacagtatacgaaggaaacagtggcacggagacacttaaacacagcagtgctgggaggctccggggtaggggagggaggaagagagatacgggttaatcaggagctgctctctggggaagattgcccaggccctgactgatgcctgacattgattaattgatactctatcctagtgtttaacaagtgttccatccaaaaagtcttctgtaatatttaacttcacttccttcagcttcaatttctgcacaattcttttgtcgtctcatcaagagagctagtcagcagacagtaacaaaatgcttatattcatatacctgaaggatttttttttgtcatgcttcagccttctccagactgaagaaaagcaaataataaacaaaattaatcgttcttcagaaggcctgtttgactcattaataaataataagctttgatactgtgctttaagtgtttaccctttggaaagaaaataattttgacagtgatgtagaaataattatttgatatttatttcaaaacaaaatttatatccaatactaaacacagaattttgtaaaacaataagtgtataaagtaaaatgaacattaggattattgagattattgtagctaaaactagtgtttattcatataaattatgttaataaattgtattgtcattattgcattttacttttttgaaaagtagttaatgcctgtgtttctatatgagtattatataattcaagaagatattggatgaattttttttaagtttaatgtgtttcacatctctgtttcttttctctgcaccaaaagctacatttttgtgcccttatgtaccaggcagaaattgatctgcaatacatgtggagtctccaagggtatatttaaatttagtaattttattgctaactgtgaagttaatctgcactatatgggttcttttccccaggaaactgaaatagcagttcaagctaaacaaccggatgtggaagagattttgtctaaagggcagcatttgtacaaggaaaaaccagccactcagccagtgaaggtaatgaagcaacctctagcaatatccattacctcataatgggttatgcttcgcctgttgtacatttgccattgacgtggactatttataatcagtgaaataacttgtaaggaaatactggccatactgtaatagcagaggcaaagctgtctttttgatcagcatatcctatttatatattgtgatcttaaggctattaacgagtcattgctttaaaggactcatttctgtcctggtgtgctgccatcaatacaaaagtagtcccaccttcaaggtagattaaattctttggggctttattgctttgcttgccagccttgatgcttttcatattgtttggtttaattcaaatcaagctactgcatcatagtgtctgtctccaacagctgtaaagaatcacaatatggtccgtgacctttcttttctttgttgctctttcttataaaagagtaaaatcggcattgaggcttcagtattttattgggtcaagaatttttagtgaaatgtcatgtaattgcttatttctttggcaaaaagctggcctgggataaacctttctacttttttttcttctccatatccatgttgaagtctaggtcacatttattcacaggctattacataaggagggagatggaaagccaggtcagttttcaaaaaatagctaatcaatggcttccatttgcaaatgagagtccagtgctaaatatacgttagcagtaggttacctgattctctgtacctgaccagaattataatggctcccattatgatgaaggttcctgagatcctgtaatcatggctgtttattgatcagtcttggtttctcagttaatgttgcaggcttggatacaatgaacctcgtcctcatgtttaaaactgcttgaaaacagttcaggtcaataacctcattatacagaaccagtttgtccttgcaaacaacattaccatgacttagattctgtctctaaggtcgctgcttagtttcccttgcgcttggcccaagcttcatttctagaagattgtttgttttccttacagcttacaagagacttttccttaggtagagttgaagtttgcacctgagcttaatgtccaaacaccagacactgaaaatcacaggtttctctgtagatatcaacatacttttattcagaaatatattgcaaccactccaaaaatctagaaaagtagtttgtatccagttcaagcccagtataatcatttttcataagctaacaatgtgctcagtatttagttggaagagctaggcaaagtcctgaaagcagcaaatttcagagtttccgttgatgttctgaagaaagccagccctcagagcagttaatatggtgactttcattgtagcaagccatgcagtgcacaaatggacaattgcatacgtttctatctactctttgttgatcctcaaagactttatgccttatggtgtatgactatgaattaaggtttgtcactaattgttagagatcacaaaggtacatgtaatttggcttttacttttgtgcctttgtaaaagagagagagagagatcttaattaaaagccactgagaaaatttttgctttcattatgtataaaacaatccaaatgcttgatgctaacttatcgcacctccacccacacactcaactactgggccacttggagatcagaactgggatctgccatgcctgagcatatctgcttcctgctgatgcattagtgatgtaaaaggagaattacttttctgaaataaaaagaaagaaccaggagctgttgctttccttctctttcacaacccttaaaaccatttttgtagcagacagcactgtttttttccttcctttttttttttctccttccctgtttccctattttctctcaatttgacacattgggagaagctgaacttaagggaaaatttattcctgtcttcccatttctcccttggatttggagaaaaatcaacatatcaagttggctgggcatggtggctcatgcctataatcccagcactttgcgaggccgaggcaggcggatcacctgaggtcaggagttcgagacctgcctggccaacatggtgaaaccctgtctctactaaaaatatgaaaatgagccagctgtggtggcaggcgcctgtaatcccagctacttgggaggctgaggcaggagaatcacttgaacccgagaggcagaagttgcagtgagccgagatcgcgctgttgcactccagcctgggcgacacgagcgaaactccgtctcaaaatatatatatatcaagttgataggggcaaaaatgcaagaatgatttgagaattatggggtttaaaaaaatagttgactcacgcacaacttttgctgtggaccatgaccttggaaacatctgaagattagctggggtttgcggtagcctgaaacacctagaggctcaaaaaatgacctcacagttttgaacatgacacccagcaatacaaggcagaaagctgtgagggctgtttaaatctctgcatggatcaaaaatttatttttaaaggttagagatgatttttctgaaggacactccattgctctgatagaacgtgaacaaagcctttttaaactttgagtccatatatcaaaatttaaaatttgtcctatttataatgcctcttcttcactctgggtcttgttacctcttaatagaagaggaaatgagtctgagtagcctgcagcacattttcatgagagaattgtgtttctgtttttgttttttgggggaggtgcatttggaaactgtaataattatgaagaaaatgatattctttaaaaagaaaatgaaaatctctcacgatgtatatgcaagatctagtatttaaatgcataattagtgtgtccaccgcttacaaacattctaattaaagacacatcagggagcaattctgtttcttaggaaattgacttgtctattggcacctccgcattctgcatcagacagcctgtctgtccagctcctacgctcacctcccaagctgagttctgattggaagctgggttcatccctgctcagtttctttcctctttcttctttccttcacttcgtcaacttctttaagatttcttttattttcaaagatggtatatttctggtttcttttttaaaatctctgactaaccaacttctttattttctttgaggacttcctgtaaaaggtcaaatacatattatgaaatgataatactaatgacgtataggtagtactaatctctgctgcaaaataactggaaaaatcttaggatcgtatgatcaaatacctctccatctttgtttagcacttcaactctctttctctctctctgtctctctctctctctctctctctttccctccctccctctccactctctccctctctccctctctccctctctccctctctccctctctccctctctctctctctctctcccccttcctcccccatctacacacatacttttatttatttgtatgttatttcttcatcttaacttcagaaattactgaagactgactatatgagttatataaattgtttaaaattttgctaaagttatagttttggtataatatattacattaatgccatagatgaaatagtctttaatgtgttccatttttccacacagtaataactaggtcctcaatagcaccccatttagcagtttaaaagcagcaaaaacaactgctatcagtaacaacaatataaactacaaaagaagccatttgttatttgatttttattataaaattgtatttttaactgtcttgagcttaagcatttaggtgccattttcttgtattcatactcatttttaacttaagttggaaaactacactttcagttaacttttaaaaatatgtttatgtactttcaatgcttacatcacctgccatgtattagaactgagagcattaatggaattttaaatgtcttggttactttctaaagtgataaaatgaagccagctggtttgctttgctaactttttatattatcaaaaaatgttacttacacaaacctagtaatatgttttacttactgctcttgaattatttttcaatgtaacagaaaaaggtgtgaggaactttctgtatttggccaaagggttccatcccaacctttaacacaaaataattgctgtagacaaatggtcaagagggcaattataatcttccaggcatcatttcctcagatatgaactgcaaaatgacagcatcattagtcattttcaattacagtcagtcacaaccagggatgattcattttcccagctgttttgttgttaattaactagatgaagctgtttttttttctcccaatgagtttgttctactgccaacatcaacatcttaacatttttaaaaacttccttagggtttattttttgcctaacaatctttaatatattactcacaaaagatgtgcatctcaagatttatccacggtatagcaggtcaaatggtatttcattggtcgaaatgttgccgaaataaatataattacacttaaaacaatacttggatttcataaatcatctgccatgcgtacagtctcatttacctggtgtaacttcacttgtagcaacagaaatcaatagagagataacagacaaaaattgtcccctcaaatgaacaagtctattttgactgactcatttattgagcacaatttccatgccaataacaccagaataagttgggagaggacttctagaaagaagataacaatattagaggcatttaataatttataagtaaatgcatagcaacattttatttttttaaattacaagtttgcgactgggcgcggtggctcgcgcctgtaataccagcactttgggaggccaaggtgggcggatcacaaagtcaggagatcgagaccatcctggctaacatggtgaaaccccatctctactaaaaatacaaaaacaaaattagccgggcttggtggcaggcatctgtagtcccagctactcgggaggctgaggcaggagaatggcatgaacccgggaggcagagcttgcagtgagctgagatcacgccactgcactccagcctgggtgacagagtgagactccatctcataaataaataaataaatacaagtttgctttacaactgaaaaaaaagtcttggagtataagaggttgaataaatgctaatcccaatgcataaacttgaggagagcttcactttcccaatgagaagagaaaaaatttataatagatttttgggcaacttgtaaacataaacatttagaaatatggatgagattgtcaaatgtctaattatattcaatttcttaattgagtagcatttccatatttgcagtcttacattttataaaataacacactcatttagaaatacctggcacatttatattttatgaaacaatttcattcaaacccttcgtatgtatattctagaattgtagagctcatcaccttgctaagttatttgtaatatggcattgtttgaatccctacataatactctgaaagccctctggccaagattacaagcaacatatctgtaatcaaaaaattaagaatatttaccttattgcagcaagagcgtaaaacacttcagagtgtgggcatctcagtaagagggcattggaaaaagcttcttacagagttcagctggctgcatgattctaaggaggaattcagaaagtagaagccatttctggattagatgctttcaagaaacagagtcaatgtagtgattaggtatcttagtgtttatctagaagatgagattaaagtagggctagacacgtcgttggtaaaggagcagcaatgcctcatattagtcatttctgtgatagcagaaaggccttgtctctgtcttgtttcaaacacggccatggggtggccttgtgtctgcctagtttatttctatgagtgttttttaacatccagctgggaccatcatggcctagctagctgccagctgccagctatcagcagagctatttttcacgttctcaatgctgtcgctgaaatttttatcccaaacttcaatacccattcacaaaatattaggaaaactgtttttttcatttttcttagatatgattttggttgtttgtttgtttttgagacggagtttcgctcttgttgcccaggctggagtgcggtggcgcgatctcggctcaccgcaacctacacctcccaggttcaagcgattctcctgcctcagccttccaagtagctgggattacaggcgcccaccaccatgcccagctaattttgtatttttagtagagatggggtttctccacgttggtcaagctggtctcgaactcccgacctcaggtgatcaggctgcctcggcctcccaaagtcctgggattacaggcgtgagccactgcacccagccagatgtgatcttttaaaaattcccaatagactaacatattctttctgctttttaagttgtttggctttttaacaaattctttgaaagactcgtttacaatgatctctgccacgagtgattgtgaagctatacattaggaatgattgctaaagatttatcaactttctttgcctccctttttaattaagcaaattctgtcagaatacttatgtaagcatcacatctcttgaggttatttcaggctaatatacaacattgtggttccgaataaaataattgagacataagagatagtataaagtcttgaatatgagccaactttcttttctgagagaatatttgagtgaaaagtctcatgtactcagtagctcatgctgaaattagggaagcattttagagatttgaatttcacctcttgtcctcagttgtattagttacacttaaagagagagacaaagagacatagatgtttcagttacaatattcgaatgtatgcctgtatatatacagccgtaggtagagtcctttatttattcagtagatattaattgcatgccaaccattgacacaagatatatttttaaattttgaaaatctcaaactcaaatagagtttaaaactatattctagtttacttttttaaacaaatgattttttatgattgtattaaacaaatacattatttttccttacttattctacatcaaataatatctatttctagaaggcttttttccttgtcttaatgatagaaaacataaaaatcatttaatattttttaaatatccaaaaaatatgaggcaagaaagcagccacaattgtagctaccttaggaaacttaattaaaaaatttttttttatttttaattttatatgtgtataattgtacatatttatttgtgcggtacaagttatattttgcttattttttataatttcagtagttttgggggtataggtggtttttggttacatggatgagttctatagtggcgaattctgaaattttttatgtatccatttcctgagtactatatactgtacccaataaatagtcttttatcccttacctcactcccaagctccccacttagagtccccaaagtccattgtatcactccgtatgtctttgtatcctcatagcttagctcccacttacgagtgagaacatatggtatttagttttccgttcctgagttactttacttggaatagtggctgccagctccattcaagttgctgcaaaagagattcttttttatggctgagtaatattccatggtatatagataccacattttctttatccattcattggtcgatggacacttgggttggttccatatcttgcaattgcaaattgtgctgctatttttgtgctgctgctttcttttttgttatttccttttctggttttggtattagggtgatactgacttcatagaatgatttagggaggattccctctttatcttttgaaatagtttcattataattggtaccaattcttctttgaatgtctggtagaattcagctgtgaatccatctggtcctggacttttttttggcaatttttaaattactgatattcaaccttgctgctcgttactggtatgttcagggtttctttcttttttttttttttttttgagatggagttttgctctttcacctaggctttagtgctgtggcatgatcttggctcactgcaacctccaccttccagtttcaagtaattctcctgcctcagcctcccaagtagctgagattacaggtgcccaccaccacgcccagctaatttttgtatttttagtagagtcggagtttcactgtgttggccaggcaggtctcgaactcctgacctagtgatccacctgcctcagcctcccaaagtgctaaaatcacagacgtgagccaccgcgcccagccaaagcgttcagggtttctatttcttcttgatttaaactaggagggttgtgtgtttccaggaatgtatccatttcctctagattttctagtttgtgtgcataaaggtgttcatagtagtagtgaatgatcttttgtatttttgtgatgtaggttgtagtgtttccagtttcatttctacttgagcttatttgaatcttctctcttctttccttggttaatcttgctaatggtctatcaattttgtttatcttttcaaagaactatttgtttcatttatattttgtatttttttgtttcaacttcatttagttctgctttgatctttgttatttcttttcttctgctggatttgagtttagtttgttcttgtttctctagttccttgaaatgtgacattaggttgtcaatttgtgctctttcagaatttttgatgtagtatttaacactatgaactttcctcttagcactgtttttgctgtatctcagaggttttgataaattgtgtcactattaatcatttcaaaaaatattttaatttccatctcaatttcattgttaaccccaaaatcattcaagagcagatttcttaatttccatgtgtttgtatagttttgagggttccttttggagttgatttttagttttattccactgtggtctgagaagatacttgatatgattttgattttcctaaatttattaagactttgtggtctcttgtatgacctgtcttggagaatggtccatctgctgataagaatgtatattctataattgttaggaagaatgttctgtaaatatctgttaagtccatttgttctagggtgtaatttaagtccattgtttctttgttaagtttttgtttcagtgacctgtctagtgctgtaaatggagtattgaagtcccccactattattgcattgctgtctatctcatttcttaggtctagtactattgttttataaagctaggagcaccagtgttaggtgcatataaattgagtactgtagtaaatatcttcttgttggactaatccttttatcattatacaatgtctttctttatcttttatttacggttattgctttaaagcccattttgtctgatataagaatagctactcctgcttgcttttggttcccatttgcatggagtatctttttccgtccttttaccacaagtgatattttgatacaagcatataatatataatgataaaatcagagtgattgcagtatctatcaccttaaatatttatccattttaaattttaaaaggaaagctatattcagaaatcactttttcttgtaactaattcctgttcttcataaagcagaaatttcatagtttgatatagttgtcttaacatttaatgaatattttcaagcaaagtatatacaatggagaataatgctcagctgcaaaagtcacctataataaatctgatttttccatttacaaacaaaagaattcccaaagtttatccattttggtagaacacgaattcactctgttgagtttggagctcttgtgcggaaaaccttggacctgcaatttagttagcatattcaaagttttaaaattatggagatgtagtcaagaataggacttgataactattatcccactgatacgctatttaaataagttgggatttaagtacttatttgatttccttaaatttgcttatagatgattaacatgtattgcaaattgttaccttttacagatttctattgagcactgcttaaattttattatatgatgaacacctgactagttgctacagccaaacattttttgttatgcaaatgaattttacagcttaattggaatgatgagagaattgaaaatatgggcaaatgccagagaagtgaaaagcaaaatgaagcaaaacaaaaaagaacttgtataatatataaataatccatttcaactctacagtacaccaaactcttgaaaaagtagcaagattgtttttgtgaacagccaaatcaaaaactgtagtcatttcataagtatttgctaataattataaaagattggaaattatacagttctgagcttattgaacctttgacccattgcagtgtcctcagacatttgtgatacattggtagtgccatttaattttaaaaatccacctctacattagagattatagtaacccctcatttacctatctggaaataagagtgggaaagataatattagagtaaatggacagactatttagagtttatgtattaataaaagagaaattgcatgtacaaacatgttattttctaggtaactaaaacctagtcctttaataaagcactgaaaaaaattttatcgtaactattttaatgagaacttttcttgaatatcttctgttttgcttcattaagcagcgcataatatctaaccaacaaatttatagtgctttgtagttcacagcatttttaccatataaaatatctcgtttagtttctccaacaaagctatgagttaggtggtattattatatccatgtttcaaggatgataaatcttagtgacccatctcattttccaaggatcacacaaccagtagtagtgaattaggaacgaaacctaagacttctgattctaaatcacaatgtaaattaacttttcttaattttcaggggtgtcgttatcacatcaatttttgctctgtttagtgatacagtgttatatgaggaacatgaaattcaaagcaccctttcttcagttgagacccagttgaagtggttaatttgcttttagaagctagactgtaagataaatacatacctttaagtattaaagctaactcaaatcactgagatacttacaccatgagaagagagtggaacctaagtcaactggtagaaacatagaaacagcaaactttgatctctctttatcctcattctgaggggcaatatgcttactgagtggaaagatgggcatacccccagcagtatttaaatcaatccctaatctatcactatctctccttttctctctatctcagcacatataggtgatttcctataaattaaatggtgtaggatgagatttcatcccatgttgaaaggtcatttcattgataaatgactaagattaccacatttctcagttttaagtttttcatgttcattgtctcctattgctactttctgttatcagaatgattacttctcattgcttttagtattctgtctttgtagggttacagaaacttcacagggaaaccagaagatcaaatatattactcactagtctcttagaatatttaatttttagtgtttaggttctgatgtcaggacaggaaaatatcttccgtgagtgatgacttccaagggtggttttcctgactaatcagaggcattattttttgtttgcttttgggttcaagactgatttttaataaataaaaaagttacatttattgatatgctagtaaatatttacatcatgcattctggataaaaacattgaaagccttgatttgacttgatgtcagacacaatagacatagtctcaagagcactgatgatagttaaattaggaagtgatgaattcttactatatattatcttttgttcttagcacagtttattttatatttataaaatttaatttatattaatggttatgtttaataaccgattagcaaaattactgaaatgtgacaataatatctctattcctgtttctttcctgctttatccttttaaaatatattatttataagtatattttaaatttataaaagctacattgtgctataaatcttgtttcttagcttttctaacattcataattgtgttttaaagatccacccatggccgggcgcagtggctcatgcctgcaatcccagcacattgggaggccaagatgggcagatcatctgaggtcaggagttcaaggcagcctggccaacatggtgaaatacaaaatacaaaaattacccgggtgtggtggtgcgagcctgtaatcccagctaccgggaggctgaggcaggagaatcacttgaacccaggaggcaaaggttgcagtgagccaagatctcaccactgcattccagccagggcaacaacagtgaaactccatctaaaaaaaaaaaagaaaaaaatccatccacattgctctacatatacccttatccatttctttcacatacatacccatgttggcctcaattccccacaatgcagcaacaaactttcttgtacttccttatgaccttaagaatgtgagagaaacttctccggtatacactggtgagggaatatgatcagcagggttttttgtttgtttttctgtgttttgctttttaacttatgcccacctttctgttggcagtcagcagccacatctgaagttatagctctctgatttagacaaggcttattcttccctttgttacaacctagtccctatagggacctgaatttgtgaccctagtctatgagattactttttaaatacagtttggttcaggatttataaaagcctaataaggctgggtgtggtggctcacacctgtaattccagcgctttgggaggctgggatgggcagatcactggagtccaggagtttgagaccagcctgggcaacatggcaaaaccccgtctctacataaaaatgtatgtactcagtagtactactcagtagtagtactgagtagctactcaggaggctgaggtgggaggattgcctaggaagtcgaggctgcagtgagccgagatcttgccactgctctcccgcctgggtgacagagtgagaccctgtctcaaaagaaaaaataagcctaataaaatgattgcacgcctggaaaacctacataggctccttcaagtcccatatatatataaagtcatccatggtatgtagttcacattgaagtcaagttgggggaaaagaaacttatttatctctttctcttttcctttattcaagtagcaattttcatttaattttattcaattcagaaatatttactgaactcctcttattaggaagcactagactggatataaagaaaacatcgtacaaggcatagaggactcagtcctgccttgcgaagggcacatagtctgactggaaagacacatgctgacagggtagactgtgttaggaataatgctcaaaatcctgaggacattgaacactcgaacaaaggattcttagcaaagcaattttacttctgcacagaggggtgcctccttggccagttgccatgagagcacacctgaacaaaggggcatgagagcctttattcctgacgcaagtcctgcccctgtaccctttccccccattggccggggttgggtcgtacaatctaaactaatcccagttggctaaacatttgattttttttagatagggtgggcacgtaaaatcaagtggagaggaaggggaaggggcgtctgtaatgagctagaaagttagtcctctttccaaataaggaaatgaatgtgagctggtactgaggtgtgcctgggcatctaacaaaggtaaaaaggaaaaaggagaaaaatcagggggtactatgaattaaagaataaaagattgatcagattatttgaagagaaaccatcatcatatcccacaactggaagaaacaatttgatggcaagtttctcttcgtcgtttaccagctcaaaatctcaactatcaaaggcaagaaaaatacacacacacacacacacacacacacacacacacacacacacacacacccctctgcctttttctgtatggccaaagccttcagtccagctgaccacttcccactccagttaccatgttagcctcccaacttgtatctctgcacccttctgataaagcctccacaatgcaaaacacgaatcgtatcatatggctcttcttctctaaacacttccatctactctgtggttttagaagagaatgtaatagtcccacattacaaggtcttaataaattgcattcttgcagctctgtatcattacttgtaaacactgtagtctagatagccaggacacactgcatttcttttttaaggctcgatacctcttgccattttgcacgtagttttccttctgtctgaaatgccctttttccacctggcgcttgaatggccccttctgaaaacttcctagtcgtctttcaaaataaattcaaatgttagcttttgtgggtaacctattgacctctccaggctgagttaagctgttcccccgaggtgtcttgttgaaatcattattttttcctaaaatctctgttctaatttacttacatgtctgtgaatgcttagaggttacgaacttcagttttgtaagcttagtaactggcacaaagtctggcacagagtagcacctgaacaattatttttctggaataaataaagtaatggtttcattgaaatgattcgcattaaattaatgattagcattaaactacaacgtgtatatgaaacattccagttaggttgggttcattccattcctatttaaagagtttgtagtttctggctcttttccaactctgattcttcagactagaaatgcaatttctgctaatgtatttattttaaccaaacccgacatcaatcaagttatttgtattcctcataaggtaagcataggaatttacagtgatacaaaaacgcagctattatctcttataggcactggtaaagcttttgtgactagtgctactatactggtaaggtattgctgcttgtaatgaactaaatatttcagtggcttaacacaataggagttcttttcttgctcacatgacaacccagcgtatgttttcctagtcaagcagctttcttacatatgttattgcagaaacctaggtcctgttcatcttcttcctctgcctgccattcccttggtagcttttctctgctcgggtttcgcaagaggatgaaatcctattgaaaatgatctgagggtctattatgttctcaagaatggtacatatctagtctatgataaatgctcaggtaactgattaggtgtaatagatatcttaggattttgtcatgaacaatcagcatcaacaccacctggaaaattgttaaaaatgcaaattattgggctccacccagtatctactaaatccagaactccggggctaccatgcagcaattagcaaggtctccaggtgattctgttgatcctaaagtatgagaacaactgccctagggcgttaggacttaattctctcctcagtaagttgtaaagatttgccgtaggacctaagagtcttctgcttccagcaatagaaaggaaaaaaaatgtggaaacctcactaaatttttcaaagcctcagccccaaactgacaaacaacacttctgctcacattctgctggctataaattatcgtatagctagctgcccagtgaagtggaaccagctcaggacggcctactgttatattgccaggcattttttgagccacttgatgttatcttcttggtaatttaaatttaaccgtggtaggaatatttacaccacagaaattggcaaacactaaaaacaaggtgtttttaaacaccctgagatcagagatccagttgatatacatctaccagcacaccactggccatatacaggcttgcctcatgccacggggagctctgcagctgaagtagcccttcaaacttgtcctgctttgagccaaattaggcctctatactttcaccttcatcagtcactgaatgagggctgcctggggaaaggcatgaacttggacaaggcagctctctgcagctcaggcagtccctgaagggactgacagttgaagaatgtctactgacatcatttccatcatctagaacaagagtctttctttgaagggggctctgagtagcatattcccgtgtccactgcagcccctccctttaagagactctgatataattgactgggggtgagccagtacattaggattttcctaaagttatctggataattttagtatgcaaccacaatagatactcttcaagaattaagctagttgctgagagggaactgttttttgttggtttgttttcactaatgtttgcactctacttcctttaaataaaattatgcctggagaaagggtttttgtatggagcaattgataaatatttgtagggtggttggctaaaatcattataattcctttaaaagaaattctacccactaaagttaatttagaagtaaaatataatagaaatccaataatatattcaccaaatggattaagatgttcatgaattatcttcaaagtgttaatcgaataagtaatgtgtatgcttttctgttaaagaggaagttagaagatctgagctctgagtggaaggcggtaaaccgtttacttcaagagctgagggcaaagcagcctgacctagctcctggactgaccactattggagcctgtaagtatactggatcccattctctttggctctagctatttgttcaaaagtgcaactatgaagtgatgactgggtgagagagaaaatttgtttcaattctaaagatagagataaacctttgtgttattgactgtgcaaaaagtcttagagtacattccttggaaattgactctgattcaaagtgttgcatgacaacgggatatggggagtgttctctggagatacacccacaaggaagagaagagcacaagggagattgtgggagagtctgaaatgtgatttgtctgcagcagaggcctaagccagtctcgcaggagccctacatctgggctggctgtgcagagctgtcctgaattgcaggcagtgggcctggcccttgtattcctgatccagccagccattggccaggggctggctgctgcctgagagtggaaggacaacttggacaagttttctgaggccgaaggcaattcttagtaaggaacaccattaacaaccaatattcctagcatccagggatgtgtgcattgttcctgaagagggacaagtatgtctacaaaaatcacagaaaccacagaaacacacacagtcctactagcacctctccctgtcccatttgcaaacaatttaagagctctcccatttttagttcaagaaaaagaaaaatggattgggaggaccacaagctgacttgggggaggaatatttcctcatttagctgtagttttaacttttgttttcactgcatattttcagtctattttattttctttcctcttcagttgttgatagaaggtattcataaattctcatggcaatgttaatgctggctttgactctcaggggaaagaggccagaaaacttctttgctgtaccattccataattaggcagaactaaaaacatctttgggtgttgttttttgtttttgtttttttttttgccttgtctgcttttcaaagatcaaatgattgaagcattaaagcatggtgactggttcttcaggtaaagttgatttttattttatgtcaagtagaaaaatactgaactggaagaatcacagctggggtagcacaatcataattcattagaaggcataaatagtgcttggattaaaagaagccctacaatctggggacagtgcatctcatgtgccctctgggattactcggcagtcatcagagttagatttaacgactttggagacttaagcattatggttttttttttttgtcaatctgggacactgaaattgctgtatcagggttatactcaactgtgtcaggtttatttgtttttatgagctgtaatttttggttccctcagcgcatatgcatagtttgttcctatgttatcatttattggtgtctgttttctggctgtctctggtaggttcagcctcagactctgtaactccatgaagagattatgttccaatgatgttttataagtttgttaaactctgaactcatgagtttatgtcccatataagccacgttacacatggtaggaaggctccaaaaccagggcgccgaaatccatttaacgtgtaacttacctaaatgtaacaatgtttataagaaaaatacattggaagttccagttttgacttccagcaacatatataattcatccactttatttattaacttccatgtgttgagcatcatactggtgctgcgagtacagcatagaataaaagtctctcctttcataaaacatatattgtaattgaaagagaaagacaataaactaatgaagaaaatatatactgtctcaataattataagtgctgtagagtgtagtctacagattgatgtcaatgggtatttgttagacacacagaatctgaggcccctatcctagacccactgaatcacaatctgcattttaatagaatccccaggtgaatcctgtgcacactgacatttgagaaacaccattacagagaacaactaagcagggagatgggatgagggtattattgtctatagtgtggtcagggaagcttgtctgttaagagaacatcagaaaactgatgtaagtgaggaagtgagcctggtgtatttctgggaaaattattccaggcagggagagaaaagactgagcaacgatactgaagtaggaacaagatgacggaatattaaggagatcagtgagactagaggagtgggtcaggggaagtgtgatggaagccatgagagatactcatctttcatagcactgccctacttccttctccccaacatgagggtctcatcaccccccaccactcttgtcttctcctatgtcctccacattgctgccagtatggagagtctgggaatgccctcagctcaaagctgtttggtgatagctggcagagttgtggtagtagctaaaaaagaattaagggaaagaggaattttctcaaaagcaggtgcttttcatcctctttagcaaaccgaaacagatctgagcattaagtcaagatgttaaatacacaaatgttgaatgaaaaaaaaaacaaaaggtagtcatttaaattcagagctgcttttattaaaataagattttcttttttctttactgtggtagttcaaatatcagaataaagaattgtttctattcccgacttcctgacttgcaggaagttaatcagaaataaatgcaatataaaaaaagaaaatctaatttgtattatgcttcttgtatatgtttattatttcatgtactgtattacaatgtaatagaatttataattcattatagcagattgtttccattgcattcctactattaaatatgtagaagctacacatatacttgtagctttaacatatatgtctttatcctcaaaataactgcaaagaacatatagataatttttaaagattaaggagcctgaggtttagaggggagatagctagattaaggccacacagctagaaagcaagcaagcaagggtttcagtccacatgtcaagctccacagcctgtgttttgttttgtggctgtgctttacactatctctctgtccaagaacctaatggaaaattacagatacagatgcagctggccagcagttaatataatttaactcaatcttaaatttatctggagtaaaagtgatacaagtttccgtgttttttcttttctttctttcttttttctttgtgtgtgtgtgtgtgtgtgtgtgtgtgacagaatcttgctctgttgcccaggctggagtgcagtggtgcgatctcggtttactacaacctctgcctttcaggttcaagcgattctcctgcctcagcctcccaagtagctgggatacaggtgcgcaccaccatgcccagctaatttttgtagttttagtaaagacggggttgctccatgttgatcaggctggtcttaaactcctgacctcaagtgatccgcctgcctcagcctctcaaagtgctgggattacaggcatgagccaccttgactggcctgtttctgtgttttttctacttaagaagtagaaaaaattggttcactctatttgaatttcttagaaccatagaaatccaaacttggaataattattgcaattattatctagttgagtattcttcttttatagatgtagaagctgaggcctaaagttgcttgttttgttttatgaacactaaaccaaactaccttgtggctgcttacttaaattataaattataatggggtggccttgcctgagctgtataaattgttttaattatcaggacaaatcaacatactggaaaaaaaaagcaaaacttgcaattgttgttgcttagacacctgtccatatcagtttctattgttgcatagaagcaccccaaaacttaacagttcaaaacgagtgatttattgctcataattctgtgtgtctgaagtttgctctgtgattagctggatagttattctgatggtcttgcttggtgttacttatgtggatgcagttatctagcaagtgaacaggagctagatggtctaaaatgcactctctcagatatctgacagctggctgttggttgcagaaccttgattcttcataaggccactcatcatcctgtaggctagattaggcttcattacatggtattctcagggcagttttccaagagagggcgggtggaagctacaagaccttctgatgcctaggctttgaaacgtgtaggttacttctgctaagttatattggtcaaagcacctcaaaagatcagcccagattcaagagatgaggaaattacttcatctcgtgaaaggaggagatgccacatcgcatatcaaaggggtatgcatattggggatagaaggttttattgtcaccgtatttatacacaaatcactacattggggaaaaggagggaaactggagatcaaaagtgttggtcttaatccaacttaattctcaaaaattaccatgcgttagaaccacccagttcttcgcaaagtatagattactgggcttcaaccccagagtttctgatttactagctctggggtgagacctgcatctctctctctctctttttttttgagactgagtcttgctctgtcacccaggctggagtgcagtggtgcaatctcggctcacagcaacctctgcctcctgggttgaagcggttctcctgcctcagcctcctgagtagctaggattataggcacccgccaccacgcctggctaatttttgtatttttagtagagacagggtttcaccatgttggtcaggctggtctcgaactcctgacctcaggtgatccacctgcctcagcctcccatagtgctgggattacaggcgtgagccactgtgcccagccaagacttgcatctctgaaaagttcctaggttatgctgatgctggcctatgctttgagaactactaccacagacatacagtgagtggggaagaataaattcatcccttctgctgtgtgcagcaaggagtgggattccaatgagatccagtgctgtgaatgctaaagggaaatccatcttattttagcacctctactccccatctccccaccccgaggatgttatagcttagaagttcaaggagatggacaacacactaaaccaggcagtatttgccctgcagagctgttcagtgttcctggatgagacctctgagaagaaaagccataagttcctctagagactttcacaatcatttaggtagacaggactttgcatgggtctgaaggcttgcatggcagatggaggcaaagagccagcaaatctggttgtaaatgtcaatgtgaatcctttcttatccacaagctgctgggcctgagaacattaatgttctacaatacccgatttagcatttttgaaagaaattgcatatagacatgcttaatgtgaagactccaaatcaggatatttgattcaaatgtctcttggtaataactatggaatgaataacccattgtatatggacatatagaagagccagttaacagagttttcttttttttttttttttttttttttttttttttggagacggagtctcactctgtcgcccaggctggagtgcagtggcgcgatctcggctcactgcaagctccgcctcccgggttcacgccattctcctgcctcagcctcccccgtagctgggactacaggcgcccgccaccacgcccggctaatttttttgtgttttttagtagagacggggtttcactgtgttagccaggatggtctcgatctcctgacctcgtgatccgcccgcctcggccttccaaagtgctgggattacaggcgtgagccaccgcgcccggcccagagttnnnnnnnnnnnnnnnnnnnntagtgggtgtctaggagtggttcggggtgtgttgatgagagcgggtgagcaggaactacaacgaaggggttggggagaggtgcgggagtgctgtgtggttgggtggactggcgtcgggcgcgtgaggggttggggtcgagagggaggggatagtgcatgggaaatggggtggtataaggtccaggcggagccgttgtggggcaataaggcggggtgccggggagatactagtgggtgacaaaggcgcgggttgaggagttctggaagaaaatggagtcgtgcgcggtggcaaagtgaaggttggcaaaatctggagaggtggatttaaagagtggctgggggaaaaacgagtggaagggaaaagcgcagtgcatgcaggaggtaagggaagaggtgaggggaaagggcgtgggggggggtgtgtgggggcgggagtgttgttttttttgagacggagtctcactctggtcgcccaggctggagtgcagtggcgcgatctcggctcactgcaacgtccgcgtcccgggttcacgccattctcctgcctcagcctcccccgtagctgggactacaggcgcccgccaccacgcccggctaatttttttgtgttttttagtagagacggggtttcactgtgttagccaggatggtctcgatctcctgacctcgtgatccgcccgcctcggccttccaaagtgctgggattacaggcgtgagccaccgcgcccggcccagagttttctagttgattaaacactggtaaaatcatctcttcctgtaattaagtttggagagagcaagtctcaagtgtaattaggaaagcacagtattggaggtcaagaagcctaaattctgatatctcagttgtgctaccaactatataagggatcaacagactgtttctgcaaaggaccgatactagatattttctgctttatgggtcatgtggtcaactctgtcattgtatactaaaagccacagacaatacctaaataaagggacatggctgtgctccagtgacactttatttacagaaacgaggcaggtaagatagatttgacccttagtgggctacccatttccccttagcactcagccttcctataaaccatgaagcgtctaactacaagtacctgtgagtcttcctgagtcctttctctgcctgtaggagtagctctcccacttgcagagcaggctggaagctggggaggagattatctctggaatagcacttaaccaatggacaaaagctgggggataaaggtgttggtcttcatagttttcatactgctatgaagaaatacccgagactggataatttatacaggaaaaagaagtttaatggactcacagttccacatggctggagaggcctcacaatcatggcagaaggcgaaggaagagcagaggcacttcttacatgacagcaggcaagagagcatgtgcagggaaactgctctttataaaaccatcagatctcatgagacttattcactatcaggagaacagcacaggaaaaccccacccccatgattcagttacctcccacatggtccctcccacaacacgtggggattattggagttacaattcaagatgagatttgggtgagaacacagccaaaccatatcaataaatatcccaccttcttctccccttgggtaggacacctccaatgcatgttccacactaaaaatctccagtgaattgggcagttgaccacaatgataagcatacttattagcatgcctcgtataggcttccttccgatgtgtaggctttcttcccattttggcagaatctggacccaaccccacatctcctgagtttgatttcagtcctcttcagtattctcatatatctcaactttgttccctgctgagatacaactgacagatatatatgtatcttcagctctgcagctctatcttctcttctaccatggctttctgggatcagctcccaattgaattatttgtatttaaatccttgtctcagggtctacttctgagcaaacctaaattaatacaagtcttagaattagtgccacagttataccttttgagtaagttatgttgcaattcccattttatagatgagataaccaagggtcagaaaggttaaataatttgtccaaggttacagagctagtcagtgacagagtgggtattcaaaaataagtctctatgattccagagcttatgctattaatcagtgcaccatgtatcaagcagtgatttagttatcttcatttgaattttttgaagtctctatttaaattgaatatcaaatcctcacatataaggttatttatacctttttatttgttttatttatttatttatttttgcttaacttttttttattatactttaagttttagggtacatgtgcacaatgtgcaggtctgttacatatatatacatgtgccatgttggtgtgctgcacccattaactcgtcattgaacattaggtatatctcctaatgctatccctcccccctccccccaccccacagcaggccccagtgtgtgatgttccccttcctgtgaccatgtgttctcattgttcaattcccacctgtgagtgagaatatgcggtgtttggttttttgtccttgcgatagtttgctgagaatgatggtttacagcttcatccatatccctacaaaggacatgaactcatcattttttatggctgcatagtattccatggtgatttatacattttaatttgaacttcactcacctctacaaagttaaataaagcattccatttccatttcaataatactttaaatatctaggcagttaaagcatgaggttacttggcacttaaatgtactcttgtcatactacttttgttggcttaaattgcaaaaaaaaaaaatggttaatttattgtgacaataccctacatttatctgcagtgatcattttttttgtgaaaatggccttcgtttatctgcagcaaaggaaaaagaggatggcaattagttcttgcattcttattcctctcttgggtcctgatccttctcattaatagaaacatggcaggggaggggtatataacccacaccctttcctgttgtggttatgtttccactgttgattctgcttcaggtgaacctttaggattaggcaaataaatttccgtgaggccaaatctttttcttcctcattaacagatgatttctctgctaaaaacacttacgacatggctatactattgccggttttatagttacaggctctaaaccttgaaaacttcctcaaagtctaatacgtcaggagcaagcttttgtacaaaaaatgtgaagacccttaatcagttccaataacaaaataaatccattttaaaccctatcccaagatactgcaaggccttggagcagctggagagactccttaactcttgacattaattaattaatttaaaaattcatatttgtatgtatcagtgaggtaagagtgcttgaaatataatgagatgtgtcacactgtagaaaggggagtgacaacagaaagccctggctggtgaggccccagcacttctcacactcatcagaaggaagtctttccatgaaggcagtagggggtccctggtcccaggccaggtccttcaacaatgctcactggttaacaggaaaggcactacagtggcatcattgttaacatccaagacagtgatagaatgtgaaacttctactgtttagtatttagtattcagcatttagatgttaattatccattttgtgatgaagttccctttcttctccctctcttaaccttttggtagttttattgcatggttaccatttccagttagggttgtgctttggggtctgaactgatgaaggaagagaaactctagttcatcatttctaggaaaaagagaaggctaacatcaattctgatgattagagattttttgattacctatgtcctgcattttaacagaaataaaatgttaattacagtaaacttactttaaccttcttatgctatttaacactcttcaagaaaggacttttgcttgaaatcactacagagtataccataatcttgactgtcatactctgaccaagaaaccagaactatttaggcatatttatgagagtaagtaccctaccgctcaaaatggaaggcttcaacatgtattcctaatatttcctaaaacttcactgaatagttttaaaattgaatataactttaccttcagagagaaacaagatttcgaaaggaaattgtagcagttttgtacttcaattgtcgattttaagattgtggtctgaaaagtatttgaacagtcattctttcttttccactatctcaggaaaggctctcattctattagaagcaatcttagaagcgtaactgccaactctcttcttaaaaagtgaagagcagatggagttctaccaatctgctatacttgacagtttttcaactacctaacctaagttccagttactgtctaaattatttttattcgaataggaaaaatacatttatgcttactgtacatttcgacagtgttcattctttgaggtctgttatttaatctccttcccacttttcttttctatcttaaatcagatgagtccccatggtctggcaacaaaacagctgtttctcaaatttttaacgtctctgtggccctcctcctacccttccaagtgttttccatactatttttctgttgtgggcttcagaattggatgctgttccataattactggtcttcccatgactctgtcacatcataaagtctatatatacccttttcctacgtttacatgccaaataccaggtgtgtctagctttaattcaatgactagcatatggtaggtattgcactaatattttttggtcaagtgaacatatattttacagatagatcaaatacatcaaccttcccatgtaataataataataccaagaagattaaatgatcgcgtgcttgaccagctgtttagtggcagaatctggacccaaccccacatctcctgagtttaatttcagtgctcttcagcattcttatatatctcaactttgttccctgctgagacacagctgacagatatatatatatatcttcacaatctcagtagtaagccctatttttttaagattacagtgctgatcaaagagggatattctatggcattgatgcaaatcttccaggccagatataacccctatctccttaaaccctcattcttgactgtgtcttgaaatcaaatttgagaacctctgctttacatgctaccttcctcttaaaattcataaggtttattccttctctcatcttcagtatttttatgaaaatatgttttactcttatttccaaagtgcttgccagcccatgctgagttcattagacaaacaatctaggtatcctaatatttaggtaaaattgctagcagcactaactataccagtacccacttaaattgcaatataaacctacaataggaaaaaaaaagtcaaaattatactactttcaattcctacttctggaataattatcacaccttcaaaaaaactcataattgttctccaatattaaaaaccaggaactaaattacatcactatatatatatagctatatagacatataactgtatatagtttatatatatattacatgtcactatatatggttatatatacagatagctatatctctatatagtttttatataggaaactatatatataaactcatatatatttatatataaactcatatatatataaactcatatatatttatatataaactcatatatatttatatataaactcatatatatataagagattttatatgtatatatgagagacaatattgaaataaaacaaactagccaatctccaatgtcccttcattttcccaggactcttctttattctcaaagaaatgtatgaatacacaatataaataaatgttctataatgttcattatggattataatagttttcttgtcatactgaagtgaatgggaattgtttcttcgattattagcatacttttcataactatgtgatttggtgataggcacttttgcttactaagttcagcatgatcaaaacagaactcctattatttttattgttgattcttatttctttaaggtaaaatatgcccttttcctttgaacctgcacactgtttaacaaataagcacataactcaggattgaattgtacacttcgatttgagcttttttttcaaggtcaggacccagtttcacaagaagttttattttttccaatacaactgacatccactcccaccagctgaaagacaagaaaaacttgtctaataaagctttcagattcaatttgctgcctgcatacagcttgaggaatctctggaggtcactcacagcatgtgttgcaaccccaacagggagaagtaatgaaaagattctagttaaaaagctgacactgccccttccaacctctttgaatgtgaatataataagccagtttacagacgcaaatctctatgattctggggatttccatcttgatctctgactccaaggaacatttgaatgcatggatttgtatccattatctgggtgaataaatgcttcatattgaaaaaaggggtgctttaacaacataagtctgatgtaaatcaggcaaaacaacattgtcacttcatgtttaactctcctggagggtctctaaggtctcacagtttggttctattccagtaatatataggcctatcatagccattttcaaaaataatacctgctttcatttcgattattccccctagcttttgcattgacccgaacatacctaatatttatcttagggctaacacgcattaatgccttgctctgtaccaggcattttgccaagtattctttgtgcatttttctgtttaatcttacagcagccttatgaaataggtactacattattattatttttcaccatgagaggaaatgaaagcctagagagaatggttatccaaaaacacccagctactaagtgggcacagcatggccttgaacctgagtctttataaagttcatgcctgtcttttacctttatgttaaacatactgaatcttggtcatgcagtctatgaatgaagactccatatactctaggaccaattctaccatattgtgcatgcttttgtacatattttccaaatgaaattaaacaacaatactctctcttcccctttcttttccgttttgcatgacatctaaatcttttattaaatctccgtgggtggaattgggccttaagtagtagtacctttgaagcttaatactataacctcagagttacggaagtggtttcaatatgaagaaatatatacgttcttttcttttcttttcttttctttttttggctcctctagaatagaaggcaatcaggagagaaaaagacattaagatgataggcttgattctcccacagtgttactacttagctttatttattctcccacatctgtaactgtcaattcaaggtcaaaaagccagtacagcagcagaattacaaaaagtagatctggaaaatctatagggtaccatagtccagcaccctgctgcaagtcaaaatcaattaaataaatatgtttaaacagcacttcatttaatcttaagggcaccacgactcccttggaaaattcttttttgtgttcagacctgattctctgaaagtattttctagtgttttctttgttcggtggctgtggtgaataagtggacccaattgcctacagcatgaaatcgtagaaatgaatatgggctggaacttcaatcaatcacacaaaccagaaacatagagttcatcacctcttctggaaagcgtccccttcggccgtcaaaagggtagagtttcctccaacatatgttcatacttccctttgcctcccatctgcaatttcaaccagtctgttgctctcgccctttttaggcttcacataccggatttcttcttaggagctcacttgaaaaaagggttgtatgctttaaaaatactaaaagtcactggactagatgataataaaatttctgtaaaataaaaagggagttaacagaggtgttaccacttatcataatggatattgttgacctttcctctagccagtgtcccacttaagcatgcttcttggctggaatttatttttctcatctggataaatctgaagcattatagtaaaacccagtgtgagcaaggccatggatgcaagtggattgagatgaatgagtggatagacctgcgtgggcagaaataatgaggtcagcaataagccataccaagggatgcacactcaaggaataaattggaggtagcagaataactgaacaaatgatacatttgatcagactgtcacatgaatatcaactgaaacaagttatgactgtagttagtgaaccctagagtgaagaaaacaaaatattgaaatccatctgatcaaaaaataataaaattgtttacatgtatatattatctaaaatttcccttaagaatgaagattataaattcccgcagttgaggaaactgaataagaggagaatcaggacagaatcttttctcttcgtattcctagtccatttttcttctaactacagtagtgagaacaagaatttattcaccaaatcataatacattgcaattaggggatgccatttgaatcttggaagacacgatttgaggcaaataaaaaatccatatttataaagtcaattattggtttatataatttactgtttcagcgggaggtataggttagtaatgtaagtcacttcaagaaggttttggtcgaagttttgccaattttttctgtaaaaagccagatagtaaatattttgggttttacaagccagaagatctttgttgaagttactcaactctgctaatgaggtgcaaagcagccataggcagtttgtaaatgcataagtgtggctgtgttccaataaaagtgtgtttgcaagaacaggcagttggttggatttggcccacaagccgtagttcactgacccctgttttagataaatactagtcaatagattccttgtagctaataaagggaatatagattgtttaatgtgtttccctaatcttcttaaggcttcctccaggggaaaaaatatttcttatcatcagcagtgttattaatgcttactcagaacaaagaataccacttacttagcatagaatggacatttataaagccactcatggaaagaataaagagatgtgaaatacctggtacaactcttaagagtgttccactatcatttgaaaaaatgatgagtagtagttatataaaaggactcgagcctaaaacatttgttctcactttggataacgttttcctatctcagcatcaaaaaatacaaagaaaggggataactaggtcttagattttctaaattctcatgactataagtcccatatatttagatattgaagtacccttaaatatacctaagtagaagtaataatttcgatattatgggaaatctaattactgctcatagttctcgagattaaaatgttatacaccacatctcagctttctttgaaacttgaaatggcatacttgtacaaaggtagaatggtctcccaaagcagcgtcatagattagcagaaaagagctatgataatgccacttcaactgactatcatttaaataatgaattagttaggaagagttaaattatatagttacaggcagcaggagatgtcaccatcagggggataagaagccattttccagtacactatttgacttaactggtgcagttccttctttaactgtaggttactcatttgtatccttaatttatcaatatactaatctgacaaataatttattaaggattactgtgtgccctcctgtgtgttagattctagggatacaatatggatcaagataagcgtgattcctagactcctagaaagtaagaaaactaaataactgtacgtgacaaatactaggatgtagaatactagggaagaatcaggaagaatcacctcacccagtctggagtattgcaacagagcgatgtcagaggaaaaattctggaaaaaaaaaaaaaaaaggaaatttgaagatgagacttgaaggataagtaggtgtacctaggcaaacaagtaggggagagtgttccaggcaagagaaacaagtaacagttggaggcaaaatggagcctagcacgttttaaaaatatcagtatggctgaagcactgagttggggttgggaatgggtgaggagcgatgtgtcagggaggacattccagatgatgctggaaatgcatgcatgttcgcaaactgcattttaagacatgttagagaaatcaaacacattttatttgaagggtaattgaaagccactgaagcattgtagagagactagtgacatgagcatatttgggttttagagggattactctggctgaagaataggtaactgattggataagagcaactttggaggctattccagtggttcaggtgatagataataatgacctaaactaaagaagtaataaagggaatggagacaaagtagacagattcaagtgatacttggcacgtggaaacaacaggccctggtaactgattggacataaaatggagagatacagagaacgcgaatagaacacccaggcatttggcttgataaaccgagtagaccgtggtagaaattactaaactatggagtattttagggttcaggggaactgtgagttcaattttagacatctagttttgcaaggccactgaggtaactgagcatatgagtcaggagagaagtttaggctaaaaatatggatgccagagttaaccagcgttatgataaaacaaagctgaagtctcgagggtaagaacacctaaacatctaggctggagaaggcagcaggtaaaaagtaaaaggagaggccaggcacggtggctcacgcctgtaatcccaacactttggggggccgaggtgggtggatcacctgaggtcgggagtttgagaccagcctgaccaacatggagaaaccgtgtctctactaaaaatacaaaatcagccaggcatggtggcgcatgcctgtaatcccagctactcgggaggctgaggcaggagaatcgcttgaacccaggaggtggaggttgcggtgagccaagattgtgccattgcgctccagcctgggcaacaagagtgaaactccgtctcaaaaaataaaaagaaagagagagagagagagagagagagaaacagagaaagagagagaggaagacaaagaaaggaaggaagggagggagggagggagggagggagggaaagaaaagaaaaggagaaaaattcaggagaatggttacttccagggagatggaggcgattgtgctgtggggaacacaagggtggggtcaaggtattagcagtattctatttcttgattggggttgtatttacataaagtgttgctttataattattcttcacactttatgtgtacgttctatgtaatcatctatagataagacagatttcactgtaaaagaaaataaaagcttccaaaagattatcatcacaattgtaacagattcccctggtgcctggagtcacacgccattttcctgcactgcagttgcagctgcagtggacagccctgtgtgagttcagacttgcctttagctgacagcatcccatgtcaagggaatggctcccatttttctactttctatctaagggacttctctgacatcccaggagcccacagattttgtgagctttctcacccttgaagttttagtgagtgagcaaccttcaaccaatggagatgggagcccatggatatatttttaaccactattccttccgggggcaaggggaattctctgtgattctcaggaacatacaaaagttctgtcaaaatacagtccccatggtccataagcattaccttgatgataatacatttgattggcatttcctccccctctgtctcactcttttggtttttcattcttgcttcctagggatcagcttccaaatgagctatctgtacccaagtcctcatccaggccctgttttcaggggacccaaagacaacaataagaaaaatggaactgaaaggaggagaagactttaaaggcatgaaaaaagttcnnnnnnnnnnnnnnnnnnnngggttaaataatactgtcatccaaacctaatctctcctcattcatttcttctctcctatgcatcttagctgtgtgaaaattcaaaatataaatttgatgacagacagaactctgtttaaaatgctccagtaccttaccatttatctcaaaataaaaatttcaaaaaaaaaaatgatatcccacaggatcttgtatagtgtgaccctttccatttcatcatccttataccagatactgtgaactacttactctcttatctccacattgacctccctcctagttttgttttgcttatgaaagtgcttattttctgttttttaaagccattgcacatattggtctctctgattgagacactatccttttgaatttttgacctcatacctactcacttttcaggtctcagctcaaatgttatactcaggaaagacgctccttacctcccaaactaggttagtgtaaatggcactatttatactcctcttccagagcacacaccaaatcttatatttatttgtgggacaatttgaattcatgttgttccccctactcaattgtgagcttcttgaggacatactctgcctcctccttacctagctttattgaagtataattgagaaataaaaactgtatgtattcaaggtatacaacatgatgattttatatgactatattgtgagatgattaccacaatcaaattaattaatacatctagcacaagaaatagttactattgtgtgtgtgtggggggggggatgaggacacttaagatccagtcttgtagcaaatttcaagtaaacagtaaagtattattaactatagtaaccataatgtacattagatccccagacatcttataactgaaagtttgtgccctttgaccaatgatatggtttggctgtgtccccacccaaatctcaccttgaattgtaatccctgtaattcccatgtgttgtgggagggacccagggggaagtaattgaatcatgggtttgtttccccccatgctgttgtcgtgatagtgaatgagttctcatgagatctgatggttttataagcatctggcatttcccttgctggcactcattctctctcctatcaccctgtgaaaaggtgccttcctccatgattgtaagtttccggaggcctctgaagccatgcggaactgtgagtctattaaacctcttttctttataaattacccggtcttgggtatttcttcatagcagcatgagaacggactaatacagtaaattggtactgcagagagtggggtattgctgtaaatatacctgaaaatgtggaagtgacttggaactgggtaagaggcacaggttggaacagtttggagggctagaagatgacaggaaaatgtgggaaaatttgaaacttcctagagacttgttgaatggttttgaccaaaatgccgatggtgatgtggacgatgaagtccaggctgaggtggtctcagatggagattaggaacttcttgggaactggagcaaaggacactgttgctaagctttagcaaagagactggcagcattttcccctggcctagagatctgtggaaatttgaacttgagagagatgatctgaaattggaactttgttttaaagggaagcagagcatcaaagtttggaaaatctgcagcctaacaatgtgatagaaaagaaaaacccattttctgagaaatacaagctggctgcagaactttgcttaagtaaaggagccaaatgttaagcgccaagacaatggggaagatgtctccagggcatgtcagaggtcttaatggcagcccctcccatcacaagcccagaggcctaaaaggaaaacatggtttcacgggccaggcacagggccgtgctgctttgtggagtctcaggacttcgtgccctgcataccagctgtggctcaaagaagccaaagtacagctcaggctgttgcttcagagggtgcaggccttagtggcttacatgtggtgttgggcctggggttggacagaagtcaagaattgaggtttgcaacctctgcctagaattcagaggatgtatggaaaagcctaggtgtccaggcagaagtttgctgcaggggcagggccctcatggaaaacctctctgctgggacagtgcagaaggaaaatgtggggtcggagctccacacagagtccccactggggcactgcctagtggagctgtgagaagaggaccaccatcatccaaaccccagaatagtcagaaatgctgatagtttgaaccatgcatctagaaaagctgcagatactcagtgctagccatgatagcagctgggagggggctgtaccctgcaaagccacaagggcagagctgcccaaggccatgggagcccacctcttgcatcagcatgacctggatgtgagacatgtagtcaaaggagatcatttgggcagttcaaagtgtaatgactgccctattggatttaagacttgcatgtggcctgtaacccctttattttggccaatttctcccattcggaacaggtgtatttacccaatgcctgtaccccccattgtatcctggaagtaactaacttgttttggattttcaggctcataggcggatgggacttgctttgccttagatgaaactttggacttggacttttgggttaatgttggaatgagttaagactttgggtgactgttgggaaggcattattgtgttttgaaatgtgatgacatgagatttgggaggggccaggagcagaatgatatgttttggctgtgtccccacccaaatctcaccttgaattgtaatctccaaaatccccaggtgtcatgggagggacccagtgagaggtaattgaatcatggaggcagtttcccccatgctattctcatgatagtgggtgatttcacatgagatctgatggttttataagtgtctggcgtttcccctgctggcactcattctccctcctgccaccctgtgaagaggtgccttctgccatgattgtaagtttcctgaggcctccccagccatgcagaatggtgaatcaattaaaactgttttcttcataaattacccagtctcgggtatttcttcatagcagcatgagaacagactaatacaaccaacatcccctcttgtcgattttcattgaatccccattacctgggaatgaatgaggaaggcagaaatagaaatcagcgtattgttcaatatagaaatcctgaagttacacaagataattacgagcaagactcagtacagagaaggaacccttgagctggggatcagagtcttctggaaacaaggagtaccaaaggggagtgaaaaagagaagtggagaatgagtagtagcagtaaaagaggaagtatgtaaagaaatggaaataaagatgaaataaactgtcatcttgttccagagacaaagctagctaggggagctaaggaaatttagagggataaaaagtctcatccaaaccttcataatgagctaagggctagtttttcatagaccctagcccaacttgcaaccctctcactctcttacttttttcctggctctgttttgctttactgcctttcatataatctaaaatgatgttaaatgtatatttcctgtctcttttctatatcacaatataaattccatgaggccattgcctgtgccacatttaccactgtactcccagtgcctagaatggtgcccagatcaagtagactcccagagtgtctgttgtcaaatgattctcagtccagtgatgtttgcactacatggtgctgccacttttttttttttttttacttcattccatttggaatttggatcattttgccaactttagggtttattcctctttatttcccctgtgtttgctgaatatctgactatctatttttctcagctctcttctcctcacactttgcctccaacttcctctctgctacaaattatacttagcacaagactggagccacttttcattgattttgatgtcagtgcttgagtgacaactccatgtggagaactttcaacctcctgctgtctcgttgtttgctttgaaaaaaaaaaatactcatcttcttcctgaacccactgggtaaatttatgctcacaaaaaagacaaaacttctagaacaaaaactgtatgagcttcaaaagtattagttttcccttgattttgagactcaaaagtaccatagaaattttaaaagggggatgaagtaattttgtcattcaacccgatatattttacaatttgaatgtcagaaccatgaaatgtcttttcagtgtactatcatcctcactatttccacctataaaagaaaagcaaaaatattgtttgagaacaaaaaaatattgcagtagcggaaaaattcactttaagtctttttttggaggttgccacatcacgcctgtcttcagctcctctcactgaagattctttgttttcttgaaaccagttggtcacttccaattcttaccacctataaatcttcctggttctttatatttcactttatatgtcccttatctcctctgatttttgttccagtctttcattttttacattctttgtcatcctatatgtcagaaagaatctgccactccaaattccttaatatatttatctaccagtgtttatttgcctgtcacatgtactcttcagtaatccattgacttgaaaactttctactctgtctttcttactatagtttgcttcttgagttcaaattattaatatattaggtcaagtaattctatttttatgcacattttacctaacattcttggtaaatataattgttttttaaattgcatcacatggtgagtattaatttaagacgtaattagtattaatctactggacaagattttatttattaactgttttgccctttgctagggttctgtaatctcaccctcagtgcctttaaatagtcttacccaaggatcacctatccctcttcaatttaaattctctattgtgttagtttctgagattgcacattctctggtttggtttggtttttcagtgatctctgtggtcacttccaaccatttctacttagtttacttttttccctgttagccctcttcagtgttaatatcacctggaagttaacccattcctagtctgcattgctctatggccagcatcttggctgattggccatcacctatcctgtacttattgtcaatttttttaaattttttattgtggcaaacagcacataacggaaaatttaccatctgtctttgttcatgtatgttgctataaaggaatgccagagactgggcaatttataaagaatggaaggtttatttggctcatggttctgcaggctgtacaaaaaagcatggcaccactaccaacttctcatgagggcctcaggcttcttccattcatggtgaagggcaaaggggagctggtgtgtagagatcacatggttagagagcataaacaagagagagaggggaagtgccaggctgttatttggcaactagctcttgcagaacctaacagaatgagcagtcactcaacctgcccccaggaagggcattaagccattcaagaaggatccacccccatgaccccacacttcccgttaagccccacctccaatattgaggatcaaatttcaacatgagatttggaggggacaacatctgaactatagcattatcttaattcaaataattttactaccaattccatttattagagaatctaagattaagactactgaaactatgccaatgattatctctagttcaggcttctctcttcaattccaaactcatattttcacctgctgacaagctaccacgtagatgttccacaggtatttctaactcaggatatgtaaaattgatgttatcattattttctgaaaatctattcctcttactatattccctatttttgtgaatgacacaatctaatggactggccatgttaaaaatcaggaagtttttctggcactttctttattccttaatattaagccccacgataaattaccaatcctttcgatcttgttaagacaaataagcttgaaatttcttatctcttatttagcactgcaattttgttttctcattcattcagatagcatcttctacaaaacctcttcactagtttttctgtctctcagctcatcttgtacactgcaaatccattaaaactacactttttaacatgccaatcataatgtattagtaaaggttgtataatagttctctttctcttctaggataaaagctaaatttttcagcttggtacacaaggccgttcatggatttggtacctactagtctatctagggtatttcctacatcttccctcctctctcttgaaaaatcaagtaatactaaactatttgtaactccctaatcaccaattgctgcctttatactttaacatatattcttccttttgctagaaatacatttgtcataataggctctttggtaaacttaccattacattctcagtttataatattatttgtgtaagtaccttttttcctacttagtcctccaggggaatgcatgtgcttctctctccatattatcattttaaaatttactcctatttcagcaagtatcataatattttactgagattaattgttggcatatttatgttaccctggtgacatatttaatagttaagatgctttgggctgcaagaaagagaatgcactttcaaagtggcttcaaaaataagaataattcaactcacataactggaagttcagaggttaaagctggctccagatgaagtacaagcagagctctgtcactctttctctatgactttctttgtcctgatttttttctctgcgtcagctttgacctcctcactagttgccctccaggttccaagatgactgccagcaacaaatgggtaacataatttcttgttacagtgagagacataaacacttacctcacagattcagagatttcaccctcagataagaacaatcaaaattttaattgtgtatctactgtatcattagtatatgtattaggtattcatatatatctactattgtactaaagatgattcagaatggtttcataagctggttgatttaaacttttcttcctgaaccaagaggatgagattatcttgactggcttagaatcgaagatttaggtgaatctaaatccatctccagaactgaggatggattccgtagaaacttgaagacaattggaattctcctagaaagcagaatttcagagtgggtgtagggatatctttgaatggaagttgtttaagccaccaacaatattcactccattggggtgacactgggcccaaaggtacccagttaatatttgttcaacgaacctataggaagacaatattatctgcaagctatttataaactaaatgacaacgagaagtatttttagaaaagttaatcatatacaatttagtcattcacattgggaggctcttcctaaatttcgtttctgatccttatcttgatctttgacgcaatcatatcttggcctccatctaaaagccagtagaagcctctggccattttttaaacaattggtttaacaacattaattggaatctatatagctcaacttaaaaaaaaaaaaaagaggaactagcttatcataatacaatattgtcaaggcaagtgatacttccatgcagctattcagcatttggtgtattcttggtttctgcagacctaataaaaagagattatctcagcgtcctctaggtttaattttaaaaaacaagaaaccatgaacaatgaaaatgatttcaaaacatcttcactcacatctaaaatatgaaatagctagatcagaggttcttaataatttaatcggtgaagcataactgaaggatttagaaaaagtgcctaaactattaaaagattcttcagctgctgcttaatgttgatatcaagttattttttacactggcaaacagctaagccattccctggtcacatccacttttcagcatttagcgctcctctcaatcatcccgatcacagccccaggaatgtttcatggcatctccgcaataatagtatattactattgggtcctgaattttgaggtagtttatctttcagaaaggatatgaatagagcaataagtccaagtagagtgggctttattaatgatgcccaagattttagacgtatactataatcttcaatcaattttaacaccacttcccttaccctagttttagtctaaaccagtccaactgtgctgtagtctcagataatacaatgttagattttttttttcaagatatagaattgtcgggaaaacttgtatgtaacctataccaatctaaatttcttagcatttaactctaaagagtaaagcttttagcacttcctgtgtaatacaagggcaagtgctgatttctctgaatataattttcctttgttagcacatatgttcactgtttaataaaaataagaatgcttcaattatctccttttgtcaagggcctgagaaataaagaaatatacagagggtcccaatctaaaaatgttttgatttacaatggttcggcttaggatatttttattttacaatggtgtgaaagtaatatgcactcagtagaaatcatacttcaagtactcatacaactgttctgcttttcatgttcaatacagtattcaataaattacatgagatgttcaacacctttaataaaataggctttgtgttagatgattttgcccaactgtaggctaatgtaagtgttctgaccatgttgaaggtaggctaggctaagcaatgatgttcagtaggttaggtttattaaatgcatttttcaatttatgatgttttcaacttatgatgggtttttcaatttatgatgttttcaacgtatgatgggtttatcaggaaataatcccattgtacgttgaggagcacctgtatcaatataggcatttacacaactctcgtactgatagcggcaggaggcagagaagctctaggcagaaaagggatggtccccagcgaaaaccccaccctcaagccaaaaagcctgaaaccgcagctcaaagtgggaacttatatcccagttttcctgctcgaatgttgcctttttctaaaccacccatggccccaccccaccccatcctgtgcctataaaaaccccagactcagctggtagacaggactacagctggacatcagagagaagcagcttgacttcagagggacaacttgatggcataactttagagaagaatccggctggacttcaggggaagattacttgccacccccatccccttttcagctccccttcccactgagagccactttcatcggcagtacaatccctcacatttacaatccttcaatttgttcatgtgacctcattttccctagatgctggacaagagctcaggagccacaagtgtgaatacaaaaggccctttgcccttgctggtggagggcagctgcctcctgtgaaaagacaaatggcccactgagctgttaacgcctaagctgtccgtggatggcagagctaacagagcactgtaacacaccctctggggcttcaggggtcgcagacgcctccacctagatgctgctccagtgctcatgcactccagttcccacctcgtttgcttgcacactccctccagtgaggagttgagagcagtgggctaagtaaataaggcacccctgttgcgagttccacaaaggggtcagggaaatatcctgcttcgttactaagtaggtataaaccctttactaagttagtaattattcagtaataatacttaaatgaaagctattctgttagactaaattcagattatcaaagacacgacagaaaacagctttctcattcatgaacctattatttccttttgtaaaatatgttaaatgaaaatacagccgtcatgctaatttctaatggtagaacatattttgaaaactcctttatgtttggaagattttgctttagtgcagataatcagaatgatgtgatatactaagaaataatttttaaaatgagatgtgacatttctcataatctaaataagaaatggcaaaacattgtcctaagctaaataactcatatgaagtgataaaatattgctttctaaaggtccatgatatgtagtgatttctaatgtgtttaatagcattgatcctattgggtaattgggtggttctaacatgtaaggaaggcctccagtactaatttcatgtactgggaaactactgggcagggatgaatcccttaactcctaagtaagactatcagatcatataaatctgctttttgatttgcaaagactcttaggcatacctcttgagaatattaaacatctactaaattatatgtaaagcatttcagtctaagatttacaatgctcaaaggagaaagattttaaagttcagcattggaatttccataatttccttccaattgtagaattttacaattgagatagcaaataataatataaataaatatgtaagactgaaatcaacataggagtttggaaagaagactgtatgggttaactagagttgtcaacaaagacttcacagaagattgtgatcgtagacattagtaaggaataaaatgggtgcaaaaaaaagtctaagaaacaacaaggataaatttattttgtaaagagtgaaagcatattgggtattacataaagagactggctagtttgacacaatgtgtacttttggggtaagcagtgggaaatcactttctgtaagtaaagtggaagagaattcaggtattggatatggtcatataggatttttcaacctttgttttgcccccatccctatcctaccagtatcatcacagatgttggcaatattcactcacttgcctgaagatagatattcatgtcaggggctacagatatgtaaaggtgaatgaagttaaatagcaaaattcaagcacactagttctgactgtgcaccctctctcactcagaaaagcactttggaatgcgagagtactcttatattgacaacctttagttggttctaatttataaaaaaatataaaaatatttagacaatttggatattttatatctatgccacaacccattgtcaaatgattgagatatcattgtttggcaacaatgaaactgaaatcaactctaagagtaaagagtacgacttttaaagatatttggttaagagtaatgttgcaaggcagagaccaacattatagaagttctcaacctgtgtgctggatatagctaaaatttcccaggaccattgaaagaaattctcaaatccacaaccacctcaagtgttgtctgtgaatcaaaggagtgatgcattacccacaaacatgtagtagacattttttaagtgatgtagatgctactgcaattaataaatgcaaaattatattacaatattactgaattcagaataagttgattttgtcactatttttctcaatctacgcatgctagatataaagttattatatagagacgtaacatttttaatatttcagaagcatgctcatgatattgtaaaccaggcactgttaaaagatcactggattgggaattaataaacctgggatctagtcctcatttgatctcttgttggctatggtttgggggttttgggcaaactattcaaccttttctgccttggtttaattgataaatgatggtgttttcccagataaatcccttcccaacttaatattaccagatgtagcatctatggtttagaatgtacagtataaattaaccttcctgaagatcttcacaagttactataacctatattttcatggcactgaaaactaagtttttgatagcttacgtttttataaataatttacttactcatttttatcataataataaatctgattcactaatcaccaaaatatcatttttgaaaatagatgcatgaaaggatccgaacttgttatggttttatctgttcaagtcacctaattttggtagccacaggcccccattgtcaataggggaagattatccattttagcaatacagtctctgataacttcagcccatatgcccttcaattccacttttacgtcagattgaatgggaatgtgaggcccccagtagtaaactaaccctactttctctttggaaattggtctttctacctagctctttgcctctgttcacgttcttgtattccacagaaaatatatacattaggtgttaaaatcacaatgattaacaatttttaagtagaaatagttattaagtatagcataatcatgcctttgaattagtacaaaagtaggaaacagagctttagtgacttttttcattctttccaccatttacagggcaaaaatgaagaattttaccaattcaaaactatgcacatgtatagtttccaccagtatttagtagttatgtttctcaagatgtataattcctttcctttctgttttctgtagtttgataaaccctagataggagttaatgttgtttcagttaggtttattatttcttttatgtggtttaatttcatgcaataagctagagattttgtaacataacttgataaaaattttctcccttcgtatctttttgttttaaaataatggattaatatagattgtaattttacagtagaggaaatacattttacttttagttcttatctagatatcttaggaaaaaagaaacatcatttttaaggattattatttttctactaatgaaaaaaatagcatgattttccattctggactttgtaattaactttaccttggaataattgaatcttaaatataacttcattgaaaattttattttcaagtaacattttaaaatgcaaaatttgtgtgatctctactaaaaagaactctcacatcccaatgtgcttatagctacaataattggttaaaagagacaaattataaagaagatataggttgtgacattgaaattacaaaatgtggattagggaagtaagcgtgtagagttttgtatgcaatcaaagttaagttattaccagcttaaaaaacccttacgtaagatgtaaagaaaagcaaaaacctatagtagcaaaagcaaaaacctatagtagatatacaaaaggtaaaaagtaaggaatcaaagtatactactgagcaaaacagtcaaaccataaaagaagacaacaaaaaaaggcatatagaacaaaggatctacaaaacaattagaaaacaactttttaaatggcagtagtaaattcctacctatcaatatttactttgaatgtaaatggattaaattcaccagtctaaagatagagtggccaaatggattaaaacaacaagactcaactacatgctgcccataagagactcacgtcatcttttaggacacatgttgactgaaatagaagagatagaaaaagatattttggtttccatgcaaatggaaaccaaaagagaatggggatagccatacttctattagacaaaataggctttaaaaatcaaaaactaaaaagacacaaagaaggtcattaaataatgataaaaggatcaattcatcaagaaggtataacaattgtaaatatatatgcacccaacattggagtacctaaatatataaagcaaatataaagtgataaaaagaaagagacaaactacagtacaataatagtaggggacttctaccccaaattcaacaatagacagaaaatccacattaaaaaatcaataagaatgcattggactttatgctttagatcaaatagacctagcagacatatacagtacatctcatctaacagcaggagaatatacattcttatcaagtgcacaagaaacaattcttcagggtagatcatatgttaggccacaaaatgagtcctaacaaatttaacaagattgaaagcatgtattttatgtaaaacaacgccatcatggaaaaagtactagtgtaaacaaggtttaaatatgatttactgattgtttaaaaaggaattatcttagccctgatctgatgggatttcccctttgtaagcagcaaaaataagttcataatgaagcaactgtaataatacagcttcacagatctttctgaataaacagagttggatatgtttctacttcagaaaccatttactgtgggctcacagcttttccatacactctttacactcttaattttaaacccattcatcaaaaggattaagacaatgagattcaagtccaagacaataggaagtatgtgcatcaaaactgtcatgctaatgctctgaggaacattgttatttcaatagcataatttaaaaccactgaaaccatgttttatttatgattacctttcatacgttcaaaaagaatttgagatggtttggcagggatgtcttaaagaaacaaacaccaaatttttatttgttgtgcttctaacaagcaatttttcctacataagtgttacctgttttctccccttgattttgatctcttttgtatggttggtagttgtcgcacttctgggcatagtatggttttctacaagttaaataaaaacataaattgattttgatgtagctagttccactatttcagttagtgtgttttccatacctgcaattcataacatgtttactgacccagaacgttaaaactcaagtttagttcaatacagtcacttcaaaccaacttaagatagcagttacatttccaaggtcattatgaagacggagttcaagacttcagcagttgaatttgtcaagctcatgggtcttttagttacaggaagtgtgcatatttcacataagaaacagcaactctgatgatacattgaaactcaaatatacccaaggagtgtaaaactactttataagcccttaaacaataaatatgccaacaatcctctgcatactttttgtcattttttagagcattcaattgaattatataacatgtgataccaataaataattaactttttatttatttatttagagaatgattcttgctttgtctcccaggctggagtgcaatggcatgatctcagctcactgcaacctccacctcttagtttcaagtgattctcctgcctcagcctcccaagtagctgggattacagccatgcaccaccacgcctggctaattttgtacttttagtagagacagggtttcaccataatgatcaggctggccttgaactccggacctcaggtgttctaccacctcagcctcccaaagtgctggtattacaggcatgagccacagcgcctggcttataattaactttaaaaaatattctactatcgaatgcctgaaaaaatcatattacttctatgtattaaaaacaaactattacgtaaatagaccagagatacggtgtcagagatgagattccttggcaacagtctctgagacaaaaagttgcacacagaaagtattttgagaagtattgttgctatttataaggaagtgaaggaggcagtattgggcagagagaaaagctcatccacactgcagttgctactgaggcttcagcccatgtgacagggacactggagctgggatggtctttcagagttctaccaaattgaggcaaatgggcgagacttttgtatctttgcactagccaagagcaggcaccagggagaaatgcagctgtgatccttttgtagatattattattctggagtcaatgcaaccacaccacaaatactaggaataatattggtagtgtgggtgcatcgactccagaagaggatcttgatgaagcattacagtatccactacagagaggcactggcatattctgcttaccccacaaatattgcaatgaggatgcaagtaggagtagtgaggacataaaataaatcgattattttccactgggccttaatatatcagaaccattggaatttacaggatgatatttattatagtactcaaaaaaatctcttttaaatctccttaactcagaagggaattttaaaaagtccacaattcacctggtctatgaattcccttttaaaataaaatgtggtttaatcaaatttacaagaaaaaaacaaacaaccccatcaaaaagtgggggaaggatataaacagactcttctcaaaagaagacatttatgtggccaaaagacacatgaaaaaaagctcatcatcactggtcattagagaaatgcaaatcaaaaccgcaatgagataccatctcacatcagttagaaaggcgatcattaaaaagtcaggaaacaacagatgctggagaggatgtggagaaataggaacgcttttacactgttggtgggagtgtgaattacttcaaccattgtggaagaccgtgtggcgattcctcaaggatctacaaccagaaataccatttaactcagccatcccattactgggtatatacccaaaggattataaatcattctactgtaaagacacatgcacacgtacgtttgttgcagcactgtttacaatagcaaagacttggaaccaacccaaatgtccatcaataatagactggatacagaaaatgtggcacatatacaccatagaatactatgcagccataaaaaaggatgcgttcgtgtcctttgtaaggacatggatgaagctggaaaccatcattctcagcaaactaacacaggaacagaaaaccaaacaccgcatgttctcactcataagtgggagttgaacgatgagaacacatggagatgggggaggggaacatcacacaccagttgggggattggggggcagagggagggataacgttaggagaaatacctaatgtagatgaagggttgatgggtacagcaaaccaccatggcacgtgtatacctacgtagcaaacctgtacattctgcacatgtatcccagaacttaaagtataatttaaaaaatgtggttgaaaaacaaaacccacataatacaaactttgccagcttaactgttttatgtgtacaaaccagtagtgttaactatacatacattgttattcaacagatctctagaatgttttcatctctcaaatccgaaactccaaacccactgaagagctcccattgctccctgtaccccagcactggcaatatgaccactctactttctgtctctaaagagtttaactactttagatacatcatataaaaggaagcatgcagtatttgtcattttatgactggcttatttcacttagcataatgtcttcaaggtacacccatgttgtagcataggaaaggatttccttctttttttgtggccgagtaataatattccgttgtgtcctataccacattttttaatccgtttatcaatcaatggacattttagttacttcaatttttggctattgtgaattatgccgcagttaatatgagtgtgcaaatatctctttaagatcctgtttttaattcttttggatatacagatgctcattgatttacactgggattacatcccaatcagcccatcataagttgaaaatatcatgtcaaaaattaatttaatatgcctaagctaccaaacatcattgcttagtctagcatactttaaatgttatcagaacatgtagattacagtacatctgggcaaaatcatcttgcaacacagtacatagtagagtatcaattatttatcctcatgataaatatcatgctgcaacccaatatgtcagaagagagtatcatactgcatatttactagccctagaaaagatcaaaattcaaaatttgaagtatggtttcttaatgaatgcatatcgctttcacaccattgtaaagtccaaaaattacaagttagaccttagtaagttggggactaaccgtacacccagaaatgggattgctggattatatgataattctatttttattttttgaggactggattatatgataattctatttttatgttttgaggaacttccatacggttttccatagtggctacaccttttcacattcccaccaacaatgcagaagtgtttcagtttctccacatccttgccagcacatgttattttctgtttatgatcgtggtcatcctcatggttgtgaggtaatatctcattgtggttttcgttcttcatttgcatttccccgatgattgacgatgttgagtatgttttcagatgcttgttggctgtgtatatattttctttggagaaatgtctatttaaatccttgcccattttaaaatcaggttaattgtttttggtgaattccttattaattactcacctcagagcctttcttcttaaaatacagatttctcagaacctttcatctaatttactaaatgttgatcttgaagaagtattttaatttatctgaatttagtttcccgttctataaattgatagtaatcatgttttccctatccacaccagagtggtatgatgaggaaccaatgcagaaaatgactaaaaaggcatttttatgctgtccagatcttgtgcaaatatattataattgatttgaaccaaaagaatctacattttaagactatttaatattgtcgcatttacattgcactaatggttcctcttttttctcactgatgaagttctagattgaaactctgaggaaactgtaaatcacagttacataactctgttatattaatttatataacttctctgtctctctctaaatatatatatttagactatatatacatatgcatatatatatttagagagagaacgagattacacttaaggactctgcttagtacattgcaacttgcacctcattctaattgtgaaaacaacaacaaattttgattgagaccctgttatttttcagacctttggtcttgtgaggaaggaaaagatgattctgatacttatctcaaatagcttatcatctcctctggtggatgaggcttgtgagggcctgacacatggtagaggatcttattcattatataacaactttcaaaacacatcactaattatttttctgcttaaggtgaaaacgtagctctcccaaacaaataagagatttagactgaattctgtagaaaacactgcttacctcattttgcttagttttcactgcagagtcttgtctctaacattcaggtaggaggaactctattttaaaaaattgaataaacaaacccaaatcagaataaattatttaattcaggagttttttaaggtgctcagaattttggtagaatagcagtgtattttctgtaataagaactacacaatgttctctagctggttatactcaaatggttatatggattttattctgatatcagttttgcaattgatgaccacccttcatcaatagcgtggtctttattatggtttcatctggctttttcttcccttgtcttctgcactgggctgcctacttcttggctcttattattacatactctacttttttcatatacaaaggtcttagtgcattaatagtgagtttctgctaaaagtgttactttcttcaaatatcctgtcaaatgctggctgcctgatttattgacctcatagagtgactatgtgaatcttccattctctgtggaattccattccacattttaacttaaagactccgtcttttccagctgtgttctctctgctggataagcatttttcttttaatttctgtggtaatgggaagggaattttaaatcctgttttgcgtacaagtgtttaacaggtaaaaatggatgctgtgtcagctatctattgctgtgtaacaagctaccccaaatgtagagacttaaaataagaatcattttttttttttagctcatgattcttgattctgcttggggcttggttcatcgaggcgattcttttgctagactcagctgtgctcattcatgcactcgtggtcagctggtagttgatgaccacatgtggcattcatatgtctggtataactttttggttataagttgagacggtgtgggtgacaggatcacttgcctgtaattattcatcaggctagcatagttccatagcggtggaagagttccaagcatagcccaacacccgagcattgttaagcctctgcttatgtcatgtttgctgatacctcattagccgaaacaagtgacttgaccaatccatattcaaggagtggagaaacagactacggctcttaatgggagaatctggaatatctcttgacaaaagtgtagatgcaagaggagaatctgtggacatttactctccagcagagatgttgtcatttttgtcactaagacagttcctgtgtaatattatttattattccttggcagccataagtttgtggtttacttatggatacttcagtgcctgcccaatatcatgttggaaagagaagcccttaacaatttctcttaatttctacttctgaggaatgagaaaaaaaaaattggataggcataaatgatttccagcacaaattctaagcagctatttgagaggtgggtgggtagggagagatggaaaatccttttaattgagacatgctcaaccataagcaatttttctttcctcaggagacatttggtaatgtcaggagacatttttggttgtacatctaggagggagctctggccagagatactgacaagcaattctgatcctacaatgcacaggacagccactcacgacaaaaaattatctgggacaaaaatgtcaatagtgctgagattgagaaaccctgcttttcactgagcgcatgtagatgaattcatataatgttagttatagaagggcacttagatgatttcaactaaaacaggaaaaggcaatgattatttctctattcaagttagtgaaggaaggatatgtttaaagtcaggttggagatatttctcaagggtaatatttaagttgtgagtggatgccagatgcgcttgattgttacaatccatatttttatagctatatcaaatgatcttctctcccaaattaaaatggatattagatatatttcatggataccatatattataagctatagctcttagaagtatttgagtgattaataattcttgcatattgaatgagacatgtaagaaagatacctgatgtcctatgattcttagaaatatgtgcagtggttaagcacattgtcttggaaacatcacttgttaatgtgagatcctgaacaagtttcgttaccttggtaaaagggggatgataacatctaccctgaagatggtttggtaaaggtgaaataaaagagggtttatgaagaaccttgcctagcacataagaatcactgagtaaatgatgggggtgatggcagtgttggtggcaattatcttacttgtaagtagtagcaaatatttatttggattatatttttaatagcaagaaagaatctattaaaatgtaagcaaatagcaccattaagctttaaaaatccatagctcccaaacttaacatttttttttcttaaatccagaaatacaaatggttatcatgaatccttgagttccagtactccggccttgcctatgtagagtacaagcatttatttttctaaaatgagaattattgatgttaggtgtgtcatatattttatttactctttagagtgacagaaaagaaagcagacaaaaataagtgtttatgtgttcatagtgtttgtttctaattttccaacttgtatgtgcagactgtaaatatttagagggaagacatgaaattcttccttacctacacaatagattgtctttcttagaatctagacatgatttcaaattttcttcagaagttctcttgaattcttacggaattcattaatccaaatgccatcctttcaaatattcaaaaagaaaatattctccaatgttgcttacatggaggagagttattttatctactagtgagatggaagtcgctaacaatctttcttataccccatagtattaaatagtaatgcaatttgatcacatataacattgctctcctgttgacatggaatgataaggaggaagggaatatctaacagcactttttagatattctctcatagaattgttaatgtgagcccaataacttattttgtaagttgagtgatttttcaaatataaaagtgaagcaaacaaaaaaagttacccacattcattcaacaaagctagaaatagagtatgtgcttcttgctttcttatcaaccaaaggagacctgtgaattacaggaaaaccatgtgtgaatacttcaaaggaaatatgccaaacacattgtgtgtgtgttttaaaagacttagtagctcctttaaagctctaagtaaagctgttagtctgactaatcatgtacccctgaaaccaattaaattttcagactagagaagtgttcttcaaacacttgaaaaaaataagagttccttcctaaagccaacaccttttaattaacaaaatactcagagcaaagctgtggtttgcaatagtatattacacctactgttattcatgctaccattctggtgtgccaaactcaattcatttcaactattttgagcttgattttctgtctgcttaactatggagggaaaaccacaattttagtacagtcattttaattttctaatgaatgcatgagaaaggtattatgctacatagtatgtcctcagactattcagatgccctctctctctcttgctctgtctctgtctgtctctctttacacacacacacacacacacacacacacacacacaatgtgtgtatctatctgtctacctagatatacagtttaattttgtacattgtaatacatctggttctggcataaggtgattgagcaaaaaacaaacaaacaaaacccacccaaatctgttactggaggaacctttaatagcataacatcagaaagactattttcagtaaggaccctaggcaggaaaagacaattcctccaatggacttgagaagaatacccttagtctctgaggtggttagagaggctgagatctgaaccagctaataccagagccagcttcttgtaacccaagataggggcataagaaacggggtgaatgcccaggcatgaacagacttggggttaagattaaatagggtacacaggaaaggatttccgccagctggaggggaagccatttcccatgctccttagggatgacaacaggagacccagcccagaacatcattgaaaattctatgtaataatttatatatcctaactctttacccgttcgttctagattatggattcaggcactcttagcaaaacaaatcctctttcagtcttttaaaatattgacttaacaggaaatatccttggcacaacaatacgaccctgcctgacccttagaactgtgaacaggttgctcagactgtacaaaaccactaacaaatctgaccagcctacacttcactgaaaaaggtgatttgcatatatttctagtactatgacatggtggaaaagaaagaaccgcatatgtgttagataaaggtaaacgcatctgaaagtgcagtaagaatcaatgtgatatatacaataaaataagataaataggccgggcatggtggctcatgcctgtaatcccagcactttgggaggccgaggcaggcagatcacgaggtcaggagatcgagaccatcctggccaacatggtgaaaccccgtctccactaaagtacaaaaaattagttgggcatggtggcaaatgcctgtagtcccagatactcaggaggctgaggcaggggaatcgcttgaacccgcgaggcagagattgcagtgagctgagatcacgccactgcactccagcctggcaacagagcaacactctgtctcaaaaaaaaaaaaaaaaaaaaaaaaaaatttcaggacttcaaaacttctgtcctttgaaacactttgattaaaaaatgaaaaaaatatatacatgcctgaatccagaggcaagtctttttagaaaacataaaatattttaagtaatgtttttctgaacagaaatggctctaatgtgagaggtcgatgaagattagcctcttgcttctttatgttttaaagtatattccttgagacccaaagtttctgactttagaatccaactctcaactactatcagctatcctctagacactttcaaaatcctccaaaacctaatagtggtgcaagattttgtccttcctagtgataactagatttaagtaagaaaacgttaaagactaaaaagtgtttaggacccacaagaaaggtgtaattctgttcctcatggagatattttagttacacacttcttattctggtcctccccaaaacacagaaatctagagttgacatttaaagagaaaatgagatttttgtctggaaacaggagagaaaaagttttcaagaagtatagaaagcgtatgaaaggacacaggtttgaaatggcctgtgctcatgagagaatgcacaatagacatgggtgtggaggagcctggaaagaatggagagaggtaagtctggagggtcaaatctggttcagagtacagagcataaaatcccatacgaatgtagaacatgaggagccaataaccattgtgtgagaaatgcaggaaaaagaggaagaaaaaaatccacatagtgtacttacagtcagaacaatcctaggaggtgacttacatgtatgatgtcataaaatccgtaacacaattccattagattggtactgttttcatagttacacaggtgaaaacttttgagggtcaagatgttcattgtagcaggcatagtataattccttacctcaagatgcctccaatgtcagtgaacattacttttccaagattgtctatttaggaaaaagtaaggccagttgtctatgaaggaagtactattataatcgccactttacagaggagtaaatggagattcagagaggttaagtcatctgactatagttacacagctaaaaaaaaaaaaaattatagagcaaggattcaaatacaacaatctggtcctagaaagcctaaatattctacaccctgctttctgattcagagctatttcctgcttttctcccttcgataggaaaaaaaatgtatgtgtgtggggttgggggcaaataaattgactggctgtattttctctctttaatatttgatctttcattgtctgctccaagcagtgggtcttcctccattatcttctcatgaaaatagctaaaatcacctaactagtaaaaacctaggcatgttttgtgttctagcctccattcttccattctaatgggtggctgttaaattttagtactcattgtatgtagaagacctctaagttcactaaagagcttactgcacattgacttttctttagattcaaagggaatcaattgagcacctcctatactccaggacatgtgcaagatgcaagagatagagcagtgagaaagtctgataaggtttcccctccctttcccagcagtgtacagatagatgttcttcaggtggtgcatgctggagaagagaagaccagaaatactggcctgacgggtctatagatgagattatctgcccatgactggcgcagggatggccgcattgctagacctctccatcatcctctgaatatgcttcagctaatttatcatcccaatggcatatttagtcatcatgaaccattctctctttttgagtctcaggccctggccttgcttttcaatagacttccaatagattccttcctccttccttcccttactgcctggcttcctgacttccttccttcctgccttcctgccttgtcatgccttgcttttcaatagattnnnnnnnnnnnnnnnnnnnncaaccaaaacaaatccctccctccctccctccttcctccctccctccctccctgactttcttctttccttcttcctttctgtctttttccaaacgtgcttttcaggaaacagtggtctgcttgttgaagtctgataattctctagttcctcatccttcactttattgaaatttagtgtgacatgatcatttccacctcattaggtacttctttcatggtcagaagtaagtctggagaaaaaaaaaaaatctcttgtctctgctcttatttgagggtcaaattttcaataagtcactttttaaaaaagcattttctgacacttcccataagcttgaaatcctcctaaattgctgtatattgcctcagtataccttgtgtatctattttaggaacactccatccacatttgccagtcagcctggtgttcttcagttagttcctacagtgatattttaatttagctctcttttcatcctcacacatgcatcctctctggatatttagctcctttcctggaatcccttttaagatttctagatctttttgcttccatgatttcttctcctggactgtgacacaaaatgctatttcttctttacattacatttaattctttctagaaagagcctcagagtagtcagatagctttgagaaacaaaactttttctttattgcctcactgttactgcctttcaatcattgtttcgtgacacaaatttttttattctctctgacaattaaaacactatttttttctgtctgcattgatcaaaattagttccttcattcatagaaaactcttggtgtccctgagaagcttgagagacaagaaacattcttccattctactcatcttcttctctaatgaggagacaaccttaaaagcacagttacatagccataaaaattaatgattggctacctcagaatgaaaattcaatgtctcatttttttttaatattcttagaatcgttcactggttgtccagtgtgagtctcctgttgagatgtcttttgcagctttccttgaaacctttcattccaaactacatagtccaataattttgccaccaatcttctggttatattatgctcttgagtctgttgtctataaacttgattaggcattccttcccctcaccactcacctctgataacccagctgtgtgttggtatttagtatcaattcacaccagcaagttcagccctcttcaatcaatatagggccacacacggacttttgactgactactccccaagtatttcacattttggggccttatctccagtttctcaccacagttgttcatcactgtgtttcttactagccaggcgtttataaaaacagtaatacctaacactattgatcacctactatagtgtcaggcgctgtaataatattattgtgatgatgatgattatgctgctctttctggcattgtcatacgtgtattgcttgtactactcactgaatctacacaactgcccttatgacatttaccctgttattattcctcttttaaggtaaatacatgaaaaatgcttcccactttgccttgcttactgcttattgctagtactgaacaaaagttagaactgaaacttagagaggttatgtggctttaccaaggtcccagagttcctagggcagagaacaggattgtctaccaggcattttaattctagtactatgcatcttaaccattaccataggctgacttactctacagtgtccaacactattcatattaagatttatttaatgactttgaaacagtatttcatgtctaaatagaaaaactactaactcgcatttttaagaaaatattgtatcttggtttttcttcactgctggccagtttactaacaatctgaaataaaaagaaaaaaatatgataaactgctcccagtataaaatacagagctaagacaagaacgtttcattggctttgatttccctagggtccagcttcaaattaatttacttcctattcaagggaattttaaatcagaaagaagatcttatcccatcttgttttgcctttgttttttcttgaataaaaaaaaaataagtaaaatttatttccctggcaaggtctgaaaacttttgttttctttaccacttccacaatgtatatgattgttactgagaaggcttatttaacttaagttacttgtccaggcatgagaatgagcaaaatcgttttttaaaaaattgttaaatgtatattaatgaaaaggttgaatcttttcattttctaccatgtattgctaaacaaagtatccacattgttagaaaaagatatataatgtcatgaataagagtttggctcaaattgttactcttcaattaaatttgacttattgttattgaaattggctctttagcttgtgtttctaatttttcttcttcatcttttttcccttttgcaaaaacccaaaatattttagctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggtatgagaaaaaatgataaaagttggcagaagtttttctttaaaatgaagattttccaccaatcactttactctcctagaccatttcccaccagttcttaggcaactgtttctctctcagcaaacacattactctcactattcagcctaagtataatcaaggatataaattaatgcaaataacaaaagtagccatacattaaaaaggaaatatacaaaaaaaaaaaaaaaaaaaagcagaaaccttacaagaatagttgtctcagttaaatttactaaacaacctggtattttaaaaatctattttataccaaataagtcactcaactgagctatttacatttaaactgtttgttttggcactacgcagcccaacatattgcagaatcaaatataatagtctgggaattgattattatccactcttctaagttgtctgtgccaatttgccttctccaatgataaggataattgaaagagagctataacttaaaaagagaaaagtaacaaaacataagatatttaaaattaccctagatcttaaagttggcatttatgcaatgccatgttcaaatgaacatgtttttaatacaaatagtgcatttttcagcctcagtgtaatccatttggtaaaattatgacatcaactagaaacattagaatacattgatgtaaatatggtttacctagctagatcaaatatactatatatcttttatatttgtgaatgattaagaaaaataatgttggaattgttatacattaaagttttttcacttgtaacagctttcaagcctttctaaagaaatacaaagttgtgctgaaggtatttaggtattaaagtactaccttttgaaaaaacaagaagtgaggcagacagagtaaggggaatttctttgtaaaataaacttcaccaattccataggaataaaagtaatttgatagtaaacaacctgcatttaaaggccttgagcttgaatacagaagacctgaattcagtgccatttgcaaatgatgattgtggtcaagccatctctggatcttcgtttcctattctgagtacagagcatacagagtacacattcacattcacaatatagttatggatatggatgtatataaatatatgtaaatactacatatatgtacctaaaatttgttttacttctgctttaaaaaaagtaattatagccacatttttcagaaaaagtaactgaggctcatagatgtcaaattcccagtaagtagcagaacaaggattcaaatccaagtccatttgattcctaagcttgtgttattacttgctactgcagagagtatacgtagcaagtaatatatgtactgcaagcaatacatactattgctgcggtaataactgtaactgcagttactatttagtgatttgtatgtagatgtagatgtagtctatgtcagacactatgctgagcattttatggttgctatgtactgatacatacagaaacaagaggtacgttcttttacaataccatattgagttatataatactcccaggacttttatttaccaaaggaaacaatattttataatgtttaaagcccaggttttgaagttacattgtctgggttcaaagcttggctcccaagctgtgtgaccttgagtaagttattctgcctacctgagcccaagtttatctagctataaaatggggatagttgtactatctgccttgcagtttgtcatcaggattaagttggttggtacatgaaaaatgcttcccactttgccttgcttactgcttactgctagtattgaacaaatgttagtaattatatttggttccaccacgaactctagaaatctaaccaatgatggcatttgtattatgcaaactgtatatcacatcataatattatatggaaatgagagcttgtttccgcttctgtagcctagtctaccattgacatagcttcctgcagaagttaccagataatagattgggagagaaagtccacacttccttgtgacgggtttgtgagtccagcatttagggaagccattgatgtgctcagtagtctccagagttctctaaataaatgtgtccttttcagaaaggactactgatttgatgccccctcacagagatcgtctttaaatataggtcaaaaactaatgtagagggccaggtgcaatgtttcacgcctgcactcccagcgctttgggaggctgaggcaggtggatcacttgaggtcaggagtttgagaccagcctggtcaacatggccaaaccccatctctactgaaaataaaaaaattagctggtgtggtggcccatgcctataatcccagctactagggaggctgaggcaggagaatcacttgaatcctggaccagaggttccattgagctgagatcacaccattgcactccagactgagtgacagagtgagactccatctcagaaaaaaaaaaatttagggggaaaaatcaaaagccatttctgagacacaaaaatacaggatttataaattatatatggtatatataaaaatatttttaaaatagtatatatagcatattatatataatgatatgtaatgttcatatattacatatttataaaaaaatctaatctcccttctcttgcttgctgaatagggggatgctttgcctgcctcttcctcttatattaaaaaataattcttaaagacattgtcagttcttggcttttatagcctcaatcaccaaattgtcggtaaaatggccctaaataatcattaaacaaatgtgtgtgagaggggaaataagaaggataagtaagtatggggaggattttgttataatttcaggaaatcaatatcaattttatgtaaagttttaaataaagcaatcccaactttaatgtttgatgtgtgaaaaattaggcaaaattccaaaagggctttataaactgaaaaaaactttactaacacctatccatttttattattttaaccaacttctattgagctgccactaagtacctgggaaacataaagttgtacaacatagaatgtgcaggtaaaagaggttgaaggaagaaaataataacactatgatagagataaattttaggataatagctaacacatatgatatgccagtcattgatctaagtacttcacgtgaattctttaatgcttacaacattactgtgaggtagatagagaggcacagtaaggataataacctgcctgagatcgaggaagaaagacaatgatgagatgtgaactcaggcagtttggttccagagtcctctcccttaaacctcatagttttcaacttctctgatattgtgtgggtgatgctgttggggctttcttcagggaaaactaagccaggagagagaatggatgctagtgagatattcctgaagaaggaaaaacttaagccaggcattaaagaatgagttggaattacctagctagataaaacgagaagggcaatccaggcagagggaacagactgtgcttttcactgaggtggaaaaaaaacagagtatatcagaggaattgtgattccatatggctgaagttaagggtatatgatgaggaagaaattgatgaggttgaatagagaggactggggctaaataatgggaatcctttgttgccagactgaggaattttgatgatggcctacaggcagtggcaactctgaaaggattgtaaacaggaaaataaaatcatcacatatagtttagttgcctatcaattagagctctctggatgcaagcaacagaaatcattctctgattaaatcaggcagaaagtaaatgtgctgtaattagcacaaaggcattggaacaaaacttacaaaaggaaaaagaatctgagcatgcctttctgggcatgtggctagcaagaagtattccagtctgtttgtgatactctcttttctccatcctgtgtgtaactctgttcaaattttaaagtcttaaaagagagtccagttcaccttgtttgggtcacatgttaatacatgagctagaagggagcagaaaactttgatttaaatccctctcctcccaaagtctcaaaattagggaaaggcaattctcctgaatagaaactgggttctattgacaatagaagaaggaaatgattctgaccaaccactaaacaataattgtccactgaactcagtcaagaacatgtagaataagttggaggatagagcaaataaaggagatttgtaggaggtaattattatgatctaaagcaagcttgttcaactcatggcctgtgagccacatgcgtcccaggatggctttgaatgtggcccaacacaaatttgtaaactttcttaaaacatgagatactttttgtgacttttttttgctcatcagctatcattagtgttagtgtattttatgtgtggcccaggacaattcttcttccagtgtggcccagggaagccaaaagattggatacagctgatctaaagcaacaggttcatctactcaacttcacaacgtgtagacctgaaataaagaccattcatataccaatacctgaaatataaatttgtttgaccatgacacgtacagtaattggttctcaataaatgtggatagcttgatggataatgtgaatgcaatgtgataaggaaacttcatattcaacaaagactggaatgtgaggattataattccaaagcaccagaagatagataagataatgcaatgagacattttatgactcaaggcaaagttagttatgagattcagaccaaaccttagacgtgcagtaattgaaatatttgccacagaaggggtataaggacatgacattcaagtaagctaacctttcactagctttagactttgaactcagaaaacatatttggtgaaaagcttatggtcccctttagtatgtattgcttgattaaagtattattttagaaaatggtgagctgcttccattttgaaataaaaataatttttactaagtgaattatattcagtgaaaaaaatggaagctacaattacaactttaatttttttaagttttaagaatacagccatttaaaaaaattaagcaaatctgcttcattttagacagtagaaaatataccattatcttttagaagaatagagatgtgaaatatgcaaattaagcctttagaagtaaagcacacatgaagttcaaagtttaatttctagaattgtgaatcaatagcagtggatgatttgtactttatagcttagtgtcggagaaatctgattaaaaaatgctttttctgtttcatcacataaacataagtaaaattgctctgaaacaacaatatttgacaagaattagcagttttcttttttgacataatctatcaaatgaagggaaaaatatgtcctgggttttgctttgagagtgattactaaatctgacccttaaggaaaggaaggagagaacaaagaagggaggaaagaaagggaaggaaggaggaggaaagggaaaaaaagaaggaagagaggaaggaaagcaggaaaaaggggaaggagagagaaaagacaaaagaaaggtagcaaggaaagaaaaaaagacaagaaaggaatattaaagaggacaaaagaggagtgaggaaaggaggaaatggaagagggatggtgggagacaggagggagaaaggtggagggggaaatatgaagagaggttcccagcagtggagactagtgttgctatcaacaaatagaatttagatggccatatgatattatttttcataatactggtgtctgattgcctgtgctgagttaattgtagtcttttttttcaattccgtttggccaggtgttcaggataattcaccacaaaatctcaaccactgcacttgtattgaataaagaattgagttggcaaaggcattttatcctccagtaagacctttccagattggggttgagacaaattggccaatctggacaagatgataatagcattgttcaagattaatttttaaccacacattgcactgttacctgggagatttcattatctaaaaattgaatgagcagttttagtgggtatagtgtatatttaaatgggacataattacttgaatgagtttaatttttgttgttgttgttaaggtcaaagtacttaaaaattatgattttttaaaactctgtctatacacaaaaagcatttgaattagctacagaataattctgattataacttttggtgaatagattcagtcaaaatctgattactaaacaacttgtgtagtatagccctggaagaattgatgggacaatgtgtgggtaaagtggcattggctatttaaactaaaagcaatacaaaacagaatgtttcttggttttattctgttgtcacaaacccagcagaaagtggctattacaatagtttcccttattcaacaaatgagagaagttatagacaatttagttaattgatctaaagtcacttagtaaatgtaattgtcctaacataaacccagacccccagacctcttgggaatagataatgtttcttacttcttttctatttcctcagccacccccctcaacttcttacacatctcatttctccatccaaattataacaaaacaaagcaaacatggtttatttccatgggcatcaaatggatttcacgaggttgggtgacagtcatcttagggtgaggagattgattattctgtttttctctttcatcgatcaacaatccagcccttctcatctcatcatttcatttctgcacaaacttgtttaagaaataccaattaagaaattaattaagaaattaatgttgtaatctgtttggctgaagatatttacaaattttgtgctttaattatcttccaacaaatgtacatgtctctggtagacagcttgcgaccatctggatgactgatccatatttatataattttctttctttacctaatgagaccaaatccactattatcttcaacgaaggatgtaaagatatgtcagtgtcagtaatgtgacttattttatattctctggtcataacaaaaataaaccgccccttaaataaaaaggtcatagagttgcaaacacacacacacacacacacacacacacacacacacacaaaatcatattttctaagtctcctaattacctttttatggaaaatgataccatatgcttttttcttaaagaaactacataaacttataaactatactaaactacacatttcaaagtctatgaatggaaatgtgtatcttattatattttaattcaattcactgtaaacttttctgtcaaaatcttatcaagcaaaactgatccaggatatttacatgaattctgatggaagtcactgtactgtgttttccataaaataccagtgggattctgataaggaagtttatgtttgccattgtgtttaaatagagaattctgggccgggcatggtagctcacgcctgtaatcccagcactttgggaggctgaggcgggtgtatcacctgaggtcaggagtttgagaccagcctgaccaacatggagaaaccccgtctctactaaaaatacaaaattagccgagcgtggtggcgcatgcctgtagccccagctactcctgaggctgaggcaggagaatcgcttgaacccgggaggcagatgttgcagtgagccgagatcacaccattgcactccagcctgggcaacaagagcgaaactccgtctcaaataaataaataattagagaattctatttacaaatttcctttcttggatctagttagggctcctttatatggagtgatttttattgttttcatagaaatacgtagaatctgggtcttctctaactttcttacaggaaagcaatgtaataaggtttttttttaattttctgaaagttatataatgttattgttccctaaagtttaggacctgccttttaggctttccatttcaccataacttttggtccttaaagtctgtaattgaagttacagtgtgttatgatgtaaatttttcttattattacctttaatgttagggtaatgttaactaatgttaatgttaggtatatggttgtttttttcattccttcgttcaacaaattgtctttgaaacccatgttacaaagcactctagagtcaggttgaagactattaagaaaggagaatagaaagagacactagagtaataatttggatttaaatttgatttccttgtgtatgatagtgaataagtgtgaataagatgaggcagtgatcacacatcactattagtaaaagtgtttctgtacctgtatccacacttttatgtatatggttacttatgttaaagtgatacatattatataaaattaacgtatacattaagtagatattttaatagtctgtaattaaatactactagtattttctttcctccttcaagtgcttacttttgatacctcgagttacagtgtcataaagattctttagaaatatattgactgtcttttaagagcttttgatacaatactgagtttacattcatctgttatttattgaacacttgctggtgaaaggcatcagtgttatctgctcttagggaacaaaaattaaaaagggataggccctaattttagagtgtatcctctataagaaaaacataaaagatagggcagtcatggccacaaaagaaaaaagtgttatggtggtttcaatcatatatgtattagaatgaataaatcaactgatcaattgtgatttcttattctaaatatgtgcctgcctttttcatatagatgaaaattaagctatgtttatctttccagggatcttgttgatttttattcaataacttgggagtgaaagttgatttttgcatatgttttaatgtttttaaatttcataaatgaattgatcagtaatttccaaggtagtaatggctgcattgtttttgaaaaaaaaaaagcaacaggatttgattgtgcttttatgatttttaaagaattcattaaaaataatgccacggtttctaaaatgatttgagtcaatttcttattcgatttataaaaataactttgaatacaattttagtaattcacaaatgctttcagttcccttacctttatattttatattctgtgtaaacaagtgacataatatttaagaattatatatctcctatgatttattcaagaaaagaatatatactgtattatttatttcaagaacagaaatgctttgatttaactgtcatcttctctcttcaattatggaagcaaaataaactgtaatgaccaatgtaacccctcccccatatcaagttaatctatgttcaactccagaattatttttgaacactcaaactagaaattaaaaaaaattaaatccatgaagacgatttttgccaaaagcatatagataaattgagttgattctatacttaagaaagtggagaggagagagtaatttggagagagtaatttactcttaatcccatattttttccctaaatgtgaaagaagtagattgtagtgagagggaaaataacctgtagcaacttcattgaggctaagctttctgtcatgttatattatacgaaagtaatgaaatgcttccacagatagaatcagaagtcccctctgagaaattctacataaaaattagcctgccactttaccacacttactcaagtttgatttttttaagttatgtaatagatgttaggcactagaagaggacatttactgggggcaaagatcagtagttggaaagaatgcaagcaggcaagaagctatatataatgagattttacagtacaattgttttctaaatgaaaatgaggacgggtccagacacaatggctcacacttgtaatatcagtgccaggatggaggatcccttgaggccagaagttcaagagcaacctgggcaacagagtgagacttcatctctacaaaaaaatgaaataaaaagttagctggctgtgatggtgtgggcttgtagccttagctactcaggaggctgaggtgacatgatctcttgggcccaggagttcgaggctgcagtgagctatgatagcgccactggattccaacctgggcaatggaacaaaactccatttctaaaaaagaataaaatataaaactaaaataataaataaataaaaatgaggatatattttattttaacatttggaaactttgtaggtgaggaccatgcaaacattcaaggtgtgagttctgaccaaatccaattattaaccataccaatgacttaaggtttcttcacactccttaaagttgattaatataatgattatatagttgactggtatgtcacagcttgaagcctttgagatttattcctgccttttctgtaaaggttgttttgttaattccagtatgtactggtcgtttttgttttgttttgtttttgtttttgttttgtttttttgagatggagtctcgcactgttgcccgggctggagtgcagtggcacgatctcggctcactgcaacctccgccacctaggttcaagcgattctcctgcttcagcctcctgagtagctgggattacaggcactcaccaccacacccggctaattttttttatttttagtagagatggggtttcactatggtggccaggctggtctcaaatacctgacctcatgatccacctgccttggcctcccaaagtgcggggattacaggcgtgagccaccgtgcccggctgccaatatgtattggtctttttcatcaatgattcagtccaaaatcattttgtcctttaactatatattttcttgtaaagctgcttctgttgtcttgaacttttcttttcaaatgtatgttgtcatttgactttttagattgttattttctggtcctcgaaataaatttaaatttcctgtaaaggaaggtgtaatattctatttgacatagccgctaaagatgtactaggtgctttataaatattgttgatttactttatcttcacagattactagttttacttagtatttggaatatgacaacattttatagagctatattcatatatatgtttatcttaactgttaaatgcaatatgattcatgtcttgttttggtcaatgatgaatgaaagtctcctgagaattaaatttactgcatcgatgcaaaaacaatcataattttagacactctaagaattttagaaattaaaggattttttttttccagtttactctgttaagattgtgtttagctatgcgtgacagcattctcactacagtggcttatccagatagtttctttttctcatagagcaagacttccagaattatgtgttccagggtcagtgcagcacctccaaaaccgtatgtcccaactttttcctccaaccccagtcatctccaacatgagactttctttttgttttgttttgttgtttttgtttttgtttttgttttgagatggagtctctgtcgccaggctggagtgcagtggcgcgatctcgactcactgcaacctctgactccctggttcaagggattctcctgcctcagcctcctgagtagctgggattacgggaacgcaccaccacgcccagctaatttttgtatttttagtagagacggggtttcaccatgttggccaggatggtctcgatctcctgacctcatgatctgcctgcctcagcctcccaaagtggtgggattacaggcgtgagccaccgtgcccagcaagactttttttcctgtggtctcaacatggctactctgcctccaggcactatgtctgtactttaaaatggaagaagggaaaatggggaaagtaaaagcatattccagctgtgtcagctcctgtttgtaaggaaaaccagtgcttttctggcagccccacacagaagagtttctacttgaacagtgcattaaccagaaatgtgtcacgtgaccattcctaacttctaaggatcttgggaggattgagtgttttaactgaataggtgtgtttctttcttcataattcaaaatgtgaaaattggtaacttagttataaaaccttgctagtctgaacagaatttggatttttttagctaagaaggaaagaaagggtatcggataggcagctggctatgctagccaagatactcttaataatgcacatttttcttctttggacataagcagttttaacttagctaaatatgatgtgattgttttcctgtcttcttagttctgtttaaatttgtttcagaaatcaaggaaataaaatggagaaaaaactctattattcatgtctatctttctgcctctgaatatttttatgttggagaaagagaaagcagtaactttcataatagcttacatagtctgacaaattctaaacatgtccgttagcatcaatatacgtggtattaggtcatcagtttttatattctgaattattaagacccaaataaacccactgagttcaagagaaagtatacactgagcaataaaaacattaccagttctagcaatgataatcaaacaagaaaacaagtaatatagtctgtttagaataacatgttttaaagatcaagtttttcttccttaccaatgttgcctttcttgtaacacttttttttccttcttgagataggctttcctatcttttgtcacaaaccccaatatttacatggccattcgtagtctattcatagcagcaccaccccatggcccaaacttgtagatattgccctccttctatggttgttctaataagaataaccactcttgtctctcataatctcagctgttttgtgccgttaaaatggaaaataatgagtattaagatactaactaggggccaggcgcggtggctcacgcctgtaatcccagcactttgggaggatgaggcgggcggatcacgaggtcagaagattgagaccatcctggctaacacggtgaaaccacgtctctactaaaaatacaaaaaattagccaggcgtggtggtgggtgcctgtggtcccagctactcgggaggctactgcactccagcctgggcgacagagcaagactccatctcaaaaaaaaaaaaaaaaaaaatactaactaggtttcagtcatatgagatgaataagtcctacaaatctgtacagcctagggcttgtagttaacaatgttttatatttaaaactttgctaagagagtaaatctttttttacctgttattatcgtacatgcaaaaataatagtaaataaggaaggtaagagaaaaattttggaggtgatgcataggtttatggcatagattctggacatgatttcacaggggtatacagtcatgcattgctcaacaacagatatacattcggagaaatgcatggttagctgattgatcttgttgtgcaaacatcatacagtgtacttacacaaacctagatggtacatcctactatacatctaggttgtatggtatagcctattgctcctaggctataaaccagtacagcatgtgactgtactgaatacttcaggcaattggaacacgatggcaagtatttgtgtatctaatcacatctaaacatagaaaagttacagaaaaatattataatcttataggaccactgtcctacatgtatacagactgtgcacatgatagtggtccattgatcaaaatgtccttatgcagcacataactgtaattatctcgaaactcatcaagctgtgttcattaaatgtgtatagctttttatgtcaataaagtggttaagaaatcaataaagtggttaaaaaatattttgactaggaaatatactatcatttctagttgataaaagatctcaacatttccaaaattgtcctacagaaaaccaggttcatcaggtgttcatacatgatcctcatgaaaaggtcaaataagctgaaaaacatgcatagacgttgcctatcctagcaatctatgatgtacatctccatagtaaggtcactgaaaagtcttttaggaatgttagtattgttagctcagtatttctcagtgatttctccatggaaaccatttgtgtagagcatcttgaggagcacagctgagagaacattatcttagttggatgtgtatgtccctctgagtcacttgatttctctacatatgcttttaccaaattaatcttttagaaatcttttctcttcgcactatgtctataatttgtgaagttgttaccaggataacatttgtgcctctcaccatgatgtacctaccagggtccaagcagccattccttctctagagcaactgtctgagggaaagaatttaacacagcattctacgaaatcattttatttataaaaatagattactgctttacatatagtaatttatatttagaatattgattaattattaaaatctgcatgagagctttaaagagtagtacataatatatagcagtttgtactcaaactgtcttctaaaaaggattcactttttgtttgtattctattgtcctattcgttgatagtgttacgtaagtaattataaaacttaaaatctggaaagagaatgtggactcagaatgccatctcttttgttatttcaaatggattagaaatgaacatacatattcattttctttcattacacatccagagaaatagaatggattttataaatatgtaaaagcaaggattttgatcactgataaaaagggaaggtttggtcactaccttatttcattccttttttcttatcctttttttttttttgtcaattatttgatgacatctctgaacatcaccttttattcatgacaagaattgggtatcatggtaaagaacactgttaatataattcagttacttcaccccctcctgaaatatagagaagctttaagactatgtgaatatttttttctggttttcttgtatttgtagaaatagcatgagctttgtttaaagtcaggcatctaaaaccttgccctgtatgttattgacaacctgcacaaattttaggatctattctattacagtttgttcaactgtaaaactaggatagcaaactctatgtcatattttcgttatcagaatttaaaaagcatgttttaagatcttagtaaataataaatctctactctgtagttgaatttgttctatattctttaagaaattccctttgatggttatgccaacctctgtattacttttcttcacactttaactttgcgctgaaatcatagtagtattttacgttatcagtcaaaataacagtcatccttaaaacaaatatgaattttagatgattaaatagatttgtatggaggttcttcttgctaatcatagcagttatccttggtgaaaaatgatagacacttgaaaaaaccaattaatcatgatggctatttttgcatcataaataaagctttcaaatttgagagggaatcaaaagggcaatggtagtatagtgtctcaaagcccctttccaattgatggtacaaatttaaaaagagagagagagagagaaacatgtttcactgtaattgttttctaagagcttccaaaaaagcgtattttcttaatagattcaaatttttcagttggattgaaagggaagtcttggagtgtagtgaggagggcaccttctgttgagaggtgttcagacgacagagtgtgcccaaggccaaagatgagatggttttgcgaaagtcagtggccacaaacaggtgtgtttgacccctgagagatatgcaggaagtctaccccactttaattcttccaaatattctttaccttaattcccaagtacttgataaaggagcaatggggagaaaatatgcacactattatggaaaagttttgacctacactttggagagttttagattaagagcattctagaaatcagtcccaaatgcctagggtttacttacttaaagataatatcatagtttgggtgactgggaagcataccctgagattgaggtgagcatgcagtatgtctatttaggagtgttcttggggtcaacgtgtaggggcagagggagaagttgagctctgacgcagtcttagtaagggcctcagctgaccgttcagggagttcttaagctggaatgacccttcagaagtgctaggaaacgaagaaaggggactggatctttataaccccgtgtcaagtcatgcactggatgtgggctactccaggaaggcaacgaactttagcaagatgattctctttagccacgggaatttccataagggggctgctatggtctgaatgtttttgtccctccaaaatgtgtatgttgaaacctaacactcaaggtgatggtattagaaggtgggggtttgggggggtgattaggtcatgcgggctctgccttcagaaacaggatcagtgcccttataaaagcggctccagaaagcttccttgccctcccaccatgtaaggacacaccgaagatgccatttaacaggagtgggccctcaccagacaatgaatctgctgatgtcttgatcttggaattcccagcctccagaactataagcaataaattctgttgtttataaattacccagtctaaggtatttagctatagcggcccagactaagacaagggctgacagctgaaggctgtctaccagcagcactcctagcagctggggaactaagtccttcatttccaaaggggaatctaggcagcatatttacagcttttcactacagataagctcattatttcaaatagggactagcaggaaaaaattaaattgcccaaaatttagtgggatgctgaaatagattgtggtgtgtaaattggagtatagtgaggagagcaccttcaaaccagtatgtactacatgatattgtttttgttgcaatatttattatatacccaaacacacatatattacttttagaaacacacaccacatatatatctatgaatattttatatacacatagggaaggattgttgatgttatttatgctattttaaagatcgatgttttcatataattatgtattggttatatattatttcttgatataaggtaaaaaaaaaaagcaaaacaaactttaagtgatcactatgaaaagaatcccaatgctgcacatttaggtttatccaactcttcccattaaaatattaaatagtagaaataattgtgaataagaaagagcagattttgaaaaatggaaagaaatgcttaaagacatagcattgttgcccaaccatcattatttaaacatacagtgtttggctttgaccaaattgccttcaaacacttccttttggcccaaaatgttaggtcatatatactaccataaaattcatgatgcttaccatgcattaatttctagtatataccaggcattgtgctatgcatatcatattcaatatttctaatcctctcaaaagtggtacaagctaactggcgtttttcttgttttgaaagggagaaactcagagaggttaagtgacttgcccaaggcaatgccattgataagtgccagattctatcacaggtttattggcaacaaaccatatgtgcgcgtgcatgcgcgtgtgtgtgtgtgtgtgtgtgtgtgtacacatacacgaataacatatatggtataaatacgtggaaacataataaactgcattgagctgcgtttataattagtatttaggacatgtttggcaaataaaaacagtggagattgaaatggatttgcttaggaaaaatgatacattaaaataggctttattatgagtcttcaactattctgtgaaaatagatacccagggaagaaataatagagaatatgaatcttgagcaggcaactgagaacttgtcgaagagccaagataaaaatgtcagagaggagaatattttggcagctcagatgagcccccagagggtgggaggcaatgatctcaccgcagtctcgtatctgaaccccaggtttttgcatctccataaagtaatttcttacacccctcaataatgatcgggcttactctcaatctctcgctctctctctgtgtctctctcacgcacacaaacatgcagaacatttcttgcacatgcataactcataagacgattatgtaaataccagcctttttatttcataactaaattacaaggcctggttattgtttggactgtgaaaaaataattatgtgaataggtgcctcaagatgaaagacaaggcaagattgtgaaattattcatatgatagtaatagtatgcaaaaaataacacaatctttaaagatctttaacgacctagttataaaaccatgctttataacaaatataaccatgaggaaataaaaagaaaaatgtaataatatactccaagaataaagtcaaatgtattgttgaatgtaaggagttggttacacttccttatagtggaggttattttaaaatttgtggcttacgtggtgttatgaattgccctagatcaacactattatgcaaggccaactattaggttatttttggtagataaccacagcaaaactttagtataataggtaaaggttagctacactcccataccctcactctcaggtgttgtcatactccgtataaaaggttcaatcaagggagacatgagaatattccagaatctagaggcaggatgcagttaaccttagagaaggcatcagacaactagaatcttcggattcaatgtggaaacaaagcatagtttaggcattaaatcttgggcaccattccaaagaatacaggttccataacttactatatttttatacctagcaagctagagatgaggaattgctctcaaatattttaaccaaagcatgtatcttaagtaacactaatctcataagtgaaaactcatttctaatattcattttgctcattagcaaggcctctagtgttgactgtgataaaaaatagttcaaatgctggtagaacccaccccaggagactggcctttctgattaaattctaactctatccccacgtgaattcctgacttaagtaactgagttcctgcacatcagaatataagtatattatagatataaaaacatatgtaattaataaatattttaagtgagacacttctttcatctttatggcttaactatatcagacatttgattatttttagcggtctaactacaaaacaaaacacaaagcccacaactaaaaatttctttgtatatattgcaaagaggcaaccatttggtgtcaattcaatcatgagtgaaatgctattatacgagtacatctccctggcttgtatgggggtaatagggcatggaatttacagattcacaataactgagatattcacaataacaaagatatcaatatgtagcttttcccataactttgtgtaatgaaatcctcagtttgtgctgtgtaaaaagcttattgtttacttctcatgaaaatcatcttagtttttatctttatttaatagtctgtaatttgggggtaatacattcgttttgttgatactatgtgaagtggcaagcagaaaattctaacaggaatagataagcaagtatcctataaatcagagtcagtgtctctctctctctcttttaatgagtcagtctgtctctctctctttttccctgcctggctatctatctgtatttttcagttttgctttgcaaataagagaattgtgtgttgtaaaccaaccaacttaccattaattttctctgaattcaaaagcaattacaagcggactcttgagtttgtgctgcctggttgtctgcatataggccagatgtctagaataggatctttatttactatttttaccctcctaatttcatggtaactccaaggtagatgatatttgtaatcgtacactacttgtcagaaatctttctaataacactgctattttataaaaataaacattaattcagtataaaattttattttaaatagttaattcaagcaaatcagtgaggtaacttttacactgccgagcgtacgtgtgtgtggattagtacagccatgccatagacttcacttgtaatcttttctttatattttttatacacctgaaatgttcatcattgtgctgtagaaaacaatctcattgtgtttttaaaagctagagtgggtattgagaaggggaagaggatcatagaaaaagttggttaacatgctacttaacacttcaaatctttactcgatgtcatcatcagcaacattttaaatttatgcttctactagtttgcagttcttttcctttgattattcttatgatacaagcctttccacacaaaatttatgtacaggaattgtgtagaatttttctttggaaaatatggtgatttattacaatttgggcaacatcatcattttaaaaattcagaatttgatttttctcagaatcatcagaaagaataaagcatatatatggttcatgtcaggagaattagaacatgagaattaatatatctctgatcttttaaaatattttcatgtttgtgaatcagcagatttttcctagtttgagatttaaaaaatctagatataattaaaatctcactgatgtttcaccatcagatgattttatatttgtattttcttccacttcataacttgtatagagaagaatagaagaaagaaaaagggaggattgataatctttctctctcagttcttatagcacttcattttttaaacttattacttccttctgcctgctttgtttgtctacatgtttgtatttcatgatttcttagaaatccatctactgccattctgaaggtcatttacctgaaaatgatagaaagcagcatatattcaaacaactgcagagtaattgtctatatcagttatcattgttcattacttttctgttttaggattgaggggctgcctcgccacctccctcacacccccagcatattatcacaaagcctactgattcattcacatccctgggctgaatttgccacccactgtgtgttcctgttgttttgtgtatggaagtgaaaagatttaatttgatgttgttgaaaagacacagaggctaactttcaattttcatatgtagttcttccctctccctctgcaccacctcctttacttgttgagaaaattgccctctccatggtaacaatagaagaagctttcagattttagtagtagttgttgcagagaaaagaattcaaaaagtagatgaagtttaaaaatgaaaaagagagaggaagacagctgggaagaaggcttaatgtttatgagtgggtgtggaggggaagaactaagttgaatgaacaaagctgagctaaggggaagatggtttttctgcatcccagaaggcaataccctagcctttcctgcagccttcactccccaaaagataagagctttatctgaaattcttataggattcattcctgaagagcagcttgtcaccaaacagaaacactgtgatttcctcagggagtcacagtttattattatttttttaatgtaacgcttttgtgaactccagtttccacctcaattcaaatggtcttttggttacagggtgaaagagacccaacaatacacctttcccacttccggaggcctttggttaaaccatgtctgccacaaggacacaggagcctggtatgactggttgttttttgtttgcttttttgcctcctgtgctttctagattgtgagatactgtaactcttgtcgatgacacatagtaccgaacccacccgaagaagtatgtcagtatgtcacattgtgacaaacagcttctcatgctaagtaaatgcagaaccattgtgaaaggtttaataatgcccactcctcccccgccaaagatgtccatatcctaatcccaggaacctgtgaatatgttaccttacatggcaaaaggctttgtattaacagatgtggttaagttaaaaatcttgacacggagagatagcctgggttaccccagtgcgcccaatgtaatcacaagagtcctcctaagagagaaggaggtgatgatacaagcagagtaaaagagagattggaagatgctacactactggcattgaagatgaaggacagggccaagagccaagaaatgcaggcaggctctaaaagctggaaaaggcatggaaaagaatcctcccctacatcccttagagggaatgcaagctctgccaacacattgtttctagcttgtgagacccattttttggactttggacctccaaaattgtaagataataaatttgggttgttttaagccattaagtctgtaatcatttgttacaacagccacaggcagctaatacagccatgaacatttagtaatgactaactttgcacaattttaatacaagcttcttattaaggtttattttttcttaattacaaggaataaaagtggggtctgggggcaatgtcatggtccactccgttttagccatatgaatttgtatttccagcattagaacaaaaggtgacaaatctgaatgtatttgtgtgaaataataataaagcagaacaaaaagggaaaagtgtccagctggaaatgaagttagagaaagatgaggagaagcaagccaattgtgtagttttcccttctgctttttaaaatcatgatttgtttaacccactgaattctattttagaaacaggactgcaaggaagtgttgatggatttggtggcatgagaaccagagtcacagaggcaggaaagtaaggaataagtgttagaataggaagcagagttgcttgggaagagaccttatgacatgtggacagggctagacttaggagtcagaaagacctgagttcaaatgctatcctttagtatagtttgaagtcaggtagcgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccatttacacgatattgattcttcctacccatgagcacggaatgttcttccatttgtttgtgtcctcttttatttccttgagcagtggtttgtagttctccttgaagaggtccttcacatcgcttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttctcctaattgaataccctttatttccttctcctgcctgattgccctggccagaacttccaacactatgttgaataggagtggtgagagagggcatccctgtcttgtgccagttttcaaagggaatgcttctatagtacaaggctacagtaaccaaaacagcatggtactggtaccaaaacagacatatagatcaatggaacagaacagagccctcagaagtaacgccgcatatctaccactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaagggcaacaaaagccaaaattgacaaatgggatctaactaaactaaagagcttctgcacagcaaaagaaactaccatcagagtgaacaggcaacctacaacatgggagaaaattttcgcaacctgcttatctgacaaagagctaatatccagaatctacaatgaactccaacaaatttacaagaaaaaaacaaacaaccccatccaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgaggcactatttacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcattcataggtgggaattgaacaatgagaacacatggacacaggaaggggaacatcacactctggggactgttgtggggtggggggaggggggagggatggcattgggagatatacctaatgctagatgacgagttagtgggtgcagcgtgccagcatggcacatgtatacatatgtaactaacctgcacattgtgcacatgtaccctaaaacttaaagtataataataataataataataaaatctcaaaataattaaaaaaagaaacaaacaaatgctatcctgatcctaactggctggctgtctttggggaagttggtaatcttttctgtgcttatttcctcatgtgtaaaaaaatgaatatagtacccagctaggtagagttgttgttgggattaaatgatgactataaagcatctagcccagcttcggctacattatagctgcttacgaaattgtagttacgatgtaaaagagaaaaacactggaaaaggaggatatgggccattttattccaccttcaccaccttttagcttggtgaccttgggcaaattatgcttcattccgtgcttcattttccttgtctataaaagggtgtaagtacagaaccattgaggggtggtcattattaacctacctcaaatggtgtctgtaagttaatatatattgtgcttttcctatgtacaatatctagcacataattacaaatcaaatccatcccatgtgcaatatctagcacataggaaaagcacaataactagttattactcttgttgtagtaattgctacgctgtaggagtttgaattgtaaggcagtggagagtcactgacctttacgagaaagtgtagcagaacatttgagtagatagtaatggggaatattacataaatggatagatattaggggcagatattactattaaaatattacagcatggatatttattaaggccaaactggttaattagttgcatctctcaggttcctaatgttgcttaattttttaacctcccattttgtgctgccctttgtacgaatatttaatgctcccaacacctcttcagtagcacatgtactgtgagtttgttttgttattacttgtgtgtattagcattcctttgtgaaccaaaagcatggaattagctgttgcctctaggctacctagttttgtagtttggattgaagccttcacctcagtaacacctattctgtctactatcttacagaaaacttgtaaaattaagacagatcattaatatagcagaaagagacaaagggcagagaacattgagatactggatattggaaccacccaatagtgttgatttatttatgattatcagtttttgtctctgcctagcctcatgccactaaagtctctgaggcaacaaagaataagcaattttgctcaccttatacaaataaaacacagaaaaaggaatcactagagaaatggtactgcagcctttctgcagggattactgcttatttttaaattacttaaaaggtattgaaattattgttcataatgagaaacctgcctaataaaacagaaaattaaacttaacacttccctataatgtaaacagctcggttaggaacacaacattacagaaaccacttaagaattgattgtacttgttcttggagcagaactagaagctcaccgtttagaagctgtgcacatttccctatcaaacagtacataaagtttccatattcctcagaatcggcttcatttgtgccatgtgtttgcttggaactatgccacagaaagcagttctccccctcaagctgggctcctttcatgccgcagtgcaagtgtgtgatatactggcaccatgtgctaatgtagacccatttttatatgataagaattagtacggcctagggaatagacaagtatgtctaaaatcctccccatagaatatgtcccttcctttaaaagctgtcatactgtaagttccagctgagttaaaggccactgtgctcctatagggaaatatattctattgtaatttttacgttctccaataacagtctgttctttgtttactgaagagagctttcatgtcataaaatggtgttttttgacagagaagcagaatcattgttttattatagaaatttgctcttacaacagcaaaaataaatagctcatctcttaagctcctgatcaatgtctaacacctcctacccccagcaacacttcactgcaagtatattaacactctataatagcaattccactcacctaccaagaaatgatcttcacaaatgatttacagctaaaccagagcttaaacacatagcacccaatcaagggcagatttttatctttttcccagtcatataagttctgagaagaaatagattaatgttgatctcccagacaactgctgagaaaatgtacaaaggatgttgtttattttgaagaatgagacctagttgttaagcactttttccccttatatgtacgtccaaaggtaaccattacaccattttgatgcaaatttaggatatatatttattcatacctctcttctccattcggatgttgtctgtgtgagtgctcacagacacatgcacacatacacacatgcactcctgtttcacacttatttgtaaaactcacaaggatttccaagccattaatatagcattgtttaaggtgaacacatggttgttcaccatccatatgtatcttcactttgtagcactcagaatttggcaaaatcagaaggctgaaacctcatggattaaatatattctatataacatatgtcttaattgctgttactgtaaagaaacctggactagccatatttgactaatttctacctaaggtatttgaattcttataaatagattcattgctttaatcacacaagagtggtttatatgaatgtaattatctccactttatagctgaataaactgagcctgattctatccctatatgggaaacatgaattgaacagctgtgccaattattttgataattcaaatttcacatctaccatgtgaagacagcagaagagggttagggggcttgaattattctgattaactgtgttcatgagtgtaatcgcctctagataatcactcatttcttcacttcacttcccatctacaggtagtatcagcgaatggtaacatctcttgctttgcctcagtttattgatggctgccgttagaaataaaaagcatggttttgtttcagtacttaaatgaataatatcttcaaaatgtttttaaaacgtgaaaaggttgaatgcatttttaacaaatgttttgttagctttgacttttatttttgaacagatgagcacaataccccagtactcctttcctagaaataggagtactacctgaagacttatttcccaaagaaaaatatcaggtctagtgcagcaatacgtattaagggcattgaaaagttatattcacaaaatgtgacatcataacatatgttaatacttcttatcactgataataatccttgaagttgtatttccagagagatctcaatttcttctcacactctgaaagtctctgtttatcctttagagtaggaatgtaagaatttaacaaaacattctgaatgtttaccttttttctaaactgaaactacaatccctttttacccctatatagtaaaatataatattacaagtagaatcagcaaatttgtttaataattctttgggacagtttttacaagcaatggggttgaatttatgttccttgtgtgcagtggagttattatattcttcttaaaaagatgcatgaaggtaaattagaaatgttttacatgttttcatgacaggacatttaatcaaagaggagatacaagaggcttttcttgggttactgcaatttaattttccatttctttcttggaagggacattggatgcagttgtacgaggttaatatttctaacatgccacttttattgtggcattcttctgctctcaaacctctgatgatttcccatggccttcaacatgatgtccttatttgggcatctagtgttctgagccctcacattctggccccagcttcccttctcaacttgatcacagccatcgtaattctgctaactaattacacagctgcccttcccactctttctcaaccactctgctgtattctgacttctacactttagttttaaagctactccttgtcctgaaattccttctcccattaggtcattattaattgagttcatcctctaagttacagttcatgttgctgttcctctatggcaccttccctgaacctggtcccatataaaatcccatctctcagaatcccattagggtaggatatgtggtctgtagactattacgtttgtcatttacatattgtcttctattattgggtaactgcgtgtgcgagcatgcatgggctggcctgaaggtcacctccccaactgcattgaaagttcatcacaagttcaattatttcactagagagtctctttcatgtcatccatgaggcacattccctactgtgatgtgttatgcatacaattatttcaataaatattttctagctctttgattgaccaaagcttaattacctgtcaactctagcctcttgtatctggaatttctacagtctttggatagtatctttaggatgcaaaattaggaggagtatgtaccaggcaaactattacaaataatgccctcaaatagttacatttcactattcatgtcttgtaatttatcttctgctttggtattttagtacacttatgattcaatttgctgtatagattcctctgaatagggacaagagaattcgtcttgataagtggaagttcgaaggattccaaaatgatgttattcaaggtagaacaagaaattaatactgaaaaaattgaggagtaataatccccaaatatgtacatgcgtatctcgttttattgggtttcactttattgcactttgcagatatttcactttttgtaaattgaaagtttgtggcaaggctgcattgagcaagtccgtcgggcacaatttttccaacagcatgtgctcgctttacgtctctgtgtcacgttttggtaatttgctcaatatttcaaacattattattattattatatttgttatgatctgtgatcagtgacctttgatgttactattgtaattgttttgagatgtcatgaactgcactcatatgagatggcaaactttgtggggtgcagtggctcacacctgtaatcctaacactttgggaggccaaggcaggaggatcgtgttagcccagaagtttgagaccagtctgggaaacaaagtgagaccctgtctttaaaatatatatgtagaaaaattaactgggcatggtggcacatggctgtaaggagccctgccagctgcatgggaggctgacacaggaggatcacttgagcccaggaggtcaaggcggcagtaagccatgttcactccagtgccctccagccagaatgacagagcaagaccctgtgtggaaaaaaaaaaaaagacaaacattttttcaactttgattttagattcagggagtacatgtgtaggtttattaccttgatatattacatgatgccgaggtttggagtacaaatgatactgtcacccaggtactgagcatagtaaccaatagttagtttttcaacccttgtttccctccctccccactctagtagtcctccgtttctattgttgccatcattatgtccatgacaacgcactgtttagctccacatgagaacacgtggtatttggtattgtgtttctgcattaattcacttagaataatggcctccagctgcatccatgttgctgcaaaggacatgattttgttcttttttatggctgcatagtattccatggtgtatatgcaccgtattttctttctccagtctgccactgatgggcacctaggctgacttcatacctttgctattgtgaatagtgctgaaatgaggatgagaatacatgtggttttttagtaaagcaatttgttttatttgggctatatgcccagtaatgggatcactaggttgaacgatagttgtgttttaagtcctttgagaaatcttcaaactgtttcactgtggctgaactaatttgcattcccagcaacagtgtatcagagttccctcttctctacagcgtcagcagcatctgtcatttttttgactttttaataatagccagtatgaatggtgtgagacggtatctcgttgtggttttgatttgcatttctctgatgttgagtgatgtggagcattttttcatgtttgttggccacttgtatgtcttcttttgagtagtgtctgtttatgtcttttgcccattttttttgatggggttatttgtttttgacttgttgaattgtttaagttccctatagattctgaatattagacctttgtcagatgcatagtttgcaaatatattctcttattctgtagactgtctgtttactctgttgataaattctttcactgtgaagagctctttagtttaattaagttccacttgtcaatttttggttttgttataattgcttttgaggacttagttataaattctttcccaagtctgatgtccagagtggtgtttcctaggctttcttataggattcttataatttgagatctaatgtttaaacctttattccatcttgagttaatttttgtatatggtgtaaggagggggtccagttgcattcttctgcatatggctaaccagccatcccagcatcatgtcttaaatacagagtccttttcccattacttattttcataagatggcaaacttaatcaatcaatgttttgtgtgttctggctactccactgatcagccattccctcatctctcttcctctccttgggcctccctattccctgagacacaacaatattgaaattatgccagtcagtaaccctacaatgtcctctaagtgttcatgggaaaaaaaagagtcacatgtttgtcactttaaatcaaaagtcagaaatgattaagattggtgaggaaggcatgtcaaaagccaagacaggctgaaagccagacctcttgtgccagttggccaagttgtgaatgcaaaggaaacgttcttgaagaaaattaaaagtgctactctgttgaacacaggaataagaaagtggaacggccttatttttaatatggagaatgtcttagtggtctggatagaggatcaaaacagccacaccattatcttaagcaaaaggctaatctaaagcaaaggactaattctctgcaattctgtgaatgccgagagaggtgaggaagctgcagcagaaaagttggaagctagcagaagtatgttcatgagccttaatgaataagccctctctataacataaaagtgcaaggcagagcaacaagtgctgatggagaagctgcagcaaactatccagaagatcaaactaacatctaagttaataaaggtggcaatactaaacaacacattttcaatatagacgaaacagccttctattggaaaaggatgccatctaggactttcatagctagagagaagtcaatgcctggcttcaaaagttcaaaggacaggctgactgtcttgtgaggggctaatgcaactggtgactttcagttgaagccagtgctcgtttaccattccaaaaatcctagggcccttcaggttatgctagatctagtctgcctatgctctgtaaatcaaacaacaaagactagatgactgcacatctctttacagcatggtttgatgaacattttgagccctctgttgagacctacttctcaaaaaaatgtgtctttcaaaatattactgctctttgacaatgtccctggtcacccaagagccctgaggaatatgtccaaagagaatgattttattttcatacctgctaacacaacatccattctgcagtccttggatcaagaagtcacttcaactttcaagtcttattacttaaatcatacatttcataaaggtatagctgctatattgtggtgagtccactgatggatctggataaagtaaactgaaaacggaaagtcctcaccattccagatgccatgaagaaaattcatgattgaggggaggaggtcaaaatatcaacattatcaggagtttggaagtagttaattccaacactcatcaatgactttgagggtccaagacttcagtagaagaagtcactgcagatgtggtagaaatagcatgagaaccagaatgagaagtggagtcagaaggtgtgactgaatagctgtaatctcaaggtaaaacttcagcggatccagagttgctgcttatggatgagcaaagattgtggtttcatgagatgcactctactcttggtgatgatgctgtgaacattgttgaaatgacaacaaaggatttagaatattccataaacttagttgataaattagcatcagggtttgagaagattgactcaaattttgaaagaagttctactgagtaaaatgctatcaaacagcatcacatgctacaaagaaatcattggctataaaggagagccaatcgatgcagcaaacttcgttgttgtcttattttaagaaattgctacagccatcccgaccttcagcaaccgccaccctgatcaatcagcagccatcctcactgaggcaagagcctgtaccagcaaaaagattatgactccctgcaggctcagatgattgttaccattttttttaggagtaatgtattttcaaattaaggtatgtacattttttagatacaatgctattgcacacttgacagatgatagtagagtgtaaacataacatttaatgcactggggaaccaaaaatattcgtgtgcctcattttattgtgatatttactttattgcagcagtctggaaccaaacacacaatattccaaggcagtcctatatattgtttcatgtctctctttcttctaaaatgtgtgtaggagaaaaaattatatcacttatgttactgggccataatatcaaaagcctgcgaatctgatgcacatgataaaaactggtcttaaacctgtcttgattatcctttgttaatatgccaaatttatagaacaatagagtttcaagaaatgtgaacaatgtagaataactaaaagatctaacgttgaatagctaaaattatcaacgccctttatatcactttagaaatgcgtttgcaaatcattatcaacaaattgtagcataaaattctttttttttcttgactttgaaattgtatttcaagatccgcaatttacaccacattatttacttactggcttgtgaaagtgaaaggcattttcatttttggatgttaagggttttagtaaatgacaagtaaatcaatcctttaagttccgtgtggtataatagcttggaaaggaccatcttaatctttttttcaacacagggagataatttattttaaaaataacacactaatagtagattaatattattaccatttcaaagaagtcaccaaatttggtaggcttaagaggttttttttttttttttgagattactatgctctttttttattttatttattttatatttatttatttattttttagttttttaattttactttaagttctgggatacatgtgcagaacgtgcaggtttgttacctaggtatacatgtatcatggtggtttgctatactcatcaacccaacatccaggttttaagcccccaatgcattaggtatttgtcctaatgctctctgtccccttgcccctcaccccttgacaggccccggtgtgtgatgttcccctccctgtgtccatgtgttctcattgttcaattcccacttacgagtgagaacatgcagtgctaggcttaagagtttttttaactccccaaaatatcaacaaattgaaacattactacaaagaaatagagaaataaatttcactgactgtcttattgttttttaagtttgaatagctaataatgatttcttaaacagctatcatattttttatttttaaagctagccaaatgatcagtgatttttataatactgataaatactgcttagaaaaggaacatgtgttctagcaatttccacacatttctgattctaattacttgtttctttttgttttatttttatatttttaagttttgtgagtacctagcaggtgtatatatttatttggtacttgagatgttttgatacaggcatgcaatgtgtagtaagcacatcatgtaaaatggggtattcaacccctcaagcatttattctttatgttccaaacaatccaattatactcttttaattaatgtaaaatgtacaattaaatcattattggttatagtccccctgttgtgctatcaaatagtgggtcttactcattctttctaactaattttttgtacccagtggctatacctacaccacccccacctgcccacgacccttcccatcctgaggtaaccatccttctactctctatgtgcctgagttcatttgttttgaattttaaatgccccgcgtgggtgtgaacctgcgatgtttgtgtttctgggtctggtttattgcccctacgttctgtcctcgtttttcacattgttgctggggggccggatgtggttcttttttggggtgggtgcgttcgttggggttggggcccgtgttccttggtcttgttcctctggcggcgcttgggtggttttgctggcgttggtcttgtgtcttggcctgtgtctctcccggtgcgttgtgtgtgcctgtttctcccgcgtgtttttctttgttcgccgtcgggcccgtggtggttcttcctgctgtgcctcggtctcgtgtgggcgcgcggctgcttgcgttgctcgttgtgttcccattaaatacacaaaaaaaannnnnnnnnnnnnnnnnnnnccacccttccccacgaccctttccatcctcaggtaaccatctttatactctctatgtccatgagttcaattgttgtgaattttaaatcccacaaataagtgagaacatgcaatgtttgtctttctgtgtctgatttatttcacctagcatactgacctccatttccaacaatgttgttgcagatgacagaatctcattcttttttgtggctgagtagtattccattgtgcataggtaccacatgttctttgtccattcatctactgatggacacttaggttgcttccaaatcttggctattgtgaatagcgctgcaataaacatgggagtgcagatatctcttcaatatactgatttattttcttttgggtatatacccagcagcgggaatgctatattatatggtagctctatttttagttttttgaggaacctccaaacggttctccatagtggttgtgctaatttacatttccaccaacagtatacaagggttcctttttcttcacatacttgtcaacattggttattgcctgtcttttggatataagccattttaacgggagtgaggtaatatgtcattgtaattttgattttcatttctctggttatcaatgattcagtgatgttgagcaccttttcatatgcttgtttgccatttgtatgtattcttgatctgccacaagtctctaattacttgtttcttgtaccactgtttcccttcattgtagtcagtgatttggtcaatcaacactttttacgtatgggtatctgttaactgtatttctaggaatggaccaagaattgagaaatttatcccaaccagaaagaacaaaatctatggaggcacaggattactgaaagctttgctcctatagcctcagtttttttctgcaagttcgctgcttcccagttgtccttgtgataaaattcaaaacctcaaactgatttttaaaaagccaactatatactgcttctactatgtctacctaaacttatttgccattatttgtaaagaattccaggctctaaccagcccatttgaggctttattttacgttcatgcctttgttcatgtctgtctttcccttataatgctcttctcattctctagccaaatctgccaaagttcagctgtagtgccatacttgatatgaagtctttgctgagaattcccatatgtggtcatttccttcactgatttgtttcaatagttgttgccattattattattttttttatactgttgctggatactttcgcagatccaatctctaacctgttgttctaccctaggaggttgaccaatatggcagtagcattgggcttgcttgtctattggcttggtccttgtgttgggaggcatcagcagatcaatggatgagaggagagtgagtcgagggatggctaggttcctttactcacagccccagctcctgtcaagaggtcttgtccctgcagccacttctcagattctactaactataccctccccttagcctttcaggccttgaggaggaaagcctcctcatcccactttgaatgaactatttattgcaagaaccatgactgattcagaatataatctgtccttgaatgaaatagttaatttccccttttgtattctcgtttcatatccctgtccctttatccattcctatattatatcatactatcatatagctaccttatattatactatgacatgagtaccttgtaagtatatcatgctatattatagttcttaagtgtgtgggctttggggccaacttacctatgttagaagttctgccacttattaccatgtgatcctagacaaattgtttaacttctttttcattcattttctttactagtaaaataggggcaatattagtacccacctcacagagtaatatgataattacattgactgatagtttttatttaaaacttttattgttcttactatgaaatgggaaatgttctaaacaccttacaaatattaactctattaattctcataatgaatctgagaggtagagtctcagtatctccatttcacagtgctggaaatgatacagacagcatttaagtaacatactgaaaatagtaaaccgaataggtggcagccagtatgcaaattgggaaagcctgactccagagttcattcttttaactagtatgctgtgatagactcttttggcatatggtatgcactcaataaacaactattgttgttgtcgttagcattacttcccattgtattattacacaaaaaataattgttcatgagtatttgtttgctagattataagttccttgaaaaaagaagacaagttttatttgtctatgtgtactagctgagtgcttggcaaatagttgcagtttagtaaatgtttctaaaacaaattattagttgtttcttatgtatttcccaagtctatcctagccttggaaacagctaacacttagctaaacctagaaatgtcatttgagatttcagcagccatcattgttgctgaagccacaggttctcctttttatctccaatttcttcctcagatgattcaccactttctttgtcgtttccctacttcatttttcctatagtgacttttgttctccaataaccattgatagtgatgacagtcccaccttggaaccacttctaactgtcctgttcagcttttcctgaggccagatttcccccaaaatacattttttagcttcataactgctccttccagaaatttgaaacgcattctcaggaattaagcaagaggcatttgattgacgtcatttaatttgtgtttaaatgtgttcttcccatcaacgattaaccagtgcttcagccaagatacataacttttattctccactaaccttagggttgaggtcacaatcaggtacgtaatctgtagagcccagtgaaaaatgaaaacgcagggcccttggttaaaaaaacattaagaatttcaagatggcaacagtagagcatgaaaccaagtatgaatcccttctaatgcagatccttgtgtaactaactgcacaagttatacgttcaagaagctggtcctggttgaggtctctgtctacctagggcacttctcactcagagaggtggaataatcttaactttctgtcttccgtcatctgaaaacttgccccaaagttccttttgccatctcttgcagcaaacctagtggttgttatctgttaaggattcctggtggcttgctttagtttcctacagttcttgagctgcctgtgttgaatggaactccaccattaccatgtaacacatctgaatactcttattttcctccagttaaattctgcgctccttggaaataatggtcatgcaccctaccttagtgatttctaaatagaggtagtatgtaaaaatacatatttacttgaattgcatcttaagaggccagcccatgggaggcatgaagaaacctgtgttactaattaatattcaataattgacagttacacattcaggtagtagtgtcatggaaccatcacgttacatggaactgaagagctgatgagaggtttagggtctaggaggacaaaagtgagtgtattagtcagggcctgaggttatatgtacccagacaggataaaatgggacaatattttattagtggaaatatctatgtgaaagaaaagaaggaggaagccaaggaaggtgcaagagatgttagatcaagatgcaattctgactctgcaaggaagagagagggagagaaggctaggcagaagcatcccagtgtgcggtctagtggaaggaaattttggcaaagctgttgggaagtcattgaggcagagccaggcaaagaagtcccatgtctcccaaggaaggctctctgccttagtattcccaccacacccaatcattgggtgaggagaagtctgtgagaagcttggctttggtgcagtgcaatcatggatttcaaaatgcagtaacaggagtcctcagtcagttaagacccaataatagaaggcctgcatattctcatggtggccacttgggtatgaggagcagtggtgtttaaaactgttttgtataatttaaataaagaaaagctgaggactacttaagcttgattccttcagaagacagtctttggcctttatatttcatgtgatatctttgccatatgctctgataactctccatgtttcccctaccataatacctcaggttattgcaattgcttttttattgcctgtcatcactactcgtttgttttctctttgagaacaggaattattttctccttcactgctacagcccctgcacctagctcaatgagtgacacaacagaagcacttaaaaaattgctataactcaaatttgggggatattctacaaaatacctggcctctgttggtcaaaactgtaagtgttataaagttcaaagaaaggcaaataactatttcaacttaaaaaagactaaggagatacgacaactaaaagcaatgcgtgagtctggaccagaccaggaaataaaaatatagctataaagttcattaatggggtaattgtcatactctgaatatagagtatggataagattatggtactaaagccacgctaaatttcctgactttgaaactgagctgaggttatttaagagaatgtctttgctattaagaaataaaacctaaagtatttaagggtaaaggggcatgatatctgcaaattattctcaaatgattcagaaaaaaaatatatatatataaaacattacatatacagttatatatctatacacacagagagaatgataaaatgataaataattaaaaataatgtggcaaaatgttaacaaatggtgaatccgggcaagggttacctgggagttctttatcttgcaaatattctgcaagcttgaaattatataaaaataaaatgcatcttataaagtatttattcagtgaataaagaacaaaaaaggctaactgcagttggaagatatttatgaagttggttatgaagattcttaagaagttaccgatggaggtgctagtagaacattcaaaaaagaagtagggaaggttgaccaagtaggaaaatatcaatatccaagccagtataaaatggaaatgagaagtgaggaagtaagtggaagacaatgaggatggttttcgatttggccactctatttggagaggcagccgaatgcaagaatagaagccagaagaagatgctcagtgagatggttgaaagctagatagattacagcatcctcaccagtaaaaccctttcggtaactagaaaggctacaatttagtaccttcctgacttctatgcttattttcttcaatacataaaatggttccgtaaactcttttaccttctgaattctttatattaattttttgaagttgtaaataaaatagcatcagttctacattgttacatttcagcttaattcatattcatttactgaaaatgggaacatttgaaaaatcatcatgggcatttatgctatgtagattgttgatttttatagaaaaatataaaaatatgaccagtttgattttcaaagtcttttcttagacatgtaaatactaagcattcaactcaacatatagagtttttatttgagtattatttaggtggaattctattttaatgaatacaataaaaaattgtaattttgtctaaaagcctaaaatgccctagttataatatgtatgatttcactgtttaacttcctatttcatagggttgctatttataaccacttcactcaactctggggggacttagtgagattaaagacttctgattcactttgtatttgaagaattttttttcctccatctttgctcagctagtggaatccatgatgaattctcatctccaaggggtaagcagtttttagtaaagcccagtagctgacttatgactccttagaaatagcattgattccttccttctcctgtgttttgtttcctctagaatgatagaatccatgtagacacgatccattatcatgcttaggtactggtaagcatgtaatgattttagttttgttcgctttaagttatttgtgtcacaaatatctgggatcatatcagagaaataaataagcacaattagcattctacttgtttgttatgactaaagctaggttgaggaaacagaaaaggaccagaggtcatatgaggatgaagataatactaggaacagcatgtttgggagagtaacatctggtaggggtagcagattgggggcagagaacagaattttatagatggatattttggaggcaagtagtttgagtaatgattagatctaaggtgttttctcatctgtgggtggctcgaaggaatagaggtgaaggtcagtttatttgagaagttctggaattataaaactaagttgaagtcaaagaaagtatagtagcaaataaatagaatacccttaaaaggaaaccaaatgaaaaataatcgttactctcaccatatgcttgtgttcttattagcaagaaattcttttaaccactgtttttataatatcttaatgaaaaaatactgaagcgtatgccatattaaatccctctctttatttctagaaagggaatcaaaggagaaaattcccattctgctatactaaaagaccactaagtaaagagcctattagtgtatgataaatcccatagcaatatacattatcattttacagcttctttgttgaaatgaatgtttgtatgtgttgaccatagagtgggataaaaagttgaaattttgttttgaaatattttagaaatgcatagttgtactgcagttgtgaacctccttagatttttaaggaggctgcttcaaaggatctcattaataatcttctcaggtgcttacaaagcatgtgtctgtcagcagaattagagaatcacccaactagagaacaggtttcacaataccctgagacctattttgttcattagagaggaaaatggcttgttttgagtctaagttgacatgcttgctaatttcagcaataaaagctgttcattgtggtcaggtttaatttagagcctggtaaggttcagattaaagttgatcaacttacttttacaacatacttcttaaatgaactttgaaatcttaaaagaaggaaaaaagtatagcaaacagtgaataatgtatctaaaactgagaagcaaaaaaaatctggttatgtgagagtgaattaaaagaagaacaacccaataaagataatctttgttatataaaaatttccaagtatcgaaaagcacgatttttcatgtgagttacacactataccgaatatatttgtccactgccacatgcatagtccctagaatagtgcctagtgctgaaaaatatttattaaaatgaatggatgagtaaatgaatttatgtattttgccagccctgtgtatttaaagttctctgttaactttgaggtgaaaatttgacttcatctgaggtttctgggtaagtccgttttaaaaattctattgaacatattcaaacattttagggtaggcaattccaaagcaacctttcagcttcccatgtcacagatgaccagagtttcacattctaacactggaaaacatcttatttcataaaatctacctgctactatatggttcctactttaaaatttgttcagtactctccagctgacttatgccacttacttcaatagctgtctttggcaatttgttccatatttcaaacactctgttgtgtaaagaaaccataaaagttagaaacctgaaaattggattttttttctgagcaatcacagcttacaaatgtggaaaatttgttaaaagttagcccctccaatttttcaatacagagaggagaaagtgcctaaagtagatgtacaatgtttggaaaagttttttgcattattttactattaccaaaagcaattgagtttaaatcacaaagcctgtctccctacctcttcacagaagaaacactacagaatgatcaaaatttggcctttccaaaaccaaaattcgttagaaaatcagcaggagtcaaagtacagagtaaataactaagtttcatataagtttcagatacattactatctaccactttcatctcttcatcttcattggcctcatgtggtagaacatcatatttaaaattatacaaacttgctggcttgtttactagtgtggttattataagaaaaaaatgagaaaatatagataaaacatctgtcacatattgcttataaactaacagtaaatattacttgtattttccccaattaaaataaaatttactgagttttagaaccagagctagtcagatgcctttttttcataaatttcttcataaatacctctgagattgtggtccttaaatctagagagactaagatgacagagaaaatagacactgaagaaagggaagaatatcttaatgatttacattactacctataaattaaaaattgttaactttattatatttgtatttttatttaaaatagtgctatattaaagtcatttataatacaggggaataggaatactaacctgtaatctgatgctctccaaacttgcctaaatcataaaagttaattagataatttatttaaaatgcaagatttgcagccctttccactacatattcattagttctggagggaggcaaaaaggtttggtgattcttacggacaggcagcttaggagaaaagctgatttagctcgtctacttcaccttttcatttgacaggtgagaaatctcaggggtacaatgaagttaaataagtaatatctcttaaatcggttctgtgctttttctgtttttaaaataaatataccttaattttgacgtcacacagaatgatattataagtataaatagttatctatcttttaaatacattgtcgtaattcagaataacatttcttactcaaggcattcagacagtggtttaagtaatccgaggtactccggaatgtctccatttgagcctttaaatgaagaaaatctatagtcaagattttcatttgaaatatttttgatatctaagaatgaaacatatttcctgttaaattgttttctataaacccttatacagtaacatcttttttatttctaaaagtgttttggctggtctcacaattgtactttactttgtattatgtaaaaggaatacacaacgctgaagaaccctgatactaagggatatttgttcttacaggcaacaatgcaggatttggaacagaggcgtccccagttggaagaactcattaccgctgcccaaaatttgaaaaacaagaccagcaatcaagaggctagaacaatcattacggatcgaagtaagttttttaacaagcatgggacacacaaagcaagatgcatgacaagtttcaataaaaacttaagttcatatatccccctcacatttataaaaataatgtgaaataattgtaaatgataacaattgtgctgagattttcagtccataatgttaccttttaataaatgaatgtaattccattgaatagaagaaatacatttttaaatcaattcagggcttatatagttgcaaagcatgcattgatgggtgtggtgaccacagtgtggcagaacatttgtggcagaacatttgttctttagttgtcatctgggctggcatccatggagatgccagtctctccctcatatccttggctgttggtccaagcaggcagtggcttcttcctgggccatctttcattcccatgtgcagtgactttcagatctggatatctctccgctactttgatgcccccattttgtaatatcaaaaatcatcgtactgtaccttatgccgtagtagggtgggcaggaactttggtaagacccatctgactagacgctgtgcatattcttttcttctgacatacactcctatccatttaatggggagagtgattcgcagtgattgtgtgttgtgtcagtgagtttccatggggtcaggaagagtgacagacgaaggagtaggggaaactcgccacccggtttccctcagagattctcctcagaaatgaggtccaagtcagctctgctttcaggttctctcagatctctctcggtttcttcacttctctctaccttccttccctccagggacacacactggtattgaattttcttgcttcctctgcaatatcccctcattttccttcccacaacccgaagaatcctttgtagtgcaggaaggaggaaaacctttcagccatctttttttttctctttgaaatcttttgtcttttaccaggcttagacttttcaaactcggaaaccatgagagtctatatcttcataatttatattctgctatgttaacccttccctaaggaaatgactagttgtcaatatgttggggaaagtgaaagagtaaccagagtaaaaggttaatattttaaaatattattagtcatacttccacatattgggtaagtacttattgataatagctagtatttattcagtacctcataagcattagatggtgtgtgcacatgtgtgtgtttctgtgtgtttctgtgtgtgtgtacaaaatctttacagaatcttgtgagctatattttataatccccattttatagacgagaaaacaggttccaagaacagttactcggccgggcgcggtggctcacgcctgtaatcccagcacttggggaggccgaggcgggcggatcacgaggtcaggagatcgagaccatcctggctaacacggtgaaaccccgtctctactaaaaatacaaaaaaaaattagccgggcgtggtggcgggcgcctgtagtcccagctacttgggaggctgaggcaggagaatggcgtgaacccgggaggcggagcttgcagtgagccgagattgcgccactgcactccagcctgggcgacagagcgagactgcgtcgtttacaaacaagcaaagaacagagcttggaatttgtaaatgtctctttctgacttgaaaatctgcgctctttctagtatgtttaccatttcccatcttgttttgttgcttttgttaatgaccttaatcattgtactaagactaaatacttcttttgtctgaaattatgtatgttttgattcacttcctaaagacatgtcttctttcagttgtagtgattgctaattaaaataggctgttcttggttttgaaagtttaactctttattgttgcttaaacaatgaatgtggatgtatgctaatgtattatttcagtaacactagccactataacaggtaatctcccaaatcttggaggcttactacagcagaaatttacttcttattttagtgcagtccaaaataagcagccctctatgaagtcattcaggaacccaagctccttccatcttttgtgtccagagcataagactcatatgcatttaatgggcagatgaagaatgagtattactcatgaaaatttgtcatgagccacgcctggaaatggtgtgtgttaattttgttcatattctgttggatggatcttgtcacatggtcacacctaactgcgagggaattagggaaatagtgtacactgttgagcctaggaagaggaacagatttggtaagatagccatacaattgatttagcagagcattcctccaccatactggaaccttgagggttctccaacaagttgcaacacactgacccaaaagagtgaatcttagtgagtgatttactcaatatgagactgaattcccattacacaggtaagtgatcagtttcttgcctgagaaatatggaaatttggcagtgaggtttatgcaaatctgaacatactatacagagagtcatttgttattttactaatgaaaaatcacttcaattttttccctaagaggaagacaatatgaatgtattatacagtatttgttcaacattgtctgaacattttccattatcccctgcatttttttttcatattgcattgactttttcatgatagagattaaaattgaatgaccggagggcaagtttgtatctctctgccaatattcagtgatttgaatagttcttcttttctaagcttttgtcttttaggaatgaatacctttatgaatatttgcagcctagtggaaaggctgtaatccaaatggtccaagaaagcattttcttaaaagcaagtgtctgtcgagatgtgtcatagcgcttattaagagtctaagctggaatcttagttccaaatatgcctggagcctctaaatggtaccaggataattctgacaagatatgtttatctaaacaatgtcatttgcagccctgctacacttcagtttatctctccctttgaaatctataaaatgggatggaaattcaatactcataaacttttcgatcgtgttcaaaatagaatttttcttagtaaagatttggttttcaggaaaaggacagaaataaaatacttgctcataaaattgtattttctcatttgatgattttggtcttcctttttattgccatgaaacttctagaaatgctcaaaaagaaatcagctaaataaagaaaaaatagttaatatatgtatgtaatactatattgaaacatttttctttctctggtaaatcccatttcataactttgaacagttgggaaaatctatacatagttattgcagtctatcaagagaaaagttcagtacaaagctatttatgtctactagaaatattcatgttaaacttcaagtaattgggtgtgcaagccaccaccatgttttactatatgaaactattaccgtggtatctgttgtattcaggtaattatattgatggaaatcatgcagtaataatctaggtaagagagtaaattttgtctaaatcagatcaaatgaaaaattctccctctttctaatattcgaattgctcatttttctttaactctttggtgtctgaatttgtcaatcattcctggccattttcttctgcaaaagggctgggtcaggggaccaaaagcagataagattagaagaatttaaattttcttccttggaggcgtctgaattacatgaaactcttgttcgtgtctgttaatactgcaaggcataataccataataccttgcatagcagtgaagaggatttggaaagataaaactgcttccttttatcattctgtttatttcacaaacaatattggtgaatgtcgttcctgtaacatttggatttaagagccttgtttctgtagcttctccctccgtaacccccaccactaccatttcggggctatacagcaatagcatgcattactttaaaaggcaggctgcctagactggccacttgttagctttgtggccttgagcaaatgactaatctcagtaaactatctgctcttagtttccttctctgtaaaataggctcacttataactatctcatgggttgggaggattagatgaaataattaatgtagagcccttagatcagggccatagtaaaagctgaatgaatgttagcatttgttattttaattataatctattggggtgctttgaaggcttaatgcaaaatacttaatgagctttttggtagctgtttagttatttcaccccccaccaccaccccaaaaggagagatttaaaagaccgacaggagaaggttgcttggaaaagatggaataagatctataaatagaattaaacaaatattcaggaaagccttttgtgggaaatactgcaaaatttttattatctataaatttaataggtagataaaattactactcccattttagagacagaaaaccgagactcggagagcttacgtaacttgtctagggtcttaggaagatgacaagtgaggaagtagaattcaagcccacgtctatatgattttaaagcccgaggcacatcaaatggaaaaggctggttagtcagaaaaataggaaggtatatttatctgacaacttaaaatattaggactaacctcaggtaattatagtctggatatacatttttgctgctcctgtttatacttttgacttctgtgtatttgagtgtctaatcaaaggattgtcttttacatgtgttggagatgtacagactagtggaccccaatgatctattagctgtgtaaccttagccaagttaattctctttcctaaactgtggttctctcatctgtcatgtggggctaataatagtacttatgctggtagggtgattaagaaagtaaaataattggtgtttctaaagtaaatatgtggcacatattagatgctcattaaatggtacatattgttatggtgagatggatttggtacagagagaactggagatgggagaatatgaagggtgtataatgtggccttttattagctaaaccaagggaaggacttctgaaacagaattccaagttttaagagggagtcgtttattttggaattattttttcagctaaggatttttcaacccagtccagaattcttagagaaatttagtgatagcttataaattttaagaaaaggaattcacattatattgcataaagaactggtatacagggccatagaaggggagaatgttcttctgtatgagaataaaaaaaaacatctctcacacgatttttgaattaactgacagttttatagcagctttgtcaacccatcattcattgctgcaaccaaatctatgaaatccttcatggcgaaataaaaaggctctgttgttctccacatttgtatgaaatctctgttgctaatgaaatgccagccagtatcttcctctcaggtattgtctattagatggttgcttattttagaagaagtggagtcaaccatataaatttccttcttttgacatctagcacctgctgtcaacctgttatagctacaagcagctctcaaaattcacatccactaggatgccgctggcaaccaaagagttcagttcagttcagcgaacgtttgaatgcctactctgtgctatctaatatcagagatggtagaggggatacaggaaaaaagtaagattcagcctttgtctttaaagagctcacaatcaaatgtgggtatttggacaagtatatttaggcaaggcagtttaggataggtgcttcagtagagcagtattacaaaatgttgagagaaaactagaggaggagttttaaatgagggcttagtggaatgcttccaggaggaggctgaatttgacctggtcatgaataagactttgaaaagcagaaggaagctggagagggaagggtatttcaggaattgatgacaggagaatacataattagacctgttaacagtggggtggaagacgaatatcagcatgggagtgtgtgtgtgtgtgtgtgtgtgtgtgtgtgtgtgtgtgtgtgtgttgtggaggataagggagtaaatgaagtcagtaagaccagttagaaggcaagagagcccaagctggagcagtgaccatggagtaaaaagaaagaagtgaaattgagacataaggtggagctagaattaacaggattttgacattgattgcatatataaaactgtcaatctaagagaaggcctgcctctaagagttggagattgaattctttggaagattaatgtcataaccagagacaaactcaggataaggagttgattatgggagacaaagtaatgtgcttaacatgaagctagatgaccatactgagattttaaagaaatggttgaaaacatagagattgcaggagtgatgttacttttggacaagaattcaaaagttacctggaatgtctgagcttgcacagagagagggtacctggtgcaaagaaaagtgaacctaggaaaaagcctagaagttggtttacatttaaggaatttgagaagaggtagcaccacccaaccccccacacaacccccaaccctgccaacttacaatatagaagcatttagacacacactgaataataattttttttttgagacagagtcctgctccattgcccaggctggagtgcagtggtgccatctttgctcactgcaactccgcctcccagattcaagctattctcttgcctcagcctaccgagtagctggcattacaggctcccaccatcatgcccagctaatttttttgtatttttagtagggacggggtttcgtcatgttggccaggctggtctcaaactcttgacttcaggtgatccacccgcctcggcctcccaaagtgctgggattacagacctgagccaccgcgcccagcctaaataatgaatttatagatgctacactgtatggtttcctttttctgctgctgtacaaccattcaagtaacataagtttcatcctggttcttaatgataccatgaataaagtatagaaactctttagctgaggattaaagattgttgtgtttaggtagaccaggtttctgatgcagccctcagtataccagggaaattagccattactgtttgccttgtaggtctaatgaaccctttagctttttattttgtatatgtctaagttactctacaaattcttatggaagtataaagagatagtgaaagacaatcttatgagaaattttaataagaattgaaatacaggctgggcacagtggctcactcctgtaattccagcactttgggaggctgaagcgatggatcacctgaggtcaggagttcgaaaccagcctggctaacatggtgaagccccatctctactaaaaatacaaaaaaattagccaggcatggtggcgggcacctgtaatcccagctactcgggaggctgaggcaggagaattgcttgaacccgggaggcggaggttgcactgagccgagatcacgccattgcactctaacctgggcaacaagagtgaaactccatcgtaaataaataaataaataaataataaaaaagaaatacaacttactttttgtatcaaataaattttggtgcacaaacatcataaatgacataatatctgtcacacatcctttagcaaaacaggattgttaaaattcttacagctaatattatgtggtgaagttcttcctgttgaataattaagtggattaaaatatcatatttcctttctgtcattagaaatatattgtgcattaatcagtccttgggcctgagaacatttatctaggttttcatcatctgaaactcacagtccaatatttcacctgtttatcaattcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggatatataaaatataaaaacacaaaaaagagagaaacagagagagagagagagagagtgagagagagagagagattggtaataatactaatatatataataatattatatatatacacacatacagagagagagagagagagagagagagagattgattttaagccattaactcatatgattgtgggagctgaaaagtcaaaaatctgtaaaatccaaaagcctggcaggatggagaccaagggaagagttgatgttgcaatcttgagtccaaaggtaatccgatagcagaattccttccttttctggggacttcagtcttttctcttaaggacttcaaaattgattggagaaggcccacccacattgtggagggtaatctgctttactcaaagtctgctgattgaaatgttaatcacatctaaaaaataccttcacagcaacatctagattggtgtttgaccaaacaactgggaaccatagcccagccaagttaacacataaaatttaccatcatcagccatcatcatgaggttcataatgtcatgtgtttcttcacatataaatctcgtggttcttttatttttttagtagtacctagttaataaggtacctggaaatatacgttaaataatagaaatggtctttaatatcttaatgaatttcagagttctatcagagtaattgtaacttgtatataaaaactgatatataaaaaacaagtatgttttttcttcctatacgttgtgttaaattaatactaattacctatcatgaaatgaatgttttccatttttcataaatgtatttcatttttaaattaagaggattaatatcaaaacatatttgaataggatttaaaatccaaattacctgttgcgattatatttaattataaatctttcaagtgagtttataataggaaaaatattttttattaaagtgatgtaccataattatgaacataaatagtgttttctactaattgtttttgtcttcattatgtttctttttaaggggaaagatctgggttaacaaatgttttattcatccaccttgaaaattaaacataataaacaaaactattaaataaataaaccaattaaagaaaatagtttttcttccttttttgtgataaagatgattatgagtaaatatattaaagaattttatactcagacaaagtgagctaataagacaaatacaaacagagatgagcccagaaagagatactctacatgtttataggctagcatttttatcttatgacctacagggtcattgtaactaaagtcttgaatttctgttatattttggtacctgtgggcataaataggaatattactccctgatggcatcatgcattttagataaaactaagccaagggttaaacacgtgccatggactgttcctaaaaaatgctctcagctctcaagttatagaaaattgtagggattattattttgtacctactacttctttctttaccaaaatttacttatacatgatttgaaaattgcttgccacctgtctttattctgttgtacttgtcttaagtaaaacatttataaagtaagtaggaaggattaatagattgtgacctttctacatgaaaaggggaaagccgagcttgttctacttttgtcaggaaagagtttgaatagttacctgttactgtaaaacaatcaccccaaacttagtgtcctaaagtagcaataatcatttattatcactcataggttctgtaggtcaggattcatgcattgcttggttgaggggttctgtctcacgatcactcatgatgttgcactcagatgtcaattaggctgcagtcatatgatggcttgactggggctgaaggattcactttcacagtgagttacttgtatagcttgtgagttggtgctgtctagttggtttccctctaaacgagttcctccatgggactacttgagtgttcttatgatgtggtggctggcttaccccaggacaagcaacctatgagttttgccctgagttttctgaaacatgatcccatgttgctttgaatatccccattagacactcccacaaatgtcaatcatactctttgccctaaaagttgcagactacttgtacatgtcctttatcctacatgtgtacaggaaacacgtgcagaataacatgtgtttttgtttcttgaaagaaacaagaacccaccaaaactttatagctccgggacatgatgataattatctcaggtccactcagcctggctccacatggaaaatatgggtattgtaaagaaagcttttgaattttggaggcctaacaaaaagacctaggaagctaatagttggttatgagataattataacaatggtgatgaaagcaattgcgattattacttttatgttagtgagataaatacataagaatgtccttctttaatttcattccttaatttccttaatccccattcttgatttctggattagaggaaagctatactatctacctgattacacaaaaagactggactgaggggtaaccattaggactcttgttagttgaaggtaataaactatattacttcagtggctaaaacaaacaggagcttttttctcatataaaactagaagtcaggaaacaaatggttgctgatgttggtttatccgtttgacaggttctacctttatcctggagattctttggcctttatttctttagtaatatagtagtaacagcactgaatctaaaataagagcacttggtccaagcactggctctgcccccttagtgacagtgggacccatggcaaattatttaatctctccaacagttaattttctcatctgtaaaactgggatcctgataacttccatactagtttggtgttaggattcaatgaaatgacgcatggaaaagtccttttcaaatggctactcactatacaaatattaatgtcttagtaagctcaggctgctataaaataatgccatagactgggtggcttaaacaacaggcagttgtttttcacggttctggaggttgagaagtacaagatcatggtgctgacagatgtggttcctggtgagaaccttcttcttgctgtatcctcgtatgttggggagagaggtggtgcagagaggtactctagtctctcttcttgctcttcttaaaaggacactaatccaattatggaggcctcaacctatgacctcatctaacccttattatttctcaaaggccccacctccaaatatccattgggggttagcacttcaacatacaaattttagccggcgggggggatgccagcattcagtccataacaatcaactatcctcattattgagagttccactaggccttctcaagggttgacaatgatagtgccctgctagctataagagtaaaaaaattttcacatctagaaaatgggtgcacgaatattggtaactgttctaatgtctatgcacagaatttttagaacttgctcgagaaatttgtctttcctgacagtgttgcttctcttaaattccagtcgagggccttgaaaaaaataggttttccatcaagattctctgaatgaataaatgaaatgctctgatattttctttcaatattaagataaagcaaaatgtatacagaattttctattttcagtgtttccaattactgcatggtttggcttattaccatctctaagtctaaccctgggtcataggagtaaagccattgggggtcccctacaaaggatacaaggcagtggtagatacaataagcctgacaattggagtcagatttttctctttcatacaggaaccatggaactgttgccctgggccacagctggctctcagaaaaacgtagaactggtcgaggaaaggaaaggcagggagtccttgattcacttgttatcagaaaattgtctgttcaaacaacagaatgtttgaaaagataaaatcaagtctcaaatgcacagaataagaatgaggggaaaacacctttctctgtaattaaacagaaaagtgtgccatgaagtgataaaacccagtcaacctgaaaatgtgaacatcaagtgtaattgtgcagaacgataaggtaatatgaacagcacaggaatatataggctcacgttggcattttaaagcaatggcactttacctgttcctcatgaaggatttggtttagtctaatcccttgtaggagccactaagaggagaaggcacagtccttttgggatgtaaaatggggaattctttctatgattacaagaatttgtaaattgctcagagttttaggacagcaggttatgtgtctctcaatgttgggtaccatgccaaacgtactttaagagacatagcaataaatagaatgggattcatttttttcttaatgtctggcagggcaaccaaaatgcccacgtttcccttcagtagcttggtattttggtaactaaaaacatgttccagggaactccagaatatgaaacatttcagacaatttgaaactgtcaaaattttcacttctttatgggacaaataaaatctaactttattcagattttaaagtatctcataaaagagtaatactttagatttgtgctgtgctttatacgaattggatgaggaactcttatacatatataagtggattttattttcacaacagtccctatggtagatattgtccttattaagtaaatgagagaaccaactatcaaagatattaatattttgcataagatcacacagatagcggaaccaggatttaatccaactcctctgattctaaaaataggtgttagatgggtattctttccccaaacctatgctgaaaggaggctacatttggagtcagttattgaaagtttaaatatatgtgtatatatatatatatatgtgtgtgtgtgtgtgtgtgtgtgtgtgtgtgtattcttatatactcatgcatgtagatagttataaagtacatgcttatatgtcaattttatatatacgactgatatataaactatcaatttgtgatagtttatttcaattaagttcaaacatattgggtatttattgactcatgggacttaaaatttctcagaggcattaatttctatgcctttaagcaaaataatgtttagcccgttttagaaagataaaaggctaacatatgttttgtttttgtttgttttgttttgttttgttttgttttgttgagatggagttttgctcttgttgcccaggctggagtgcaatggtgcgatcttggctcacagcaacctccgcctcctgggttcaagcgattctcctgcctcagccatctgagtagctgggattacagacacgtgccaccatgcccggctaattttgtatttttagtagagacagagtttctccatgttggtcaggctggtctcgagctcccaacctcaggtgatccacccgcctcggcctcccaaagtgctgggattacaggcgtgagccacggctcctggccgctaacacatgtttttaaaaaataaacaccattcgagtaggaaaagtgggagaactggtggttcagctagagatacggagatgggagggcaagttgctttctcatgttgccacatctgtaagttacaaatgccatagattaggaatttcaacgttgttgtgtctctctgaggacattctccatgtagtatatgtttcgcctccctgatggacagtaagcatcaaacggttactcctttatatttgaattattttaattctaacatcttgttctgaaaataacgggaatgccataaatacttactgattgattggactgtctcgcaggggagctggcagctagtgtaggctacaagctgccatcatcatctccatgaccatgagtcatcactggaattaccctaaagaggttaataaaacgccttgtttgaaaagcaaacaaaaagccagaagaaacccaaagcaaacagacccagactttgcaatgggtagtgaattttcagtcttaagggattgagagtccttttagtacaatctctcataaacatataacagattttaaaagcaccttggtctgattccagttcacatacctcatccttgcagaatacaacatactaggccatttgaaatgttcctcagtttacttttggaggatctgctgatttgagcaaaatggaaatgaaatgtatatagaaagctcttaatttttttttttttttttttttgagacggagtttcgctctgtcgcccaggctggagtgcagtggcgggatctcggctcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggccagctcttaatcttaagaagttcagtttcgcagctccccccccaccaacccccaatcttgaaagcaggaatttggattagggttttttaataaaactttctttttcttattaccatgatgttttttgagagggtacagagaactcattaaaatgttatgttataacttaagacaaaatgggaatgagaatttgcattatataaacaaagtgtatgactaagtaacctgttacatataaagtgtttgactaagtaacctgttgtccctaggagaagtagaataaatatcaacatgtggcaactaacagaatgtgttgtgatcactaaagcagcacattcattgactttacacttcattaagtaggtaacgaattttacaaattttaggacttaaccaggctgtccataatactttgcatcagtaagtaccaaaatctacgatagggcacttcggagttccttaatttaataatattgataatattttgtttacattttgatttaattgtatcatttcattatttttgtgtcctgattctaaatatatacgtcaacaagctatatggccattcaaaacaggtaaactttaaatatgtttttgacatagaaattatgtaacagtcttcatcatgagtataggagtcagatttccaattgaaaatttcatcctctaaaatacttggcatatgtatacagttgtctagttcagacaaaaaagtattgaatataaagttgattttgtaaaaccagaattggcatccttaaggaatacaaataaagggaatcttaagataatataataatgctgatttgaaatgaaaattaataaaattgttattctattttagtatgctaaattggacagatccttatttcattgaaaaattagattcttcagtatatcagtgcactgtgctaataacacaagaagattaaattatgtccatatgtgatttggtagaatttaattataaatataataaatccttcaatatgtacagcagtgaatattccaaatttatctctcatataagttgtgagcaacttaaggataggcaccatcccttaacatacctagattaagaacagtacctagaaaacagtcatcaaatgcttcctaaataaattttcaccttcaagcttatggcagcaaattaaacatagattgacccttttctaatagagacagaatagatgagactgatgacttttttttataaatgtgtaagtctgcaaatatttagtaaggatctaatttacacaaagaaatcaacctagagtgagattattttattcatttcccggaggctgtgactgaattatatttgcaacttgccctaatttttatacttaataatttgcattagtatttaaattatgtgaaggaaaaatataagtttaaaatactgaaaagtatattcacacattcatcaaatgttgattatgtgcttacagtgtgcaaggtattggggctaggaattatgtggtgttccaaggaaaccatgatacagcctctttcattacagtgtttattattaggtagaaaaagtaaaattagtataatattagataggatatatgtgtcataggagtaatataaacaatattttatgaacaatgtatgaaggtataattttgttcatttatccatttatcgctctgtacatccatccgtttattcattgttcattacttcatttaataatactttagtgaccattggaaaagggatttataaaagtgagtaaaatgttaatcattttctaaagaagttgataatctagggaaagacaaatgtgtaccaacaataacttggatataaagcataaattagaggtacaagcaaagaaaaatgaaagtacaaaggagaaaaatatttggctgcatgagagcagggactgtgtcttgtttcatcatagattttccagaacctagatcagtgtttggcacaaagtaggttcagatgagtttgtgttgactgactgtctactgaagtaattgtggaacatatcatagaagaagtagatcagaggctggatcttaaaactgggagaaatacatttcagctccgtgaaaccccagaagtgatatttgacattagaaagcacaaagtcacactctaacagtgacagtactgagtgaagtaagaattttctgcaccccttcttcttcttccactcccattaacccttgttagggtgagaaatagcagctggtgaatggtagagaagactagcaagacagaaagaggaagcccaccatgcccactaccccaggtagtaaaggacctgtccacttccatcctcttctaattgaggaagaaatcatatatgtgagttcagattgaagtattgattaatatattgagctggatattctaattttaatgtctcgatatggagcaggactttgtttccttaatgatgaccagaaaagacatgaaacttacccatattttcacccaagaacagaacagaacaacctacttgaacagatttaaagggagaaccaaaggcagataaagttgtctttattcttacacagcataagtcctgattattcatcaatttatacattttatgaatttaagaaaaaaggaaaggaagactataaagggattcatatcaggatacacatgaaggtaatgtagtcagttttttagtggaaccaaaatattacagtcatcactgaacgaaaatattacaatcattacatcattcactagattaagtgaataaattaaaaatatattaaataaaattaacaaagacatgagcttttcaaagtgtgtggtaacctggagcaataagcagtgtagttggaatgttacctcttaaggattatcaaagaggctggctgttcagtaggacagtggtatggtaaagcaagcttgctacattgcagaactccagagggcaacattctaattatctttagctatggggtctgttcccataggataactataacttagtaggttgacagagcctcccaagaaaccacagcagtgctcaattgtggcgaattacttctctatcccatcaaaatgtcgtgattggacccacaactgtgcatacatttttttggcattttcctgccagaagcatatttacatttctttaatatccagtcatatccttcccttatttaaaaataattattcagagaattccagttttttgtaatcctctcttctatgaattttagcaacacttatatacagatacttgatattctggagaaatatgcttcaagaccatgtggattaacagattttcaaatgccgttatagtatatgtatatactatatatgtataagtatgtgtagtccccaaaatgcgtactttaaaatcctcataatagatctcttacagatgaggaaaagaagatgtagaaaggttacataaagtagctaacaagtattccaaataatattgaacttcagtctgactattccaaaattgcattcttaactctgatttctatatttgttttccattctaaactgtgtattgtgatataagttcctcactaaggctctttttcagggtcttcctaatactaaagtcactcttacaatgagtattttctttacgtgtgaaatccaataggcaaaaaaaaaaacttggcaataaattttaggcattaacctcatgccaagtaattatcagaaggctgtaatgctttgaaacttcacaagtctgattttaagataatggaatgaggcttgcattgtgaactttcttgatgctttacattgcaatatgctgtatagattgacttcctaaaaataaaaaataaaaaaaaagatttgtagagcatactgggaaggtcttgccaattaaaaaccggagattggctgaaggcttgcagcaattgaattttgaatacagatggtgtcaaatcgagtgtttccatagcaacagactcttccttaataacttttagatgggagggggtacataaaagagaaaaccatcttttagcagatgtatgttttcagcatgttttcagattgattttggaagctaatttgtacttaactagtgattgttttaagtggatctaaatattactaaattctcctgaggaaacattttgagaataacagaaataaactctaggaactttataaagacatgaaaagggcacaattttacaaaacctttttttttttggtctggagccaatcaaacagtattttatattgagtatgacctatcaatagtcaaagagttcttgattcttaatgcctgttaatattgaatgtttagaatatgggtaaaatcaaggaaaaagtgctatgtatctcatggatttggaatatcttaatatactctttcttcaggttaatgattatttttaaaaaatgatgatataaatcatttcaggaaggactgcataaagaggtcattgatagagttcatatcatatagcagagttgtcgtagatttaatgtccaatcctcagttttgcatagccaacaactaaattttagtagtttacctagagatgatcaggctctgggagactgattcatgctacacaaactcacaaggcactggtttataaaccatttgaaagaagaaataataattcaaactattattttacaacaagactggcaggaaaatcaataatggtaatgtgttcggggtgtcctccccagtgaggactatccagaagaccaaatgatagattattgttcaaagtgatagaattgggagaagggtaataaagcattatgaaaggatgcttccttaagtgagaaaagctacataaactacccatctttactattctagatgaccttaaaaatattaatagaaacagagaaacagacaattcatctcagatggtacaaaaaacataatagcacatgtttgctccctggcttccttttagattccctgcaagaggttttcccccaaccaccaccatatacagatatacagctttaccttcactctcctattatctgtcacagaacaatataaaactcagatatgttagtataagttaatagttggtagctttatgttaatgacattgctacctgttacccccagattcatctgggttacttcatccccaaaaccctttcaaaacgacatttcccacaaagatttctagtattactggccattcccggacatcttgcttccaacataagaaattctgacataatagggatataagaaggccttgggaatctgtatttataacaagctccccaggctatctgaggctcagccagtttatttttgcagatagctattactatccacaatctcttttatcctattgtaattgcagaagaaaatctttctttctagtttctttgaaatttctggaatgttaggacttagagcctctaggaacttgtacataaaaagagagacttaaagagatatcaaagtagagatagagatagatacagataagtgcatagacatagaagtagacatatataatagaaacatatatgtatacatagaaatagaaatatgccatttagaactcttaagaaatatgtgcactcttaaaatatagtttaaaaatgtaaagaacttgctattaattgaaaatagcataataaacttaaatgaaataaggaccccaaacgcaaatatttctctctgacacaccacacacacacacacacacacacacacacacagacagagagagagagagagagagagagagctgtacaataacaaccaattcctgacccagataaagaaaaaatttttatttatcttctttctcattctattattattttttctagattaaattaaaatggtaattatgtgtaagaacaagcattattgccatataaacaatgcaacaaaggaatcaattgaaaattaagtgaaaataaaaggtacagcttcgttaaagacccagttcttagagcttagtctcaaactctttgtactctgcactcttttcttgatttgactcgattgattgattgattgattgattgagtcagagtctcactctgtcacccaggctagagtgtagtggctcaatctcggctcactgcaacctccacctcctgtttcgagtgattctcctgcctcagcctcctgagtagctgagactacagacatgtaccaccatgcccagctaatttttgtatttttagtagagatgggacttcaccatgttggtcaggctggtcctgaactcctgaattcaagtgatctgtctgccttgttcccccaaagagctgggattacaggtgtgagccaccacgcccagccgattttactctctttagaactgcaaaagtaggaatctagctcatatgcagacattctagaaagtttgatttcaaaagtcttctcaaaagaaagagagcaagagcaagaaagaaagcagagagagaaagcagaagataaaatggcattgtttgaacagggatggaaactgagtaagaaatttggtcactaaacactttagtgtctatcatttaagattgtaatttggttatttatcactggaaagtgattaataatctaaaatgcattttataatactaatactattaaaacattaatttttggagaaagtttattatagattgatttatacttaccactgaatattaaaatgtttaatggaagtagtttcaaatagtatttaatgatatagggaattattacaacattaatgctcaggaaaaaaagtaggatatggaattatttatgccataggatcctaattttgtaaaaaacagagaaaaccagcaaaagaaattataactggaaggaaatacatcaaagtggtttgcagttatcactcatgaaattgaggtgaacttgatttttttccttttatatccatccgtgttttaataccacagacatgctttagatctgcccgtatattgtggctttcagagggtaataaaccattgtgactcagaaatagctaagaatttttatctctcaagaacaaattttcactcccttggggtgtcattatctgttgagaatgcatgcaatagttcaagagccaaaagactctgattcagtaagtttagggtagaaaaaaattaagtacatttttaaaatagagctctggtgtttcaaaggcaatgtgcaaatatacctacttaatattattctaattttttcaggatagctgaaatataaacatctatttttagtaataacacaaatgatggaatgcttttacatatttataaatcattaaggatttgctttttgtttctactgtctggaacatataaatttgaacacaatttagaacaacattcaggaaatatgatttatttattaccttcttgacctttattttatttttaccatctacttttatgtaagtcttttttttcaatcattgtttatttctttacttttccttccacatagaattaaagggagattcgggcttagtgtccttaattcatagttccattgtggctattaaaaggtgaactgaaagcttgcaaacacgtggtaccttgtagataattttctccagtcagacagttagataaaggcctctgaggtttctggggtcattgttgaagctatgttttaaaatcctatatccttctctcattgttggttccttttcacaacacagaagttttcttttttttaatttcaacttttagatacagaaggtgcatgtgcagatttgtcacgtgggagtattgcatgatgctgaggtttggagtacggatcccatcgccatgttagtgagcatagtaactgataggtcgtttttttaacccactcccctccctcctccctctagtagtccccagggtctattgttcccgtatttatgtccatgtgtgctcagtgcttagctcccacttataagtaagtgagaacatgtgatatttggtagaacttttcatttttaagttaaaaaacaaaacaaaatgaggatgagtggaagaactattcagcacagcaggttataaaccaattaggatgatgacgccctgaatggagattttcatgaacatctcatattagctatttcagctttggtttttttaatgttcaaagtaaatagaataatgaagaggctatttaggaaggtttagactgagggaaaaaaatcctttcattaggttccaaataacggttagcttattaaacagcaagaggcagagatttagcagagaaaaaataaaaagatttaaaaaaaaacaacgagattaaaaggtcagtaataccattggaactggcagcatggcaagtttatatcagctatcttttgttttggaacacaactatgctaattctgttctgaacctcttgctaatgcctgtctcaagaaaatttaacatactttatctgtgtgtacaaaaatacctaaggacaaagctattacccaaactgtattcagattgaaagaatccatatagaaatttgcagctaacgtattagtcagtgtatgtaatttctactgcttcacagcacaactctttctaattttcaggagcaatatagcaactgcttgccagccaagagaaaaccataggagcattcttatcattggagccaacattagttctgcctacagtgactaacatagatgcgtttattgctagctggaattttccattggcactagttacatgtaataagttagtgctttcaaatggaccgtggaatataggaaaactagagtctgacgtaaccaaaaaaaaatgttgataaactcagagattatgaaagagaggagaggagtggtttttgtggaaatgatagaaaagcaaaaaaagatggcaggatttggaaaaaagaaaatcaggttagagatttaattagtaaaggagctccttttaataattatataagagtatgagtttagagtaactgcctggctaatatgtacaatcttcaagttcagtcgttttccaaaattctaacttttagcattttttttttgtaaattttaagtggaaatcttccacttttgttgactaacttggctacctgatattttactcaacctcctactttcttgttctctacttcttctgagtctttgcttccacaatgaggtagctcatattccttaagtttcctgtctggttttgcttttttttttttttttaacagctaaaataaactctacaagcatttctatcattttctttacatccaatctcttgtcagccatgtcctaatcactttggtaaagtatcagtgaccacccaagaggttcactttgcttcgtcaaaggaccacctgtcatgctttatctccagagcttctgccttgaaagtaagaataatataacctttcctgaatgtcttatttcaatttcatgcatttgatctgcctcttcagaccattcccaaggctttgcccttgttctttaccctcatggcttcagttattcatcactatatgaatgacagctctcaaactgacagctctggcctctcacctatttcatctattccatatggcaaactgtctatattacatttcatcatgagggataattataattccacattcaacaagaaattgtgggtccgtgttgatttccaacagcaacctttattttttagactatgatagagaaagggtcaactttctctcttacttatttatctcaaataactcaaagtcaagctagaaaagccaagcaagtaatatttcccaacaaagcagctttaagcaaaatgattttcagacacgacatgcagcctgtattgtggaagaagcacagtgacctaggtgtactttgctgaaaagcagtggtcacagtccattagtttcatctttttcctgcaagagagaaaagtatggcagggccaagactcctaagaccccttaaaaaattgtgaggtttttataaccctgttcatttcccatcaaaagcattcatgaagcacctgccatgtaccagatgatgcattctaggcagagggaagaacttgggcaaagtcctgtacattttatcttctaaatcttactaatcttttcttatctttccatctaccacccaccatcaggctgtgcctggactcctatgctaacatcttactctgtttttctgcatcttttttgccctcccctccaatctactctccaattagcaacatgactaatgttttcaagcccagattagacggtgtcacttccctgctttaaacctttcagtggattcccattgcactgaggttgaagaccaaaatctttaccataactcacaaggccactgggagctatgaaaattttcttttttagtttttccttttaattagtgatgcattcaataagtggagtctatcgtgaaagcatagattccaaaggcatgtgaatactcaattatgtaatttacttacagaatgtttattacttcttttttagctttgattttgtatacatcctaactcaatctcagttatataagagattataaaaaagtttgtgatgaatgcatacataaaggaacaaataattaacaaatatataaagacaaatcagtattgaatgaccaaatggctctttatttattaaagaacttagaaaaatatagtcttgcttgagaccaagttctggcaacgtatgtgtgtctttttgtttgggttaaaaagcattagttttatatgttttaaaaggataggatcttcccttggctgcaaatagtataggcaaaatgctattctgtatcttattttaaagaaaataacaatcataccttattatttgctgacagttttgcagtttacaaagcactgttcacatggattaccttattttaaattcctcaattttttttccttttactatgggaattctgtttcaggagaatttccctttaaaattaaggtgattatactattctgttcctgtatttcgtagccatatgtttcaccaaggtattgtctctctccaggtctttcttctctggatgtatagttatgattttccaggaggtaaatgaaaacagtgggagcaattgacagagtgttttttgtttcccataaacccaagcattgcatttaaggagctgctgtactattgtaagagttcctatactaattttaaaagttcatttacatattttgtagatttttaggataagtcatcagaaaaaaattaaaaataaatttacatattttgtattaagctgttttgttacttgaatggggattattggaacgaggaaagaattacttttatctccccatttttcaaatcatttactataacattcatgaattgctgaagtttaaacaatcaaaaatatctgaaaatggagcctaggaagggtaacttatgtctttcatactccttcctttttggtttttctaccagcattttagtctaaaatatattttattttcactgatcctgtgtttgtcttaataatatagtatgtatgttaaatgaaccagaattcattgatctttttttttattattcctctttttgcttttctggagaagcatttgaagaaatcagttcaggctacacttcatcaattcatttcctcatcttccccttaatacaaaagccccattttcactcttcaaaacatttgatcacatacttaattttcatagcattgactaaatgtatgtgtttattttgtttatatattgcatatttgtgatgattttcacttttacagtttaggcatgggtaggaaggacacttacatgagtacttaagttcttggttatgacttgagaaactcacaaggtagcatggaatggcacgtaaacaaggctttgatagggtgaaagggaattatcaggacaaaactgactagtggcagtgacttttgagcagagtgctgcaaactgaaaaggcagagagcattgtaggcagagagaaagcatagacacatgtgagatacatgtgaaatacttagacaaatgtgaggtgtgtggtaacattgtacatacctagggctccttcctgtgtagctgtaaagctggagtataggcatcacaacaggcagcagaagccaagaaactagaaaagtagacaaaggccacgttataaaagatcttgtaggataggtaaagagttttaatactatcctgaaagcagtgtggggtgggaggcatgacattaaggaaatttaataagtgatgaaagaccaagattttcatcttcagaagacttctctggaggtgggtggaccacttgatgtcaggagttcaagaccagcctggtcaacttgatgaaaccccatctctactaaaaatacaaaaaaatagctgggcatggtggtgcatgcctgtaatcccagctactcaggaggctgaggcaggagaatagcttgaacccaagaggcagaggtggcagtgagccaagatggtgccactgcacttcagcctggatgacagagggagactccctattaaaaaaaaaaaaaaaaaagacttctctgactagagttttaaagaaggatggggagtgcaaaaggctaacattaaatcagtggttctcatccctggctgcacgttagaatcactagggggagtttaaaaaaaatgccaatacttggactccaccccaaaccagttaaatcagagccttaatagggcccagacattcgtagtttttaaagcagccctcttgattcaaatgcacagacaaggttgtgttccgctgaactagagagaccatcaggaggcttttaactaaagcaatctagggaagagagagatgaatgatatagaggccagaagagctattaaggagaagtgactcggcatcttcttggttaaagtataaggaagaaagaagaatgaaggataatttgcatgtttctccttcagtgactaagtagaggaacagatgtgtatcagtgattaggggagaggaagaatgaagatgatgtaatccagtttggatatgttggctatttcatagagatttagtaggcgtttggctctatggatacagagttcaagagacaattcttagcttaaaacacagattttactctgattattttagagatagtaaatgaagcaatatacatacatgaactcaccagagagaatatgtaaagtgaaaacaaaaagatcaaagggagacccctagggaatagcaacatttaaggaatgggcctaagagagtgaggagtggccaaataggcagaataaaatccaagaaggaatcttccatattaatcaaaagagaaggtttcaaagagggttcgtcaattggcaggtactgaagggatatctgaaaacataaagactttagactctctaatactgtagcaactttaaggtcactgctatcacctacaaaagtaatttcagtggcaaaagccaaaacgtaatggtttagaagggtatgtgaggtgtggatgtggaaatagtgggtatagactattgcttctcaaaatgtaatcacctgaaaaatcttattttaaaatgcagattttgattcattagctctagagtggagcctgagattctgcatttctaacaagttatcaggtgatgctgatgctgctcatacacaaaccatcctttaagtagcactggtgtaagccactctcccacaaaggaggaagacatagggtttccatcaggggacgcaggtggggtgtaggaccaaaggaaataatactcttttgtcttttgtttggttggttttggttgttttcttcttaaaataaacatggttgtagacggagattgaagacataggaggggtaaaagatggaatcacttctcatagaagatggaagagactggaacattgagtacagcgagggaattaggcatgggtaggagggacacctaaatctgaagagaaggaggtaaggaagaattgaaatacagaaaagttctgtcagtaagcaatgtatggaattgtgctttttagccatagtttctgttcaagaaattgttttccatttatttttatttcttaacttgaatagttggatggtggagtatgcttgtaaaaataagagtgaggccactttgtttttcggggttaatttccgttttctgcactcatcaagtaaaagttgaagtggcaaggtgtagatatgaaattcagtgtgtgctaagggagaaaaaaatgctttttattctacatgattttaaaaatatttatattccaacaaatgcatcaaatttgatgtgcaaatttacagtgatgaatgagttttattgtgtgcattgcatgctggtgacatggtaataaatctgtggtgctagaattataatggtcccctttagcttcgctttaatgaactcttgctgaacacttttgagttgttagtactttatttgctacatttggcacttaattagttaatgactgagatgctggaccgatggatcatctaatgatatgttaggcctattatcacatctagatagtttcttttctgtgacttgtaagtgacctaagatgataaactgaaatatttttgcatagatatacatcaagcttttctcctaacttcaggctttcatcttaagcaatagtttccaacacccccaaaagagaagtcattatgtttttaaaaaaattattcattttaatgtgatcaaataatatcacatttcagcattcacctatttaattaataaaacaacttacatgtttcattatgactggatgttgatattttttcataatctattatcctccaaccagtggtaaaaacccaatcctcctctcacccagctcatctttccgtatgggaagcaatacatacttccctatgttttattaccaaaacaggagaatgagctttctttagaaggttaactcattttctctattagaatattcagcatacttttaaggaggtaatctggtctttgacagtctgttgattagaaaattaagagacctgcctaaattccatttccaactcctctccatacacattgtgactttgagcaaaacgttttgccatttccactcgtataagttctgtttagtatctttaaacttccatatcccacagatggtatttttttcttcattggaaagtggtgttagtgattcagaaaactgcttaaataatacactgctttgtgttttctgtgagagaatttttttttttttttgagacagagtctcactatgttgcctaggctggagtgcagtggcgcaatctcggctcactgcaacctctgccgcccgggttcaagcgattctcctgcctcagcctcccgagtagctgggattacaggtgcctgccactgcgcctggctaatttttgtatttttagtacagacagggtttcaccatcttggccaggttgatcttaagctcctgatctcatgatccgttcacctcggcctcccaaagtgctgggattacaggtgtgagccaccgtgcccagccgagagaacattttatctaacattctattttaaaatttttcaaatacacagaaagctgaaagaattgtacagtgagtgctcatgaacccactctctagattttgttgtatcactttacttctttctctacccgccaacccctattattttctgatgcccttcaaagtaagttggtgacatcggttccctttacccctaagttcttcaacatgcatgtcattaaccagagctcaatatttgttcacatttcttttgtttgtttgtttgtggcaaaatttgtatagactagaatgtgtaaatctcatgtgtattatgaaatgagttttgatgaatgggtatacctgtgtgacacatgcctctcttaagatacaaaaaaatagccttggcccagacaggagggaacattttttaggttggcttgagtttcctttaactgacatgtagcatgactgaatatatgaccataagattgccaagttgaaatttaccaaaggtccatccaggggaacagtatggctattgatacgtcatttgttcatctaggcactgggctgggtgagttcttcacaaaaaccttgtaaggtgagctttcagctctgacagaggcatcaagaaacgtatttcacaaactgttagagctgaaaacatctccagggatcatccaatctatcctcctttgctttatgactcaggatttaagaagccccagaaaagtccaacagtgttaccaaagtacacgattgcctatttacgcccctataattgagagctgtctaggggtcaggtacttttctcagtgccttgtgtacattatttccttttatctttctagattattaattttcttgttattatccccatataatagaggagtaaacagtgtgaaaatagcactaaactgttgatcttttccatgttccaaactaaccttaaatgttaggctaatattataaaattttaaaatttagtcatttgttctgggtctggcttccatgaacttaaccaaaatgcttggctgtttctgcattctagctttttgggatttagagaaaaagcaacttggtcatcatagtggccaggatttatttatgtgccaataactcccctctgtttttagctttttgatctgttacatctcaaatactttattctctatttgtaaaacaaccacattcctccttttctatatctaagtgaaaaaaaatgcccgttcatactagctacatggttagcatatatgtttcttcctctttgtgggtttgagttgaaacttcttttgcaaagcttaactatagataggtcttccacagaaccctgtttaaatgccttgtggaagtagaagggacatatcttaatattccttataatctgtgttattatttggactttcctcagttccttatatgtctttgtatgtcaaacattgagttatgcttacattactctaggtatagttgtgtcctagctttgtacaaggttacaataatggtggtttccttgttttcagcttcattcttgatcatgcctaacattttttgatggttttagcctcggagaacagtctactgctatttctccctttttcctgatcccaacaaatagtttagaaatctttgtcttaactgcaattgggatcatttttcctttagagttgcccacagttagtcatgtccgtcactcttcactcactcaaatgacctcaaaagatttacctgcaatttaagcctttcaccttggcattttctacctggaactctggcgtactctgtgggatcagtgagatccatagtgtgcactccctagcagatcgtgaatgtttgttgataactataattcattgtttagtcttgtctatacagagaagcagtagcaccttgctttagtaggatcctttatgcttttattcattattgaattttatcttcacaataattctgtggttctgcagttgtcattatttcagtttgggagttgaggaaactgagatcgtggcaaatcaacttttcccatttaaatccactatttcatcgctaatccagggttataacccaagactaactgctagtcaaagttgctttctaaaaatcagttacacagacttctaattctcgtgctgtacagtcagtgcagaaattgcaacagaactgttctttgttctgtagcaatgtgtattcaaaaggtaatcatttcttgtgtataaataacattcctccctaagagagatgttgtgggaatttatatcagtcaagaatgtatatcgataattaaacatagctagtctaaaaaacttgaagtgaaagattggttcgtattcaatcaactgaactgtttctttctctgcaatattgtggttcttgacatgattgctgagtttccaatttgacacttctggaggttcgtaaatcaggacacatgctgggtctcagtctgtcatcctgagtcttagcattggttatttatttccctttattacccaacatctatttactgcacaaattagtcgagaagctttccatgacggacctttgtgagaaaaaaaaaatgtgtacattgggtagctcttcaattacaaacatgcacagattgtctgggtttatgtgcatatactttattattatttcacttttgtatgtcagatgaatttggtgtaaatgtaaatctaacaatatgggctctagtggccaaatacattgccataatatgtttttgatctgtcagtctcctgggtgaagtgtcgcaagtgtggtaaaattctgtagtataaattgatgctcagttatggacaattaccaggtctatatgatgtcagactaccacactgatccacttttaggataacagcttcgctctgatgatcttcagattttagatttgctttcattccttgacaaaatgaaatacatttaaaacttctaaaattgtcttttgtatatatttctgcagggtctactcttgggactactataacaatcaattgtactgctttgtttcttttattaaatagcagaatagctgcttgattcgtctgtatgtgctgatgtgtgtctgtgaatctagtccagttcactgtccaataagaatttctgaaatgttctttgtcacatcaatgtacagtcaaaatcgtattgtgtttgtagcagaatgattgcatcttttattattcacagcagccaaaatgacacatatttcacacgtgacaccttttttaaaaaagatgaattgtccaaagttgtatgtagaatatatttcacaaatcaaattccctatttaataaatggtgctgggagaactggctagccatatgcagaagagtgaatttctataaatagaatgcaactgtgtaaatagcatccaaatcaagaaacataatataatatagccagaagctcaggatcccccttcatgtcttctccagtcatgaacatttcacaagggtgactactatccttacttcaaaagttttctattactttttcctgtttttgtgtattatatgaaggaatcgaacagtcatatctacttgtctgtggctgtatttttccccccaacaatatgtttgtgagattcatccatattattgtatgtagttgtggattgttcacttttcttactgaataatattctattgataccacagtgtatttacacatgttgatatagatgagaaattgagtagtttccaacatgaggaaattgctgtcaacaattctgcaatccatagccatgctatcaacagtctagtacatggtttttggtgaatatattaataactatgcatttctgttggatatacacctgggagtggaattacaactcaaataatattcattttaaaaattttatttcgtttttagtcgacaactatattatggggtacattgtgatgtttcaatccatatatatacattgtggaataatcaaatcaggctaatagcatatctatcacctcaaatacttctcatttttgtggtgagaatatttaaaatcctcctttttagctatttggaaatatacaatatgacaatattagctatagttcctgtgctgtgcaaaagaacaccagaacttattcctcctgtctaactggaactttgtacccattgataaacgtctctcatttttccatccacccaccactgcagcttttgatcaccaccataatactctccatttctatgagttcaactttttttaaactgcacatacaaatgagattatatgatatgtgtctctctgtgccaagtttatttcacttaacctaatgtcctccaggctcatccttattattccaaatgacagaatttcctaggtttttaaaattttttttttatttttaattttttggggtacatagtaggtatatatatttacggggtacatgaggtgttttgatataggcatgtaatgtgaaacaagcacatcatggagaatgaggcatccatcctgtcaagcatttatcctttgtgctacaaacaatgtaattgtacttttagttattttttaatgtacaattaaattattattgactatagtccccctgttgcactatcaaatactaggtcttactcattctttctaactattttttgtagccgctaacaatccccacctatcccctacctccacactaccctttgtagcctctggtaaccatccttttattctgtctccatgagttcaatagttttaatttttagatcccacaaataagtgagaacatgcagtgattttcgttctgtgactggcttatttcatttaatgtaatgacctccagttccatccaagatgttgcaaatgacaggatataattcttttttattgctaaatagtaccgcatcatttatatgagccacattttctgtatccattcgcatgttgatggacagttagcttgcttccaaatcttgcctgttgtgaacagtgctacaacaatgtgagagtgcagatagctcttcaatacactccctccttttcttttgagtatgtacccagaagtgggatttctggaacatatggtcattctctttttattattttgagaaacattcatactgtctttatggaggccgttactaattcacaatactaccaatagtggataaggtttccttattctctgtatcctcatgaacacttgttatctttcaactttttgataatagccaatccaaaagatatgaggtgatatctcattgtgattttaatttgcattttttgatgattagagatgttgagtattatacatatatgtgtgtgtatatatatatatatatatatatatatatatatgctgtttgtcatcttttgagaatgtctattcatatatttgcccatttttttattagggttatttgttttcttgttattgagtagcttgagttccttgtatattttggatattagcaccttatctaatgtatgatttgcaaatatcttctcccaatctgtgggttgtctctttattccattaattgtttcctttgctgtgcaaagctttttagtttgatgcaatcttacttacctatttttgtgttgattgtgtttgggggtcatatgcaagaaaccactgcccagaccaatgtcatggagctcttctcttatgtttttgtagtttttagtttcaggtattacatttaaggctttaatccattttgagttgattcttgtataaggggtgagataagggtccagttttattctgtatgtgaacattcagttttcccaataccatttattgaagagactgtcctctccctattgtgtgttcttgctacctttgtcaaaaatcaattgatcaaaggtgtgtaggtttattttagtcctctttgtcttattccattggtctgtttttatgtacttgccatgctgttttgattattatagctttgtaatacattttgaaatccagtagtgacatacttccaattttattctttttagtaaagacagctttggctatccagggtcttttgtggttccatgcaaattttaggattttttaaaaaaaattctataaagaacaatatgcagattttgttagtattgtgtcgaatctttagattgctttatgtttaacaatattaatttttccaatttatgaacacagaaatctttccatttatttgtgtcatcttcaatttctttcgtcagtgtcttatagtttcaacacgcagatctttcactttcttggttaaattcactccaaatattttttcatgctattataagtgagattgtttccttaatttctattttagacagtttgttgttattgtacaaacaataacaattgttatcgctactgatttttgtaagttgattttgtaccctgcaactttactaaacttgtgtatgaattctaacagttttcagtggagtccttaggatttgctgtataagattatgtcatcagcaagaaggggcaattttacttcatccttttcagtttggttgccttttatttctttctcctgcctaattgctctggctaggactcccagtactaagttaaacaagggtggggagagtgggcatctttgtcttgctcctgatcttagagaaaagccttctacgttttactgttgtgcatgatgttagctgtgggcttgtaatttatggcttttattcttttggagaacatttcttctatacctaatttgctaagagtttttctcataaaaggatgttgaattttgtcaaatgctctttctgagtttattaaaatgatcatacggtttttgtacttcattctgttatatgttgaatcacatttattaatttgcatatattgaaacaaccttctatcccagggataaatccctcttggtcatggtgaataatccttctaataaactattaaatatggttcactagtatttcattgagaatttttgcatctaatttcattcgtgatattggcctatagttttctttccttgtagtgtctttgcctggctttgggatcagggtattgctggccttgtaaaataaatttggacgaatcccttcctctttagttttccaaaagagtttgagaaagatttgtgttaggtcttctttaaatgtttgtagaattctcccatgaagccatctggtcttgagctttcctttgatgtgagaacttttaaatactgatgcaatctccttaactctttccttagctgttactggtcttttcagatttccaattttcattattcagttttggtagattatgtatttctaagaattcatccatttctgttaggatgtccaatttcttggtatataattgttcatcgtagtctcttaggatcctttgtatttctgtgttatcagtcataatgtcttctctttgatttctgatttgatttatttgagcctgctctcttcattcttagtctagctaaggatttgtcaattgtgtttagcttttcaaaaaaccaacttttagttttattgactttttttctattgtttctctagtctctatttcatttatttctgctctgatctttgttattttcttctttctgctaactttgggcttaattcattcttctttttgtagtttcctgaggtataatgttaggtatttcatttgagatatttcttcttttttgatgtaggaatttattgatataaacttccctcttagcactgcttttgctacccccagaagtttttctatgttgtgttttcatttctgtttgtctcaagacttttaaaaaatttcctcttgaatttcttcttttgacccaataattgtttaggagcatattgtttagtttccacatatttcttaattttatatgatttctcatgtaattgatttctaattttatattgtggtcagaaaagatacacgatgggttttcttaaatttgttgagacttgtctgtggcctaacatatgatctatcctggagaatgttacatgtgtacttgagaagaatctgtattttcctactgttcagggcacaatgttctgtatatgtctgttaggtccatttggtctaaaatgtcattcaagtccaatgttttcttatgaatttttctgtctattgcttaaagtggaatattgaaattgcctgctattattatgttataggctatgtttcccttcagatcccttaatgtttgctttatatatttaggtgctctgatttgggatgcttatatacttgttatgtcctcttgatgaaataacctttatcaatatataatgatgttctttgtcactttgaacagatttgacctaaagattattttgtctgaagtaagtgtaactaccctgctctctttttgttctcatgtacatggagtatcttttttcatccctttactttcagtctatgcatgtcctttaaggtgaaatgagccacttgtaggcagcacatatttgggtcttgttttttgttgttgtcgttaatccactcaaccactctatgccttttgattggagagtttaatctatttacattcaaaataatgatggatgggtaaggacttactagtgtcattttgttcattgtttcctggttgtcttacagattctttgttcctttcttcctctattgctgtcttcctttgtgttttgatggttttgtgtagtagtatactttgggtcttttgtttttatcattcatgtatgtattataagtttgtgctttgtggatactccgaggcttacataaaacattttataagctgataataacttaaatttgattgtgtgcatatactcaacactttgactctccctcctcccacattttatgtttctaacatcacaacttacttttttttttaattatactttaagttctagggtacatgtgcacaacttgcaggtttgttacatatctatacatgtgccgtgttggtatgctccacccattaacttgtcatttacattaggtatatctcccaatgctatccctcccccgtcccctcaccccacgacaggccccggtgtgtgatgttccccttcctgcgtccaggtgttctcattgttcaattcccacctatgagtgagaacatgcggtgtttggttttctgtccttgtgatagtttgctgagaaagatgatttccagcttcatccatgtccctacaaaggatgtgaactcatccttttttatggttgcatagtattccatggtgtatatgtgccacattttcttaatccagtctatcattgatggacatttggattggttccaggtctttgctattgtgaatagtgcagcaataaacatacctgtgcatgtatctttacagcagcaggatttataatcctttgggtatatacccagtaatgggatagctgggtcaaatggtatttctagttctagatccctgaggaatcgccacactgacttccacaatggttgaactagtttacagtctcactaacagtgtaaagtgttcctatttctccacatcctctccagcacctgttgtttcctgactttttaatgattgccattctaactggtgtgagatggtatctcattgtggttttgatttgcgtttctctgatggccagtgatgatgagcattttttcatgtgtcttttggctgcataaatgtcttcttttgagaagtgtctgttcatatccttcgcccactttttgatggggttgtttgttttttcttgtaagtttgtttgagttctttgtagattctggatattagccctttgtcagatgagtagattgcaaaaattttctcccattctgtaggctgcctgttcactctgatggtagtttcttttgctgtgcagaagctctttagtttcattagatcccatttgtccgttttggcttttgttgccattgcttttggtgttttagacatgaagtccttgcccatgcctacgtcctgaatggtattgcctaggttttcttctagggtttttatggttttaggtctaacattaagtcttcaatccatcttgaattaatttttgtatatggtataaggaagggatccagtttcagctctctacatatggctagccagttttcccagcaccatttattaaatagggaatcctttccccatttcttgtttttgtcaggtttgtcaaagatcagatggttgtagatgtgtggtattatttctgagagctctgttctgttccattggtgtatatctctgttttggtaccagtaccatgctgttttggttaccgtagccttgtagtatagtttgaagtcaggtagcgtgatgcctccagctttgttcttttggctcaggattgtcttggcaatgtgggctcttttttggttccatatgaactttaaagtagttttttccaattctgtgaagaaagtcattggtagcttgatggggatggcattgaatctataaatttccttgggcagtatggccattttcacgatattgattcttcctatccatgagcatggaatgttcttccatttgtttgtgtcctcttttatttccttgagcagtggtttgtagttctccttgaagaggtccttcacataccttgtaagttgtatttgtaggtattttattctctttgaagcaattgagaatgagagttcactcatgatttggctctctgtttgtctgttattggtgtataagaatgcttgtgatttttgcacattgattttatatcctgagactttgctgaagttgcttatcagcttaaggagattttgggctgagacgatggggttttctaaatatacaatcatgtcgtctgcaaacagggacaatttgacttcctcttttcctaattgaataccctttatttctttttcctgcctgatcgccctggccagaacttccaacactatgttgaataggagtggtgagagagggcatccctgtcttgtgccagttttcaaagggaatgcttccagttttgcccattcagtatgatattggctgtgggtttgtcataaatagctcttactattttgagatacgtcccatcaatacctaatttatcgagagtttttagcatgaagggctgttgaatttggtcaagggccttttctgcatctattgagataaccatgtggtttttgtcgttggttctgtttatatgctggattacatttattgatttgcgtatgttgaaccagccttgcatcccagggatgaagcccacttgatcatggtggataagctttttgatgtgctgctggattcggtttgccagtattttattgaggatttttgcatcgatgttcatcagggatatttgtctaaaattctctttttttgttgtgtctctgccaggctttggtatcaggatgatgctggcctcataaaatgagttagggaggattccctctttttctattgattggaatagttttagaaggaatgataccagttcctctttgcacctctggtagaattcggctgtgaatccgtctggtcctggactttttttggtttgtaggctattaattattgcctcaatttcagagcctgttattggtctattcagggattcaacttcttcctggtttagtcttgggaaggtgtatgtgtgcaggaatttatccatttcttctagattttctagtttatttgcgtagaggtgtttatagtattctctgatggtagtttgtatttctgtggtgtcggtggtgatatcccctttatcattttttattgcatctatttgattcttctctcttttcttctttattagtcttactagcggtctatcaattctgttgatcttttcaaaaaactggctcctggattcattgatttttttgaagggttttttgtgtctggatcttgtaggtatgcttcattgtttcttattatttttttcttttgtcttctctggctgtgtattttcaaataggctgtctgcctacaagatccagaaaatagcctcaaaagggtcaatctaagagttattggccttaaacaggaggtagagaaagagatagggatagaaagttgatacaaagggacaatatcagagaacttcagaaacagagaaagataccaacattcaagtacgacaaagttatagaacaccaagcagaattatctcagagactacctcaaggcatgcaataatcaaactcccacaggtcaaggataaagaaagaatcctaaaagcagcaagagaaaggaaacaaataacatgcagtggagcttcaatacatctggcagcagatttttcggtggaaatcttaggccccgggcatatccagagatgctgtctgagggccagtcattggagtcaaaaaccttagcagtttacctcatgttctattctattgtggctaagctagcactcacaccacaatataaagtgctccctgctcttccttgcccttttaaaaggcagaggatcctctccctgtggccctcaccaccatgagggttctgcttggcctccactggtgttcacttaaagcccaagggctcttccatcagcttgtggtgaatgctgagagaactgggacccatattttagggccttgggctcccctctggcccaaggcaggaccaaaaatgctgtccaagaacctaggccaggactcagaaatcccagaagcctgcctgcttctctgcctttctgtggctgagctggtacctaaggggcaagacaaagtcccctttacttttctgtctacttttctcaaacagaaggggtctttcaccataaccaccacagctgggaatttgctgggtgacctatgaagccagcacatctcagaggccaagtcccacagtgtactccctgggtattgcaactggttattcaacgttcaaggcctctttagttagtagctgatgaatcctgataggactgagtccttccctttaaggtagcagattcccttttggcccagggtgtgtctagaaatgctatccaggaactagggcctggaatgggggcctcatgactctgcccatgccccatcctactgtggctgagctggtatccaagatgcaagacaaagtcttctttacttttcgctctcttctccttaacgagaagtaaggagtcacttctgttgctgcaagcttcactgctgggagtaggggaggtatggtgcaaccactcccttagccatgccagctggtgtctccctaggtcatgtgggagaccctaatccactggcttcaatatatagagggacgtttctaaattatttatctgtaatttgattaagaagatagacacaggcaataggatatgccaacagattctctctaacctatagttattttaagaaagttagggaaagagaggtcattgattagttttggcttactgaattatttgaccctcccatatcttttaatttatggattttatataaggcacagatattctactagtaaacatgacattaaagatgttttatacaaatgaatgtggttgatacaaaggcattaaataagaaacaaaggaaattcagaggacatttgttcgcctggaatagagatcattagcataagcataagaggaaaataaggaaggaaatgggaaagtcttgagtccattttcaaattatgaaaacttgaaatgcaacaaacaaatagtggttacttaagaagaaagactgaagatgctgggcaaaggttaactttagaaatggcatttttatatcattataaagagaaagtggggataatggaaataatctacatgtacaactcatttgacagacatttattgaaggtattccaaatgccaaacactagtttgtgcactaaggatgtttttaatttttactttttactttatttttattttctagcttcttccgctttgccagagaaggatttttttaaatggataaaatactaacttaggctagcttctttcagaaacagacctttaaacaatgattaatggtgaaagtggtttggttgtaatgtgatcccaggaagtaccagtaggagagtgggacaatgagataataaatgaaagaagccaataattaagccagttatggaactagttattgctttgggccactggggtttgatcctgatgaaggagctctgggagatagtaaacaaacaaacaaacaaaaaacatgcctcaaagttgtcaaccacaagggggtaaaggcaaggaaccagggctaactattccaactcttatccatcattggctaaatgcttcctggtacataaactttccagcacttctggccagcgcacctagcaagctgaggaaaatctctcaggtttgcagtagggcaaatgcttgtactaggacactgctggcatatacttgaaggatgagtgccaacggcagatagatgggccctgacagcatcttctacagattctgtccttgcctttgaggcaaggacactgtctagagtcagagacagaaatgtaaaatgtaaaaatgtaaatcatagtagcacacagtacaagttttaaaatcttaacaaagtgttatgggagaaccacggtgagagaaaatgactgcacatatgagagcaggggaagtctttatatgtgatgatgacatttgagtgggtgttccgttatcaaagatctacttaaaagggaaaaagagtagaattattttaaaccatggatgtaaccaggcgtggccaccctatatgtgaatgtcctgggataattttgtccccagatgtctctctttttgagtgtcattttcatttatgtattcataatataaagaaattgaatagaaagaggtaaacattggtggcaaaaatcccttcctacccataaggctcacagaataatgttgtctaaatgccataacatttttggtaagttttggttctatgggctttggaaattttttatgtaggaactcctccaaggtgatataagcattcagtgtatttatctagataccctagttaaagctactttaagcaggatcaaagtcctcttttaaacttttgtatttgaaagctattcccatgtacaattcccatgattcttgtacaattcctaggagacctttgtttacatcaaaagagtttgtctctctctataagttagaacttgtacattgtagtaatggaaaatccatttcaaagtagcttagacttactcagacaaaatgtattgatcagtgtcattaaacagttgaaagatagacgaggcttgattcaggaattaaatagcatgaccagattctagttttccttctccattgcatggctctgctccccagtatttgttccgtttaattcctcttaattgttctaagatggatatcaggatactgcagaactacgtgctttctcatccatcttaaacaagaagcaatgggttttctcttttagaatcacgaacaacaacaacaacaacaaaaatcctagagttgtttcattggttctgattgaccttacttggaaccataagtccatctttgaattaaccactaaagccagggagatgagttaaaactaagtacacaccatccacagagcaaagagaggtctattgtgggaaaactgcacaaatggaaaaataacaggggaaacacaggagaaggaggtagttagttaatgttcaatacacgcaccttctcagggacttttcttccatctggcatcatctttgtcttttgaccattttccccaatcaatacctatattcatactcaagttttccatatttgggaaaaaacttctcttgacaccaaactcccctctgacttccttcttataatgatctatggttggatagtctacaatttactgtccttactttttcataggtattttttaatctcctacagtaagatttctaccactgcactgaaatcattttgtgtatggtcttcagggaattccatgtggccaaagccaatggatacttttggcatgggctttggaggtctaacttcttgaatccaagtgtcggctctaacaatcactatctatgtgaccttagaccagttatttaacgctgtctttatttcctcatttgttaaatgaggataattgcagcaatagaaaaagaacgtaaacaattatacttataggattgtatgatgattaagtgattaatgcaaggaaagaacaacacagagcttcagacagtgtagatattcaaataaatgttagttatgatttttattatgtcttgtgacatctatgagatttgaaagtgttaatcactcttgtgtttttgaaaatctttcttttccatgttctataaaagtacactttcttgatattcctcctccttctctagtctttcattcatcttatttgctctttgtgttttatttattctttttacgttgtattttccaggagtccattcccagcccggtgttgggctcagtctatgtgccatataaatgagaatgcacttgcatttgaggctttgctttttatttctctgtagtgacggccaatcccagatttctgtctctcccaaaatacacagctatgctatagatccttcagtcctcctgactaaaatgttagttttattggttgtgttcctcacaacctccccagtgaataggtccaaaactgaactcattatcttctccatgctcactctgcattctttggataggcagtgaatagcaccactatctaacaggcacctaaaccagaagccaggtaatctgtcttaaacccttttgttttccaagttcttatcataatggctggtgtctaacagatggtaaataaaatagagactagctggctacatggatggatgtgtggggatgcacagagggatagatggattattgagtgagtctctagcctataaatatttttaattaactaataaattatgataatgtacagttgaaggtcaagggtgaaaaagcataccctcagtgggatgcacaccccaaggagccattttaacttgctacataacacacatatgaccacttttttgctgaaagccttctattattgagcaagcattcaaatcccatgtttgcctgaaataatggttcaggttataaaagtttccttctttttccaggattaaaattatcttcctacataataggaagaactgctttatcttttcctaatatctagagatggccttttaaaaatatagactgttttccctattgaaatgaactgtaggatgtacaaaatatttactggcatgaatcaaaagagcttgctatgtttatgtgaaaaccactaggcattctaaaaaatattgctagcatagtaaaatgttagtaattaagactaacgaaagcgaaggcaaattggaatcagagactatttttaaggaatgtcaactgtattattttcaaatacacatggtacataacagtaggatatgagaaaaagtcccaagtatgtgtactaaagtagcctgctatgataagttgaaaaagggtttgtaattggaatatccacagaatatttcagaacacttaaagacattttcatttacactttatacagctttcttataagagcatttacaccatttattttataaaccaaagattaattagaagactaaacaattacaaggcctcaactacgaaagctgttccactacctagtggaacaacaacaatgagacacacaaaacaatggcgttcaaagattagagagagacttacggttaaacagaggttgacatgttaactgaagttgcaatataatatgtcgactagttttgcaatacatagcaaacacccaaacagaaataaacctgataaaaaaacagtagtctataatgtgtgccacttactgagttttaattattctggggactatatttttgatttcatgttacaatcactagttttgtggggtctttctagtcctgatgcttatttacaaaatatctgaagtatttctttctatgtatttatttttgagatggagttttgctctgtcacccaggctggagtgcagcggcatgatctcggctcactgcaacctctgcctcccgggttcaagtgattctcctgcctcagcctcctgagtagctgggattacaggcgtgtgctaatttttgtatttttagtagagactgggtttcagcatgtcggtcaggctggtctcgaactcctgacctcatgatccacccgctttggcctcccagagacctgggattacaggcgtgagccaccgcacctggccatctcaagtatttctttaacttataacttcacataactttgtggaggcaacagggttaattaaaaaggactttacttacataacaaaataagaagcatagttttatattcctgtgccatatacattttgtttgtccatctgtagccattctttgaccttctctcccttgctctttattctgggaggctgacctctgtcatcattgggctcccatgccctttggcttccagttggtttaggcacccaagagccctagaaggaaattgaagacaggaggtaaagtgaggtcaagatatttattctcctaattccctccctttgaggttgccacaggctgactatgtcctttgacaaaaggttattgctcttctcagggtggtttctcattccaattctctgcttttggccacttttccctcccctcatcccttgggcctagatgtagtaacagctctactgttgcaaggttcttgtattatctgtgatggtttcttataccctgcttatcttgtgatttgttgctttgtagataaacctctcagattatctaggcaagatcatagaagaacacgtatgtccagctaagatattccagaagacagtagggaaacattgaagggttttataagagggagtgcagtgatcagatttatgttagttttaatctttaattggggtagaatttacattctaaaacagagatttgggtctgggaggatgatatagagcctcttatggatgtgagggcaaaaaatgatagaggtttgcagtgccaatagaaagaggaaagaagttatatatgagagaaatttgtaactaattatatgaggtgttgggtgacgcttaggaaagaatctagaatgtctatcaggtttcatgcttaagggataaagtagatggcagttttattacttgttttctgtattatttttatttcataaaaccagcttagagaagttgcatagaaaaaataatgtagtcctgtttattttaatatttgaaaagaacatatttcagagtagaatctatatagtacctccctcttggacttccaatgataccagtgatagcctcaatataagccagtcttgcaaaatgcacccagcgtgaattcttaggtattgttaaaagaagttggccaggcgcggtggctcacgcctgtaatcccagcactttgggaggccgaggcaggtggatcacctgaggtcaggagtttgagaccagcccggccaacatggtgaaaccctgtctctattaaaaatacaaaaaaaaaaaattagctgggcatgatggcacgtgcctgtagttcctgctactcgggaggctgagacaggaggatagcttgaacccgggaggcggaggttgcagtgagcggagattgcaccattgcactccagcctgggttacaagagcaaaactccatcaaaaaaaaaaaagaaagaaaaagaagaagtttctaatacacttatcttcccttgggttcactcagaagacccttggaaaaggttttaagagcaagtgatttatttggggggtaaattaatcagtagaagagtggaaaaatgagacaggtgaggcaaggcagccagtaaagagtggtgcattatcaagccagctgctgttgtgggtcactggagctttatcccttgggaaactctggaacccttgtaaaatacatgcctcaaagttatttcccctagcatcaagggagctagtgtaacaatatcccaattcctacaattagtcattatatacaggctgcctctgggagctggaggggaggcatcagttgcctggtatgtctagcctgtcacatggatggcaaagcaaactcctgtggcaacagaaagccttcaggcaatgaaatgctggcactgggaaaatcaggctgatgggtgctgaagtggcaaggatgaggggatatggatattctgctgtagtgcttttctaacagatgattcatatttggttctagggatcaagaattgagttaaaattttatatatatgttgatgttctatgtcaccttcaggaaaataatttaacagaaactaatatttgccatcaaaaaagcaaagaatcctgttgttcatcatcctagccataacacaatgaataattttttaaataagcaacataaatgtgagataacgtttggaagttacatttaaaatgtctcctccagactagcatttactactatatatttatttttccttttattctagttgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaaggttagtatcaaagatacctttttaaaataaaatactggttacatttgataaaattataccatagattgtaatttaatgatgtttaatgtaaagttattaacagaaaatcacgttaaagctgaaatgaacagtagactttgtatatttattttcttagagacagagtctcactgtcacccaggctaaagtgcagtggcacaatcatagctcactgagccttgaactctggggctcaagcagtcctcctgcctcagcctccctagtagctgggactactagccaggcgtgtaccaccacgcctggctaattttttaaaaatttttgttttctgtagagatgggttcttgaactcttggcctcaagcaattctccttccttggcctcccaaagcactaggattacaggcatgagttagcatgcctagccagtagacttttgagtcaaggtagagaatagaggaaaattgacagctaatgtcaatgttaaagttaattttgtttagtaatctggatatagttggctggttttctgttgcaccatctttaagatcacttcaaaattggtatacgtatttatgtagttgcatgaagtcaaccattcgggcttaattccttcctagaaaaagtaacaggtctactctttcatatcttatttggaggccctggatcaagaaatgggggtgagtgggtatcaggattggggaggaataaggagtactctcactttctccccccattctcttacctccagcccagctcattcttctcttctttctctttcctctgaaatttcctcaaatatctgtctgcttagtagtctataattcctcaggataaaagaaaaaggaaaaggaagaaaattgcttaataactatgttttatcaagcagcatgcatagtgctttgcatgcgtttaatcccttcaaacttagtatttactagtcagtttgaaaagcccttaaatgttaaacaatggttaagctttagggtattttgagcagggaagtaacatggtaggaggttgatcagattgggcacttgatcaaaaccctctatagatattttatctgacagaaaaggccttttgctaaaccagtatctgattctcaaattggttatgtcatctaagaaggaaaccgtatcattttcttggatgaaatggcttccatttccaaattagtcaggttaggctatgctaagctatagtaagaaatgaactctgaaatctcaatagcttaacacaataaagactgctttcttggttatatcatagtccagtagaggttgacaagccattcttaggagctgtcccccaacatggtcacttggaaacccagacttttccaattttgtgacacttgtcattttcaacacactgccaaaagccactgcagaaaaggaagacagaatgtggtcagtcaatccatggtgttttatggccaggcctggaaattatgtatatcacttccaccacatcccatcacacagaacttgttctcgattgaatttcaggaagagttaatggaattagtgagcttttagccaatctctgtcatagccattttatcgaagggacctgagctgctatgaggacaaggttttagtttatatgatgaggatgttagaaagccacatagaattttacagtcttatcattagctctgttggagtcaaaatctaggtgaataaaaattctttcaagagacacatgttaccactaatggttttttcaatggatgagcatagatgaattaggaatctccaatggtcattttcctaattcctggtctgactatgtaatatatagaatcatgtggttattcttgaaagctctagtcatattcgtgaggtagtcagcatgttatgctacttctttttcttctctataagtttcggatactatgaatctattggatcacaaaccaaagtagttaactggtaagaaggtataagcagaaaatacgaagtttggactggatccttgagttagatgagaagaaggagagatgagaggcatacagtgatagatttgactagggcaagaggactctggtagttagcaaatgagaaataaatttaacctaagaaaatcctaaagtgatggtaagaatggttagggtttaattgctcttagaagagcaagtagctttaaataagagacaaaaatatctgcagaaggaaatatgaaagtagaaaacaaaacaattgcattgtcaaaacatgtaagatgttttaatcacctaaaataaaaccagaattgtattataattgctatcctttgtcaaacttttgaaattaaaaaaaaaaacgctttggaatggtctaaaactacatcataaaaatggctcagccactatctatagagattgacattttttgtttgtgctctgtgtttaggaatttaatgatgtgtattgctgcagattcaatgtaagttcccgatacagataaagatggccaaagctgtaattttttcatccatttcttgaatgatgtatgctaaaattaaagtaatcctaatgttaataataacttttagtgaatgcttgctgtgtgtcaaaaagtatgctagtcactttatatatattggtttatttcatcctttcaaaaacactctttgaaaagtactcttattattcttagtttgcagagaagaaaactgaaggctagagaagttcagaatcttcttttgaaagtagtagagttgtgatgcgaatgcatagcaattactcttgtagatgacctcacaggcttcctcttccaattgtctacgtggctaaaacaaagcaagaaaaccccataagaatctgaaaaagactcatgtaattattaattgacaaataagattatattacattactgataaaccaacaggtagaaaatgaaagcaatgaaatagtatactgcgaaaaaaaatttcatattatattctttgatgaaaaaataaaacaataattgcaaactgcatttcatttttaatgaaacgacaatgtttaattcttctaaaaggtagggagcaaataaaatggttatctggtctttacatcgaatgtgtcatcactactaagtgatattagctggcttattacttaaaattttcttttaggaaaaaagtgtgaaaatagacaggaggagacattaaatggctaaagcaacacccccttgctccgtaagttctttctgagtctgtgtgcctaagattaacaagagagcctgtgagcctcacaaggcaatcacaaagctatgtctacagccttggagagctgtgattacagcagccagcctcctttgcagcacctcagtgatgactacactaactctcactactgagcaacaatgaaatgtttcaaacccaaccaccaacactgttataactcttaaaatttgagccagtcaccatacctgaacgtaaaaagaaaattaccaaaaatgcttgataccaaaaagcaattaatgattcataattgctaatctttattgacagtctcttctagttcttatctacatatattttaattgtctacataatgtaaattaaattttaaattctgatttgtaaacttaatattgcataaatatttatcaatgttgttaaacatcttttaataattattttaacttctttatattatttcattaatttccatctttatgtccttgctggtctgacatttagaaaaaactcctccttttatttagaaaaaaagaatggtgaggccgggcgcggtggctcatacctgtaatcccagcactttgggaggccgaggcaggcagatcacgagatcaggagtttgagaccggcctgaccaacatggtgaaaccctgtctctactaaaaatacaaaaactagcctggcgtggtgctgcatgcctgtagtcccagctacttgggaggctgaggcaggggaatcgcttgaacccgggaggcggaggttgcagtgagccaagatcacgccactgcactccagcctgggtgacagagcaagactctgtctcaaaaatacataaataaggagaataaatggggacaataacaacctattcacagaacagaaataaaaccggagatgtcatgtggaaaaagcttatcttgaaagcgtggtcagagtggaaagaaacagcaacaggagagtcttgatttggtgaaaaaacagaatgcagatggcatagagtatcaacaattaattagcaggccatcaagagacggccataacatattggtaattgttttctttcacccttaattttttctaaaacaaaaacatgaagttagaaagtagttaattttgttagccacatggcttcatggtttaattttatcttctctatgggcctggtacaacaataaagttcttttgagatagaaagacagatgttaggcaaaaacatacaagattttcattctaatcaaaatctttgccaataggctatgacagaatcctatgagagatgatgccatttagaactttcacaagaggcaaaaatagtatgccattggcacctaaaactgccaacagtgatcatcataggatttatttcatttggcggattcttggttgagttcataacctgttccctaggcttttaagattggtccaaacttggcaatggattctttggaaaaattatttcttgatcgttttaaactttcttttccagtgtcaagagagattttcccaggctccgagttttcatttattttttcccctgtcagtttttgaaagagaaatcccctttttgtcggctttgtgattgcttttgtgtcaaattcagcataaaagcttttcaaacgtgacagcattagctgttttgtgcttggctgagctaagagtacatgaattcaatagagaagtgaaatcttgtttgagcctggctgatttggctatataatattgaaaactatctgaagcaagaaattcaatacttttcaaattattgaataaacatttctaaggctgcaaaatctctgtgtttttgaaggcattctttaggaaacttgaaacacagacattctataatcacataattaattttaaaagttgaacttattgtatgtagtaactaaggcagctatttgagtgtctcaaattattttactaaaaagggagacatttttcaaatatggaagtagtgccttacatttttagttatctgtggaaggatcgatggcatcatatatctcatccaccataaaaatatgtacggtagtggaaactgaatttttcttttatatattttgtgtattttttggagttgtacaaaattaaatcagcaaattgacccacactagtagtttgaggtttgggtttctggtacaataatgaaaagcattattagaaatcttcttgccaggacctaccatttcttcatgtattttctttattcccttttgttctcccctaaagcttctatgtgattaaagagaaaagatcaataacccaatagtacttttccttctaaagtatgcatgaaactcttaaagttctcaaagcatacaaacagagtgctctctacattgctgatagaacacaggtagtaatgggctagtttccccaggtaactattatattatataaatatttaatgcagagtcaccaagccttgaataactttatgctttgattgtaccatattttctctagtttgcttttcacaatttaacttatcccgtgcttgaaaatataatgtggtaactgtgtaaatctgctcctcaaaaaattttcgaaatcatcttttcttttttcttttctttctttttttcctttttttgagatggagtctcactctgtcacccaggctggagtgcagtggcatgatcttggcttagtgcaacctccacctcctgtgatcaagtgagtctctcagcatcccaagtagatggaactacaggcacattccaccacgcccaactatttctcgtgtttttagtagagacagggtttcactatgttggccaggctggtctcaaactcctgacctcgagtgttccgcccacttcagcctcccaaagtgctgggatacaggcgtgagccaacatgcctggccccacatcgccttttctgaaccctgggaattaaccaaaggctggcaacaatttttgaaatgctgactctcaataaaaatggcaaagtttgaggttttttaagttggcctttcccgtcactttctcccagctccacagtagccttgaaaatcagtagccttgcaaccataatagctgtgaaaactagcagccttttagccaccagagagtgtagaccaggattggaattcttcaaaaaggccaattttattccaagaaccttgccactgtttgacctatcttgcagctccctggaataaacctatatacatggccttgcctttatttggcccgacttagagataactttctaggaaaagccctagctccagggtgttggtccaaaccaattagcagcaattctttaacataacaggttcctaaggctgtgatgctagttgagataaacataggtctggagaaaaacttccagtgaagctctggagaatgaggtgtccataggggattttggcaacctctgacatgttcttgcgggatctagaagcccatgtgcttgtcttaacaaatagagagtatcaataaagagatagaaattgtaaataagaactcagtggaatatctggagttggaaagcacaataactaaaattaaattttcacttgacgtcagattcaagctgcaaaagaaagaatcagcaaacttgaaaataggtaaatgggataatccaatccaaagaaaagaaagaaaaaatattaaggaaatacagaaagcaaaaactgactgaactgaaagaagaattaggtaattcaacaaaaatagttggagacttcaacatctcacttttaataacaggtaaaagaactaggcaaattaacaaggaaatagacacttgaaaaagactataaagactataaacttacaagacctaacagatatctatacagcgtttcatccaataatagcagaatactcattcttttcaactgtacacgaaatattctctagggtaggccatatgctaggtcataaaataagtctcactacattcaaagggattaaaatcatacaatgcagattttatgaccataatggagtacaattaaaaatcagtaacagatgtaaatttgggagttcataaatatgagaaaattatacaacacactcttaaatagccaatgggacaaagaagaaataagaaaatacaaaaatatcttgagataaatggaaataaaaatacaatataccaaaacttatgggaggaggctgaagcagtgcttagagtaaaatgtataactataaatacctatatttaaaaaggaaaaagatctgaaatcagtagcctaagcttctaccttaagaaactagaaaaagaagagaaaagtaaatctacagtaagcagcaggaagtaataacaattagtgtgaaaaaaatcagatagaggaagaaaatataatagaaaaaatcaacaaaaccaaaatctagaaatttagttatttgaaaaggtcaacaaaattgacaaagttttagctgattggttaggaaagaaatggtcaaattactaatattagagaaaaagagggtgcattactaccaacattacagaaataaaaagaagtaaaagaggatattatgaacaactaaacaaatagataacctggatagacctataacaagaaattgaattggtattaaaaacttctcccaatgaaaggctcaggcccagaagtcttcccccgatgaattctaccaaacatataaacaactcttccaaaaaatagaagagaaaggaacacttcctaaccagacaaagatatcacaagaaaacaagctacagagcaatatgccttatgaatatagacttgaaacgcctcaaaaaattatcaaacctaatacaacaacatattaacatgattgctaccataaccaggtaagatttatcacaggaatgtaaggttggtttaacatccaaaatttaatcaatgtattataccatatcaatagaataaaggacaaaaatcgtatggtcatcacaataaatatagaaaattcatgtgacaaagtacaaaaccctttcaagcttgaaaaataaagaacacttaacaaatgaagaatagaaggtattggccaggtgtggtggctcacgcctgtaatcccagcactttgggaggccgaggcagttggatcacgaggtcaggagattgagaccatcctggctaacacggtaaaaccccgtctctgctaaaaatacaaaaaattagctgggcacggtggcgggcgcctgtagtcccagctactcaggaggctgaggcaggagaatggcgcgaaccctggaggcagagtttgcagtgagccgagacagcagcactgcagtccggcctgggcgaaagagcgagactccgtttaaaaaaaaaaaaaaaaagaaggttttgtggattgaatagtgtcccccgctcccaaaagacatactaaaagcctgagcccaggtatctgcaaatgtgaccttatgtagaaatagagtctttgcagatgcagtcaagttaagatggtatttttataagaagaggaaaagaggcatacacagagagaagaatgccacataaaggcactgaccacgggaaaaacaccatgtgatgttacagttagagattaaagtgctacagttgcaagacaagtaaaactaatgattaacggccatcattagaagcaaggaagaggcaaggaaaaattctcccctacaggtttcagcaggagtatgggcctgctggaatcttgattttggatctagcctccagaagtctgagacaatgagttttgtctacccagctacgcaaattgtgacacttaattacagaagcccgaggaaacgaatacagaagaggatttcctcaacctgataaaaggcagctacaaaaattccacagctaatgttattgtgaaacactgaatgctttcccctaagatcaggaaatagtgaaggatgcctggtctcaccacttctattcagtattgtactggaagttcaggccagggaaattaggcaagaaaaataaataaaagacatccagattagaaaggaataagtaaaattatctctacttgcagacaacatgaccttgtaattagaaaattttgaagaatctatgaaaaaatattagaaataataaaataattcagcaaatttgtaggatacaagatcaatatacaaaatgaattattttatacattaaaaatgaataatctaaaagtgaaattaagaaaatatttacaatggcatcaaaaaatgttaaaaacttaggaataaaagagatgcaaggcttgtatactgaagaatacaaagcagtgttgaaagaaattaaagataaaaaaatagaaaaatatcacatgttctcagatcaaaagacttaatattattaagatatcaatatccccccaattgatctacagactctatggaatcattatcaaaatcacaactggcttttttttttttttcagaaattgacaagtggatcctaccatttctattgaaatgcaagggatgtagaatagtcaaaacaaccttgaaaaaagaacaacattggaggagttaactttccaatttcaaaaactactacaaagctacaattattaagtcaatgtggtactagaatgtgaatagacatatagatcaatgaaatagaattgaaagttcaaaagtaaacctttgcatttatggtcaactgatttttgacaagggtaccaagagaattcaatggaaaaagaatagtctttcacaacctggtgctagaataactggatatacacatgaaaaataatgaaatttggccccacctcacaccatacacaaaaattagcttaaatgtatcataaaagaaaacaaataatctgattaaaatgggcaaaacacttaaacatttctcaaaagaagatgtacaaatagctaacgggtttgtgaaaaatgctcaacatcactaatcattggggaaatgcatattacaatcgcagtgagatgtcaccttacacctgttagaatggctgttataaaaagagaagaatgataacaagtgttgatcaaggatatggaaaaaaggtaacacttgtatatcattggtgggaatgtatattagtacaaccattatggagaacagtatggtagctcctcaaaaaactgaaaacagaattaccataggatccagcaatcccacttccgggtatatatccaaaagaatttaaaccagtatgtcaaagagatatcttcactcctgtgtttattgcagcattagtcacaaaagccatgatatggaatcaacctaagtttccatcagtggatgaatggataaagaaaatgtggtacatatacacaatggagtattattcagccttaaataaagaatatccttttgtttatgacagcgtggatgaacctggaggacattatactaaatgaaataagccaggcacagaaagtcaaatactgcgtgatctcacttatgtgtggaatctaaaaaagtcaaactcattgaagtagagagtagaatggtggttaccagaggctgtggatttaggggtggaaaatggggagatgttgatcaaaaggggttaaaaactttagtcaggaggaataagtttttgagactttatgacacaacctggtgaccatagttaataatattatattgtatatttcaaaattgctaaaataacagattttaaatgttcttgctataaaatatgataaatatatgcagtgatagatacgttaaattgctcgatataatcattccacagtgtatacatatatcagaacatacatgtaccccataaatgtatataattatttgtcaaagcaaaataaaattaaaaataaaatgttttaaaacttttgtaaaataaactttataataataatatatttttaatgaatcatagagctaaatatattaataagaactaaaactttaaaactcttctaagaaaatgtaggaatacaatggattatgcagtgttttcttagatatgacaccaaaagcaaaagtaaccgaaaaatacacaatttggactttaacaaaattaaaacttttgtactgcaagcaatattgtaaagaaagggaaaagacaatcctcagaatgggtaaaaatatttgtaaatcatatatttgataagatacttgtatcaagaatatataaaaactcataattcaacaacaaaaaggataaatgacttaattacaagtgaagaaacagtttgaataggcatttctccaaagtagatgtatagatctccataagcacatgaaaagatggttaacatcattgattgtttaaaaaatgcaaatgaaaaccacaaggagatagtactttttacccactaggatggctaatacaaaaaatacagacaataacaagtgttgagaagatgaagaatgcttggaattttcacattactggtggaaatgtaaaatggtgaaacaactttgaaaacagtttggaagttcctggaaatatttttttaatttttaatttttgtgggtacacagtaggtatatatatttatgggatacaggaaatattttgatataggcatacaatgtgtaacagtcacattggggtacctggcctatccctcacctcaagcaattatcttttctgttacaaacgacaatctaataataatcagttatttttaaattcacaataaattttttgactgtagtcatcctcttgtgctatcaaatactagatcttattcattctatcaaactatatttttgtattataaatttcactacccattagccatccccccctttccccctaccactacccttcccagtctcctggaaatattaaacatgaagctaccatatgacaaaaccattctactcccaggtgtatgctgaacagaaataaaaatacatatgtacacagaaaacctttatacagatgttcatagcagcattatttataatagccaaaaagtagaaccaacccaaatgtccatcagctaatgaataaattttaaaatgtcctctacatccaaaaatggaatattatttagcaataaaaagaaatgaaatactgatatgcactgtaacatgagtgaacctcaaaaatatgctaagtgatggaatccagtcacaaaagaccccaaattgtatcaatacattcatataaaacatccagtaaagactgaaggaggaggagaatagacaatagaaagggactgttaattggtatgggtttcattgggggcaaataaaatgttctcaaattagatcataataatggttgcacaaccctgaatacattaagaaccagaaaattatgcactttaagtgggagaattttatggtatgttaaaaagtatatctgcatgtcattgactacagatcttttcttattttttcaagttttatgaacacagttttagaaacatagtctccatttttctctttcatgaagctgcttgccagctatagaaatgaaaaaatagccatgtctgtggaacataactgctacctagatgggagcctccatcacacaatggatagggagctattttcttttatggtcaagataggcaggttctgtcctatagaatatattctgagatgttacctgtagttcagaaaaacagggatattgttgttctaaacatttcctcaacatttatgtggcttcctatttattaataagagaacctgttctttatgtgtcattatactagtttattctagccctggtcctggtccaggactgtctggaggtattagaattgccctactctatgtgaaataaggtcatatctgaataggtatgtcagtcagcataggctaagctacagtaataagcaacctcaaatctagaggcttaatagtctatattttactcatgttacatgttcgttgtagactgatgagagcattctacttagcttagtcactcggggaccatggctgatggtatctccatcttggtacattctttcatgatcatagaggcaaggaacatggttcttgagccttctgcctggaagtgaccagtagacaaaaccagtcacatggccattcctgagttcaatgggaatgccgatgtataatcttctggcgtgaaaaggcactggatatttgagaacaataatgcagtctaccacaatatgctcatggggtctgaaaaggagctgaaaaaacgccattttctggggttctgtcctctggcattgtttctggaatcgtttccacccatccatttctacaccctctcaactgacttttctcagatgcctggggtagctgggtgatttgttaattacagtattgcttaagccttttaataaagtcagcaaattaaagagagagcccagataaagagaatgctttcaaaaatgtcataatgaaattaaggtaacgaagcacttggagacctctcctcccttctttttgtatgaaacttattccaaagcagctggaagagaaatggggcctgaaagtaaagaggggaaaaatatattgtatgccattagtttaattataaaaattcattacatgaagccatgtaagacagaaaataatggaactctaatgggttggccgataacacatttactagtctgctctcagcttgtagtcattgttgaaaggacagaaaagtaacgacgttggtatgtagtcttcaaagctattgtaaagattaatcattttcagtaagccggaaaatgagggccattttcttaaatagtatgccctgtatagagtgttaccttctgaaacagagttgtttggtaatgtcagaggtttaatagatgagtcttgaagttaatggtgagaggctttacttttgaaatggctttcttacagctattttaacatttctattataaatccataaagaggttttataggtcgttttaattcacacaaggagggaagaaattgtgcttctcttttcccaataaggatttatagaacattaattcattcttgggaccaaattgtttagtgattttcaaaaataaactatgtatttttctgctgtctttttttcagaaatgccttactttattatacataataattttccagtcatgctataatcatcaagattgttttatattcttcaaagctcagttaaaataaacccagtccttttccttaaatttctttatatggatgcataacttctttaactgaattgaaatgaaacctgaattgagagtccagaaacctgcatttttatgatgactctttcactgactagctatgtcaccttgaacaagtcacttaacctttcagagcatttatattctcatgtggacaattatggaattgctcaaaaaggaagaagatatcaaaagatgaaagtgaatatgtaggtaggggtcatatattcgagggccttgtaatccaaagagagaggttaggactttgtcttgcaggtaatagcaaaccattgaaaggttttacacagaggagaaatgaggttctatttgcattacaaaaagatcatttacgcagttgtatgtaggtggaagggtggtttgagagtggagggagggagccaataaaaaagattattttagtacctgagcaagagatgatagggacgtaaattaaggtagtgtcaatggaagtagaagatttggataaaagttaaaaaaaaaaaaaaaaaaacttatgatacaactacccagggagtatgttccctgcctcctgctccagttgaggaccaacatatcagattgatccagagacagaattttggagaacattaatatttaaaggacaggcaaaaaaaaaaaaaaaaaagcttgaacactcagagaatacagaggcgaccaaaagagtggaagccaagaaagcagagaacttcgagaagagaatagtcagcagcaccagttgctgcaaataaatcaagtaaataagaacttaaatctttccataggcattggcttttggtaactgaatcagttaactattttcacaaatgtgagtggcatatagcaataagcccatattgcctttcatgaattttcagcttgggtggggtggcacttcttcatgttgcaggttgattggggtcgctctgctccatatgtcactcattctcctcctgagatgagtaggctagtccagagcatgtttgtcttaaggtaatggtgaagtgcaaaagggatagccacactgcataaatacatttcaagcctctgcttgtgttacttctagtaatatcccactgggattaggcaaagcaaggcgcatgaccaagctcaatgtcaagggcatgctgtctttcgtaggaagaatttcagagttacttagcaaagggcatggatacagggagaggtaaagaattggggccagtaattcaatttgccatagtgacttctgtcagaatagttttagtggaacgatgatggcagaagcctgattttcatgaattggagagtggcacgaatgtagtcaagttgagataatgagtgaatatctgccttctaaagagtgtgactgtgaaaggaaagaaaatgatagagtgcagattattgttgttgttgttgtttaaagatgagagagacactcatgtttgaagtctctagagaaggtccccgcagagaggcaagaagttggaacacacaaagagagagggagtatgtggaggaggatcccagaatagatgggtgcccagatggtgaaatcaacttccaatagcagaaaagtcgcctcttcctctgagactagagagaaggatgcaagatgtaaagtctgatatttcatgaaatgtatgtttgatatattaaatttccccctgtggaattgtaggtaggatcatttactgtgagatttctttcagttcgtgttgtcaggaattagtctgtaaaccacattcgatatttcaaacagaggaaattcaatacagaggactggctcctccataggaatgaaggagctgacaaacccaacagaggacagtgaggcaacccagagtttagcaacttcaggaaactattaccacctcaagggctggggaaccgacaagttttaccaaagcccagaaaccagaaccatcgggtgctaattcacccaatgtaaggtctgcacagcaggtaatggaattacagagggagcagccgtccagtgggaaacggagacaaaggagatactgccaagacagagagagaagggggataattatcttgtttcaccctttctcatgctcttctgtctcccactagtgtgtctcatgacttaacctagttagaagccagctagcaagaaatcccaggaaattctgacctcctatgggagttagtacatctcaatactgagtggagtaggaaatgggtagagaatggatctaagagcaaacgacctcttggtggttagctaacagagttaaatttttccatgaatcccttggttcatgaatgtaaatacaggatccaaggaaaaataacaaatccaacatgtagaactttttgttcataagcatattaggatcctgttttacaattttccgagcaattgcttgattttgacacttcaggacaagccggaggcatggtcagagcaagtaaccccatcctagtttacagatgacaaaactgggacttacaaggttaatgacttccttaagatcaaactgcagaacaatggacaagcaaaacttcctgggaagatgtcctttcgttactctgcactgcctttcttgaagttcctttgagacacagtcattaaaaatttaagtaatagttcacccggaacaaacatttattttacttgtaggtgaatatcacaaaacacattttaaaaggaaatttaaccaatattcaaccttaaaattttaatgatagagctatgcacttgcttttatcttccaagttaaagggagaattttagagttgcagcatttctagacaatgtccataaaacagcgagctacttgctttgcattcagaaggggctcacactgtggggaatatagtttgactcattaaaattagtagtagatgtgctagcagtagtaatgatgatgatgatgctgatgctgatgatgattaatatttatttaatccttcgggcacgccaggcacctttgtaaatgttctccctgaattctctaagttaacccacctaatcatatttccacataaatactgttaatattcccatttagcaaaggaggaaactgaggcacagaaaagataattaactctcccatttgccactaagcgatcacgccaggattcaaacccagcaggctcattgtattgctcaggcttttagctactctttctcttcctcctctcttttctaccatgtagggtcaatatcactaaaataagttcttacacataaaagaaatgagagaagacaaacaattaaagtagaaaaaaatactcaaaattcttgaaattaattcaggttgtctcatagtccacaatcactttttctacctaagatactgtgaatatatatcaagcacatagtgcagtagcagcataatgggtttgaatgtgaaacatttctttcctggttggggaaacaatcttttggggatttagcattttatattcttcatagaaaacacacacacatacacacacacacacatacacacacacacatatacaaaggcaatctttttttataagctagtgctcacagtattttaaatttcttcacacaccatgatcaccacacaagcaattccctgtggtgtacaccattgtcaatggaattcagaaagagaaaagggtgtgtgtgaagtctgttgtatttttgaatttacactccttctgaggtctggagttatcccagtagtaaatttcacagcagtaggcaaagctggtcaaggtcatggttcctagtgtgaatgacacttgggtaaaacccaaggtgggcgggcagaatattaccgtaggagaaagggaaaacattctgtgtggggaatgtctttaagaagggagaaaaaaaaaaaaggctacctttgagaacctttgtgtttatataagggcctgagccccctcaatgtcagtcaaggtcagtgggagttttactttttaatcctacatcctcacaaaacctgggcagtattcagtgagggttagcactcagtcaagatttccttaggtataacagtcctaactttcgctgtgaatacaattttgcagaaaaatatatggcacgcgtatttctacctttcaagcattaaagtacatcaaaaagttctggtttgacgtcaagcctcactctttactaccttgtttagtaggaaatctgtcatttaactctagcttactatttctttcagagattttggaaaattctaggatatgttataatttataattttaggcatttttatgatctattgattatgtttttagattcattggcaccttctgcattttatgttttttaattttaacagctttattgaagtgtaattgatatacaaaaactgcataaaattatatgggctagaacatgtgcatatacccatgaaaccatccaaatggtataacctcttatatctagacttttcaaacaggaacctatgagtgatgggtggcttccaaggttatttaacttgcttgagtaaaataaatgattttaattatatatttactaaaaattttgtttttattttgtattcctgagcttttacatatatgctctgatactggtccatcataagtattttattaacaattcagtgttttataaaaggaattcatttgaaaaaaaggtaaccaagttattggtctcagttttgtggatgttcatgctattaattagcaatttaatagatgagagataataagctcttcttttaaaatgcaaatagcaccctctggatactaagggccaattacatgttctttcgtatcttggaatacatttcttttatcactttaggtttggcttaagtgaggaggagaaagaaagaagtggtaattttgtaccctaggatatttctagaaaaggcaagcctttggcagaagttccctcagaagggctttcaaatagtgcgaggatctgaaaagtggagaatagaaactgtaatgcttgataaaaggagtatggaagaaaaggcaggcattccacgcggataaatgttaattgttttgtaatagcagcaactatgctctgtgcctttagacactgtcctctgctttcatagcaaaagtcagtgatattggcattagcttcttgataatagtttggtaatctgggtctatttgctatatgcagtaaatactattacttggtttgattctaggatgttttagttaactgagaaattacattatatatagattgtatatgttcaataggagttcaccaaacacgctgaaattatgctaagaacactgtttgatttttattctgtaaatatcatactaacgcaaaagaacaaatattaaaacaaaaatgatttttctcctcagaagcattattttcaatttcttccatttcgtgttcagctcatgattatgtattcttagagataaacacagtgtagttaaaaattgtgttctgttttttacacaagaaaattgtgctctttttacagtgattactgtgcacatttgctacatattggaccattggaatgatgtattatgttcttttaatgtccctgcattaaacatcgacattgtttctctttttttttttttttttttttttttttttccgagatggagtctcactctgtcgcccaggctggagtgcagtggcgtgatcttggctcactgcaacttccatctcctgggttcaagcaattctctgcctcagcctcccgagtagctgggattacaggagcctaccagcacacccggctaatttttatatttttagtagagacggtgtttcaccatcttggccagactggtcttgaactcctgacctcgtgatccacccgccttggcctccctaagtgctgggattacaggcatgagccaccgcacccggcctgtttctcatttttttactgctttggttaatgaagattttaagtcatatagtatattgatcttcttttgaagattttatcaggataaagtaccaaaagtgagattattgagtcaatgggaataagcatttgtatgtcacttggtatctattgccaaattgtcctaatagataacggtccccagcagtaatacgtgaatgtgctagttttactggtcttttcagctttggattttattttttgttaatttaattggtgtccaattgtaccttttcaatttaatactctattttttattacttgaaagttaacttttttctttttaaataaaatcatcccactctttctcttgtttgaactacctgttcctattcctgtgtccatttatcaatgacttaacccatcctattgaatttgatataactatcttaacaattagtattatcttaatgcttagaagcctcctctctgcacttgcagaaatgtttaatagaaatttcaggttgatatgcttcgagataaaacctaccattaattgacttctttctttgaaatatgtttcaagtgatgagatagcaagtttgaaaacactgaattgccaaagacaaacaacgaagaaaatgtaggtgatttggtttagtaagattcttatattttgactttttttctaattttaaagtaaggtattctaaaagtattttgatccttcaaaaaattcgtgactagaataacagtactattcttttgttgttcaatattttctgtatgcaggtttagttgaacgccagtagatggcactaattacataaacaattcaacaagttaatgaagagggaaagaaatgtatgaggtttttttcgttcaaatgttgttatatgtcacatattcaacaattatatatgagcttatttttgtagtttttttctcttgtgataaaaacaattaagcccactttattgccaattaattgctactaagttgaaatacttgatactggttattgctcaagatgctgcatttgaaaagtttgtcctgaaaggtgggttaccttatactgtcatgattgactaaatcatatggtaggttaaaagcaatctaatatatgtattctgacctgaggattcagaagctgtttacgaagtattttaagacactccaactagagatttcataaaaaaaactgacattcattctctttctcataaaaatctatagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaaggtatgaattacattatttctaaaactactgttggctgtaataatggggtggtgaaactggatggaccatgaggatttgtttttccaatccagctaaactggagcttgggagggttcaagacgataaataccaactaaactcacggacttggctcagacttctattttaaaaacgaggaacataagatctcatttgcccgctgtcacaaaagtagtgacataaccaagagattaaacaaaaagcaaaatactgatttatagctagaagagccatttatcagtctactttgataactctatccaaaggaatatctttctatctcatcatggcgcacactgccttacctgttatctgataaataagtcactttgggattcatgatagagttatagctgtacatggtctcatcctagtatctcactccacacacccaatgggaaaatttgtggagggcaatatgactcgtcacttcatttcccattatatatgaatggaaattaacagcgcttatagacagtatctcctcaaactaagccttgtatccttattatacctctcttgatctctagtgcttttttcactagcatttattccaatcataaataaaaatataaattatgtaactaattgttaaatatttgtcctttaaattaatctaaatgccatgagggcagagattttgtctttctcatttgatacatccccaggtcctgaaccacgtgatataatagggagctagtaaatgttttttgaatgatgactccctttgcagaatgtacaattaccttgtgcaagctgaaaaaatagcacctgtacaatatgaggaagaccacggtgaaaaataattgagttccaaaatatgacatcaattactgaaaaaataagctcggtgatttttaacaagaagtaaaagtcaccactggggccaaaacagattttgaactaagagtaggaagtcttaggagaaatgagataatgatatatggaaattaagcggccaactaaattttgaaactgagctagacattagagagtaaaaactcctgtgaagctgaatttaagctggtcaccctggggaatagagcaactctaatcctgaattccagacagtaggtgtatagatggaaaagaccatggaaaagaagattcaacctaaagttgggaagttttaattggagccctatgaaaaagaccctggtggagaaagggcaaacttgaatatggagctgatatttggaaaaattctcatagtaactactttttctcaatggcaaggcttggactttcttctcaaaatacagatcttatatgtgttcaattaaacagggacagattaggttcaggaagaattattcacatggaatcaattggtatcagagagtcaaccattagatcttagtgggaaatatctgcttctcaaagagaagtcttttggggaaagcaaattaaagtcagagattaatttgatgagtttaggtaatataaactaaggggccaagaaaaaagcttgctcatggtatgaaactagagcttgaggacactgatctagtctatctatactactctttctgacagacccctctcttcattctcatgctccttgatggcccaagccactctctcagttttttaaaaaattgttttatcaaggtctctggattcttcatgggaatgacttccagtttatattttttggcttggttccaaaaagctatcagctaaggaatgcatatacttacttcccctatgggtaaagtaaatgagaattttagaagccaactcacatttttagcctgtacagaatctgcaattcaccaagctacttctgactcatgtctataaagttcttccctgttcttttctcacttcacatgtactctttgcaagaattcatccacttgtgtagtttcagtctgttgatgactacccatctataattccagctgagaatgatcttttgagttttagacatgtagatcctgctgctttctttcgatgttaatgtcccacaggaacttcacattgaagaggtccaaagctaaactcatctttgccttcttccaatctctttctccaaatgcaacctacttctgttgtccttgtcttagtccttttcgtgcttccgtaacaaaataccacagactgggtaatttataatgaacagggatttgttggctcatagttctggaggctgcgaagtccaagatcaaggggctggaatctggtaagggccttcttgttgtgtcatgattccatgatggaaggtggaagaccaaaagagagaaaaaatggggccaaacttgtccttatatgaaactcactcccacaataatgatgctaatccgttcatgaaggcagagccttcatgtcctaatcacctcttcaaggtcacatttactactgttgcaatggcaattaaattttaccataagtttgggaagggaaaaacattaaaccatagcattctgcccccttttccccaaaattcttgttcttctcaaagacaaaatacattcatttcatccccaaagccccaaaaatcttatttcagcataaactcaaaagtgcaatctaatataaattagatatgggtgagactcaaggcacaattcatcgtgaggcaaattcccttccatctctgagcctgcaaaatcgaatcaagttcatcccctcaccccctacccttcccagcatcaggtaaccaccaatcacagaaagttttactgatagtcctgctctagatcatctttgtctatgttcactttagctatttatcctagtgttccattattggaatactaagcatgtgggaattatttatattctactgttcaaggtcctcaccaaggtctgattgcaaaaattcaaaaaattgcaaccttaggcataaatgggttaagcagtttagggtacatttataataattatttactgtgctacttcaaaaatcttattgcctctatttataaataaaaagtgttgtctctacacagtggcttgttgtaatgcatttacttgtttctgcctgattttttctatttatacattttcttttttatttttatttttattttttcacttttaagttcaggggtacatgtgcaggtttgttacataggtaaacttgtgtcatgggggtctgttgtacagattatttcatcacctaggtattaatcctggtacccgttagttgactttcctgatcctctcgctcctcccaccctccacactctaatagtccctagcatgtgttgttcccctctacgtgtccatgtgttctcatcatttagctcccacttataaatgagaacatggggtatttggttttttgttcctgtattagtttgataaggacaatggcctccagatccatctatgtccctgcaaaggacatgatctcattctttttttatggctacgtagtattccatggtatttgtgttggtctcaaaaactacaactatgacaggatggcattttcacttttgttgttatattaaactcatcttaaaaaggaaagattaataatgtcaatatttgggttatggagaaaaagtatctcatatctttgaaaaagttctgtaactatagctttttaggtaggagggattctgtggaaagttttctgattacatcatttctcacagttcaggttagacaccattttactatgaaacactaatgcattgcctgcactgagactttcagtcacatggagaaacctaggcaaaatttttgtacacttggaagaatatttaaattagtaataaaatctttagttttaaactgttgaatgttaaataagatataaaatgtacttgaaagaaatttgctttgatatcagacactgccatgttgcagtttcaagacataataaaaaagtaaactaatgtttatattttgctgtttaagtttattaatacatcagatgagtcttcaaattctacagtggcttttgatatgatcatttttacttgccattttatatagaataaatataaataggcatttatgcttaaaaggaactaatctatctatggaaaaaagagaaggctgcttctcaactaaattgtacagtttagaaacccagatctgaacatagattattgttgtgacctatgtaggaaaatatgttgttttccttatcgtagtccttacagagtccatgataacatataaagccagaaatgtgagcctctgcaagttcatttctttgtcttcaatctctgtgaatagatatgagtttgtgaataagataatattagatgtgatattacaaattattgtgagaagcctctaaggattagatttcaaggactgccatctggctgatgactttatgatgacactgtcatgagatttcatttccttatttctgttccaggatcactctttaaacaagaaataagcattaactctgaattgtctgcttgtagctgtatgagggcttccacaactgccaactagccaggtacaaactcatcaagcagaggagatggtccttgcatcagagggttaaacatgcctagaagttccttagctaagctcccagatactaaaaaatccctctaggttctaagaaagattcagcatgtacatgtgtgtacatgtatgtgtgtacatatatacatatacgtgtatatgcatatgcatgcatatacatacaaacacattttcttccataacatctcagtattctctgttctttataatactgttttgtattttaatgatcaaaattaatagttgatcatctgaaaacattttgacctgttttctccgtctttgacaaccttgaaggcacttgtaagtcactctttgcttctctattcctaggtcctttctcatcttcattgcaacaagaaaagagaaaacaattgagccctattttgtgtgtagcaaggagctactctagttaaacactagatctcttttacattctccaacatgttgttttagtaattattctactttcctttttttgggatattcaatttcttctttctttttgctcctcccctttagcaggccaacatactcaagtctccctcatcctaagagaacttttttagtatatcattttttttctatccagctgtacttgcttctgcttactatatcatttttaagcagtagttggcattactgtttcctgttctttagctactagttgtactttgacccactccagtctcacttccccagcaccaccactttatgaaaacaaggacttactaagatcatcagtgactttgtaatagctaattagtgtattttaattcgtccatcttcttgactatattttaacattgatcctgttggtcaactctgctaatcaaaactttatcctccttggttcccagaacaatattatcttgaatatctcatttctctaatcatataataattgtgaggtgcttggcacaatgcctagtgcgtagtaagaactcagtaaaatatcatctgccatcgacaccataaaaattaatttacttactcaacaaatacttttgtatgaagtttgtgctaggtaggcccagtaattggtacttggtatagagcaatgaaaagccctaccctcataaagcttatattcttggaagcagaagttggaagacagacattgacaaataaaaattaaatacatgatgtgtcagatggtcatacacacagtgtggaagaacaaagaggaaaacaagtggagagagagagggaggtggaagaggagtgctgccatgaaaatgtggtaatcaaaaaaggtcttactgaaaaggtggcatttaagcaaattctaaaagacctgaggatgtgggccatatgtataattgggggggaaaaagtagtccaggagagtcctaataagttaaaatgccccaaagcaggaatattcttggcatgttgaaggaaccttaaaagggagatcagttaggcagaaaaggatcaagcgagcaggaaggtagttgacaataaatttagaggggtaactggcatctgattatattggccttttaggcctgtggactttagcttttaatctgaatgagatgggagttattggagggttttgaatggaggagtgacatgttttgtcttatctggctcctctgttacaatagactaaacagaagtagtgagaccattaggaaactgttgtcataattcagtcaagagatgactgtggctgggatcagaatgggagaggtgaatgtggtgaggagtggttggattctactatattttgggtacagagcacaacagattttataatggaataaatttaggtgtgagagaaagagtcaagaagactcaagaatttttagcctgagcaacggaaagatggggtcatcatttactgagatggggaaggctccaggagtaacatattttgggaggaagatgtggatatgttacatttgaaatgcctattatacatctaggagatgtgtggagtagatagctggatatatgaatcttaagttatggggagtagctcaagatacaaagttgggagttgtaacaatgatcagtgcaagttctctgtcttcaatgcaattttaaatgttgatgttccattcttaattgtctctcttctttctctctgcacattttgagtagctttgtctgttggcttcagttaacattaagactcctcagtgtcaacttccatcttacactcttctcctgatctccagaactgtactttctgccacctaacctacattaccacctggatatgctacaggctgcaaaatgtgtcaagtagaatgcattatcttgcccctaaaagaaagttaaattttctgtgttttcagtgtagtgtaattgtctaacttaattgtctctaaaactggaaacctaagaattaccttctacctttctcttgatctctctttcccaatctactgacacatgtattaaactggcttccaaattctgtgaattctacttcaaaaattgctctagaaacaattccctctctttatccctattgtcacctcatcctaaagcctcttcatcctttgtagatttctgggagattgtaaccaacttttctctattctgccagttatcaagtctttacgctcatttgacattcacaacagccttggatctgtcttccttgaaatgaatcttcttgcttccctttgattccagtgctttttttttaccctcctgagacttgatgcatgatatttacatgtatgacatgtttccaaaagcattctcaaatttttctgaaagtaaaaacaaatgaaaaagtaaaacattttcctgggaagaaaagcaaatagtgttatacatttttgcttgttcatttgtttgtttatttaggagagggacaagcattagaacttcataagagtcttatatgctgtatctacaaataccgtcccttggcaatataattttagagttccttttctggaactacttaaggactgttttatgatcctcagcagactgttatattattttatagccataccttttatttgctgagtaattgtactcaataattgtttgtaattgaatgaaacaattcatcagatgttgggcactgaatggctttggattatttccaaaaatttaaaggataaagatttgctgccttcaaagctatgtacaaaaatatgatagaatgctagcgggatatttgtttaaaatacaacctttattacattggggcctgctcataatatatatgtggcacattttatttaaaatattaaagttcctggtgggacatgtccccataatcccagcactttgggaggccgaggtgggggtgggaggatcactagaggccaagagtttgagaccagcctgggcaacatagtgagataccatttctacaaaacataaaaaaaaaaaaaaaaaagccaagtttgtagtcccagctacttgggaagctgaggcaagaggatttcttgaacctaggagttcagttcaaggctgcagtgagctatgatcatgccagtgtactccagcctgggtgacgtagtgagactccatctcttaaaattaaattaaatttaaagctacaaatgaccccaaagccaccagttcaaccctctcaattttgaataccctattttaaattcctcttatgcgaaatgtaccttgtagtccattttaaggactgagaggatttggtatgttaaaaaattcaatccattatcaactcctttaggtacacttagcagtatgaaaatgtgtctttcggctcttcaggagagagtcatatgtatagttacaagacaatcccatttttatattgctgagacccaaatcttcccaactgattatgaagcataagaactcttcggaggtttaagtgagctgagattgtgccactgcactacagcctgggcgacagagcaagactttgtctcaaaaaaaaaaaaaaattctctgcattctacagtagggtaatataacatctatgatgtgaaatcttggggctccgggccagagagtgtcatgatccatatggatctaaaaggttcatagtggtaacagcctgcttcattttatgtcatctcctttcaagtaattagaatgtttctagcttgcagggattgcacacaaagggagacatttggaaccatgtcattggtgatttactggtgtggaaaattacctggtgatgtagccaagtagccattttcattctaacccagtcctacagtcctgaactgggctgaaccaacgcaccaaaatatatgcttagaaatgctcctatgtatcagttttcccaggaaaaacaatagtattatcgaaaacttaccattgtttcctaataaaaaattataggataccaacagactgttttttgttcataaatttaatattacagtatcaaatattaaagcaaatgggagaaagtttttcttatttggtttaattgaaccattaatgttagctacaatacccatcatgttacttttcaattatatttatattttcattttatttctatctgtatcattctcagaaagacttctttaaaacattcaataaaaatagaatttaggtagatttatttttagaaagttgagtttttttaataaatgaatataatcatcacttgacttaatttttttctgcacaattctagaaatcttatagttttgggatcctttggctttattcagtatgtaacagggatctgtttcctttctctaaatcattaattcaaatgatttcttatattaaaaatgtttggacatataggtattaatgagttttatgaaatctaatctttccaatttccccctaaaaagggatgtcatttaatcagttctaggttgtgatcaatagcagatttttttttttttttttttttttttttttttttttttttttttttttgcagctccctttcaccccgtagggaaacctgatatcatccttgactaattgcagcaaagagcctggctcaggtcctttgtcttataccgagtgtttatagattcttgagcccagcagaatctgaactcctggctactgctacctacttcccagcccaggccccaaaagccctatgtctgcagccccgtgcaccactgtgtgtttttgtggcatttctgaaacacagagctacttaacttgtttctaagcccagattgtgcctttttgattttctattttggtattttatctaccatttttctgtgtttggatgtttcttctatattttgaaataacttctttcctttagtacaagtgattcttattgtagaaactatcaaaaatttacaaataaagaatcattctcaacattcttagcaattccttctatcatatttttgcaaatatatttttgcctatttttattttacttactccctgtttattaacagttaaaagcattttcagatagttttattttttcatttaaaaaaatcttaccacatttttattaggaaggaaatggacaggtgtttatcttttcaataaaaaacatgggggaaataatttcttgaagtacatagtgacattcttccagccaatgttttatgctgtggtcattccgtctgtcatcagtattcatagaaagagatgaaaattatttaaattaactaggaaatcaattccccattcaaagcagtagttgtgtgtttcaaatatcttctaatagtcagtttcacacttagctttatcaaattcctaattatgatactcattacatcactctgtgtccagtcagtgtgtttatgccacagagcaattaaagcaaatcaggtgaaccaaattcaatcacctttgtagataataacctacgttgcttaaacttatggccgctcatacaattactgatggattgcctttttcttttatattgccagtattttaaatgtcctagtgaagttggggtagctgttgaacttcaactttatcacaacctcttttttaaaatgtgtaaacgaaaaaaccctccatgaaatgaccaaatacagttttcatgctgggacaaattagatgaataataatcataaattcataatgattatttatgattttatgtttttatagtgagatatgttttgttgaaatgtgttatataagtgatacttaagtttcctattaaaatagaaatgctaaaatggcattgttctctttagctgtgagtctagcttttgacctctgcttaaacggaactgttgttccatcccaaatctgcaactctgaggcctatgctcccttcactgctgtctaatggatacctatcaatttggaaggaggtttcaggcagctattcccggtaatctaatctcagctctgtccttttcaatattttcatcagtggcttggatgaagacatagataacattcttatcaaatcaatgccacaaagcagggagaaatagcaaatatagcagacaagagtatcaggagccaaaaagttttcaacaaattggactggtaggctgaatactgaaagatgtaatgtaaatgcaaggtgctacatgtgggttcaaaagaaacatgaaacaaaaaacccatctaacttagactgggctccctggaaatagactaagatagagagttgtgtgcataaggtttgttgaggagtgttcccatgagatacatgtgtaaggttgtaagataggcaagattgcacagacgaagaagtgcagtgaagcctgcagtgcgttgcggcctcatcagattttcaggggagttctggaaattgcatggccctttagagacacgctgaattgaagcaagggatctggacctttgaacccaatactagagagttaatggtcctgggtcaccccatgggaaagagcagactggagtaagattgttacctacagctgaaggcaatttccagggagggaggcagctgtgagctgttagtagtcaatattccaaccagctagggcatgaggtcttggcagagcaacagtgtacccaagaccgcagtgttacccaaagtatggtcctctgactggcagcattggtatcacctatgagctcactagaaatttaaatttgtaggtcctaccccatccaactaaatcagaatctctggggatgggacttggggaacttttaacaagctttcaggcctccaagttatttctatgcatattaaaatttgagaaccactgcctacaccaaccaaaaacattccaaatatggagataacatagagtttttagcaacaataatctccttctgtttcacttctctctttacacacacacacacacacacacacacacaacacacaacacacaatgtgatagaacagtgggaaaggaaagccaaaggggatcttaggccgaataaatttaagcatataacctagtcctaagaacgtatatttcagcttaatagagagaggaatattgttataaagctgtccaaagatggaacaggctgccttgtaaagttgtagaagtattcaggaacaggttggtgataccttggtggttgtatggtataacatcctgatcttcacatactcatcatctagagtgggagttttctttttccaaatggggttttggcagaactagttccactgtatcttaataagtaataactcaagaaagggttctatggatgaaaaaatgattaggtaatatcaagttaaatcaaagcgaacagacttctttcccataggagtaatcagacccttattacagtgcatgcttggtgaatcaacaaagtatgtgtatttatgaaagtatggggggaagggataatctatacagtatgcatcccttctaaaagtttgaccatgaaaacaatttctcaagaatcttatacaacactacagtatctggtccaatactatgcatagaacatgcactcagtaagtgtttgtaagatagatagcatagcatataggccaggccactgaagggaaatcatctcaccgtgagttacctgaatagtattctctagtgccattagctcaattcttcacgtaggcataagcctatacatttgccatgctaaccaagggaatttgtgttacgtgaattttgactctattcagacatttttttctatgactcctccaaggctgttattcttacctcatattctggtagaagtttaaggacttttttctgggaatattgattaattagctagctagctagagacagagagaggatagagattgattctctggcagagcctatttgaatcatattgaatctttttttttcctgagacttcccacaaggaggatggaggagaaattttttagaaatccaccgaagtaatcagggatatcttcagtaaaagaagctatacttaataaagtctctattttagcagatggcaatcaacaatagaggcaatagacaatagagtctattaaaattgctgggatctgctaataacgtttttcttttccctgaaacaaatgccattaaccctccttgacactctgtcttcatcaacattctaatagaatggaagtaactcataattttgaggatttttttcccacacaaaacctataaaccacaccacgctagtgattacttttagcctagttgctaggttgctgctggtaacagtaaaacttatcctgacaggtaggcaattccagaagcccagccaagcacttggtgtgtgtgagtaaacccccatacacttctcatgtagagtaaccctggccaacccataactcttagcaactattcctggtggacggacctggtctactctaagaagaggccaaggttctttaatagtgcagttgcaagaaccagaattgaaagtcaaagttctagcaagattttgcagactccttggcaaaccagtggcttgggactcattcttgacttcaagcccttaattgataatggtaggacagcttgcttgcgctgggttctgctccctgggatatgcactgtttgccaaatgagtagcaggtggacagacatctttacaatttgctgtcccatattctaaatgaacgtgacattctataggtctgagttaacctatgaagtcaccaatttcaatatcaaaatatttatgacagagaaaaggatactgaggcacagagagtctgtgactttcctaagctcaaaacaccagtttgtgttaattctgacacagaaattcttgtatttgctatcagtctcctttttctgtgtgtgtgtgtgtttttacattgcagcatcacctatatgatgttaggttctgtaactttttgagaattttctcacatacagtgatgtgttactttttgatatttcaaatagttctagtaagtcttttctacttttattagcgtattaacatactggctctaagagggcatctcaccacatctttgccattcttcctggaaaggcaagtttctctccatcttcttttttgtattccaaagttttgccaaagtttgcttttgaaaatgggttacctggcagagctttattattctaactttgaaagtacaagtcagaatcagacagtggcagttatatatgcactactgtgattactatataatgaaagtatctatggtgaaaatactgatactgacatatatttgccattttctaattaagtgcttcagtaaaaattaagcactcactctttgccagatactgcaatagatattgagcacattgaacaaaattctccatatacatatatatgagtccacattctatgaaagtataatgtttttctgagaaaaggcataatattctattaatatcagcttttgcttcttccaccatatattgaaagaattctgaatactgttataatttaatgggagaatctagagaattctgtatttgctttcactgcattgatgaactaagatttttaaaaaatgtattcttcatagaactacttttccatatttacctaatattattcttatatcatttgagcacatatttcactaacaaaacaaatgtgcaatgttattagttctaacatcaaaattacactgatactttaatttttatcctattatttttcatgcagattaaaataattatagctacatcacatgttgcaagttttaagagctactttaaaaatatatgcttcaggaaagacatgattagatggggaaatggatgatgttcatattttcaaatgaaaagttttaaaaaagtgcctatcacaaacactaaatttttacataaattatcaactactaatatatctacaagaaataccatttttccctacaaaaactcttaacaataattgttaaacttagtcctggaacctgctaatataatcggacaaatgttgtcaataagaaggtgaaaaagaaagcatatatagtttatcaaactataaaatatagtttatcaaaaccaatttttcctattgacatttattcaggaaggaaaatggatgagtgaaatgaacaatggtctctaagagaggtgggagatagcaataaattcagaccacgtttcctgtcattacagcagggaagtaaaagagctacagtcaactctcgaaagtacttgggggaactaatgattccctgtagacctgtgatgtttttgaaatttaattcaacaatttgatatacaccgcaaagcgaacagatagtcagatcaaaatcggaagaacgattgtctgaatggcatccatttttcctagatgtgctgtcccatcctgtgtcaattaaactttcaggtgatcttcaaacatatttccaagtaaaaggtattgcagttatcctataaactggcctcttccccagcactgcttttgctgtggtcaactttatttctttgggctcacaaaactgatagagcaaaataaggaaaacggaacattggattaaaataaattaattcccattctgtgactcactaaaaaaaaaatgataactatgcttctgtgagcattaataaggaaatgaataaggaaatgaccaaattgttcagtggacaacttgtatgggatttttaagtattgtgtcatcatcaatgttgtcaattagcatatactttgaaatcaactaaagcaaatcagttgactaatcattaagggtctttttaaatgacaacatctaaacagcaaatgttttattttggaaaatcatgacagcacaagaatgagccagatgttttacaacatgatatccataatttaaagtatgtagtagtcactcaaaggatttctatttcagtttccttatgatttggctaagctagaatttggaaaaacactttaaggtaatgtgagaaacagcaaaattcaacatgtggattttttcactaaagcttatttctgattattttttacaaactttactaggtatatgttaacttcatgacacttatagcagtggaccgtagttttaataaaatgtgaatgtatactcttttctcaataatattaaagaatgttgactttcgtgaggatatttttatttttctcaacattaagaactgtcaaagatttaattctacaacagaagacgtgaattttgttttctaaaggagaacagaatctatagaagaagtgttgctcatagtactcagattgttgaccaatcttaaaggagaaaccgtcaattaatttaccgagaagtaataacattatctttttcttcaattatgcacatccacaaagatttggggcaaaatccacttaaatgatattatacataatagatgagtattcatatgttgtaagagtcctggcttctttcctgcaaaatgattaaaacttggatcagaaaccaattaaaaatccattctaattcccaaatgtatgtaactgtactataagaaaaataaatatttcttcttgagggatatccattagttaaggatattcataacatggtgtcttgtaggaaatgttaatctttgggtgaatagggatgtttgggaataacaagactcaaagagatgttgcacttactcacttttctctgagttgttatttctgtcatttccccagtgcgcctgtcctcaactttgcctctctccttattcctttttttttttttttttttttgagacggagtctcgctctcttgcccaggctgtagtgcagtggtgcgatcttggctcactgcaacctctccctcctgggttcaagcaattctctgtctcagcctcccgagtggctgggattacaggcacccaccaccacgccctgctaattttttttgtatttttagtagagacagggtttcaccatcttggccaggctggtcttgaactcctgacctcgtgatccacccaccttggcctcccaaagtgctgggattacaggcgtgagccaccatggccgatccctccttatttctttttatctctacctctgcctcaatggtatttctctattactgttagcatttgctttctgtgagctcttgcacactgtcagcttatatacatgttcctgttcacatgttttcctgtccccagtggttacaacatgtcttctatctcagcccactctagaattgtcttacttttccaggtctcctgctcctcagtatttttcccacttttctagattcatgttttcccatctgcatatttctcttccatgtctgcactgtcatccgcttagaagacagcgcataaggacactgttatctgagcaaatcttcagcacagccaccatgaagcatggttaccttgtcactttccatttttcccatagtgtgtgcaaactgccctgatctgcatagaaaggtatcataattgaggaaacaaaatgcacaaaaatgtccttggttattccacccctcagaaatataggagagaagtaatttacagaattacacagaataacgctatgtcacatggacatggagttatcgggttagcatataattggaaaatatttcctaggaccttgacatttactcactttttgttttcaaattacatgtccctatctattagttgcaaattattttaatgcaccgtttaccaaagaaaggctgtttcttctgaaagctttcatttgacaagtaacttgtaaaaatattcacattgtgtatctgttttccccttctagtccaaactctagttatcttaaactttgcgcagttataaaaaatcataacaaaaaaagcttcctcgttgtcattcttgtcaaaacaggtttaccagacttaggtaaacttaaaatagttagtgtaaaagttaaaaagctgatttgctccttccagcgtgtttgttgcctttttgccacagcaaaattgtaaatgtaaacgtattccctaggagatgagctgggctgcaattttcagctaattgggagaagcagccctgagttgagcactgtcaggctgatttgagtcttaagatatgatgatgattattgtgtcaaatgtaatcaagaacgtgggctctgaactgactcaagggctggctgtttttaattcaggttcgtatatgaagtagacctccggttcaccgatagtcacagctggttgtagaagagagcaatttttaaaatgctatttcattctctatggagctctagggatcagagattggatgcacagggaggggacacatcctcattctctcctgaaaaattctattaattttcagtataataaactttctcttgagattccccagtggctctgtatcggtggttttcaaacttctcagacccaatgccacccctcttttcttttttaaataacaaatactttgtaataccttctttacgattataagccaaaatatgtagacaacataccctacttatacaggcaatagtttaaatgatgccgtaactctattttaaagagaaataagagtcatttataataaaataatatgtgttgtagtatgcagttattcaggcaggatcacactggaacacaagtgaagtttttagatcacgagactatcaatgcagtataaacaaatgcagaatgacaccattgtgttgtatggagactcaaataccatgaggggcattggtcatccatagcgtaattttccaaaatgctgaacaactcttggcaaaattcctaacaccatgaaataaattttttcttggatcgttatggcagttagttgcatggctgaaaaattcaatgtcttaaaatcatgaggaaaatatcttatgtttacgtgtaaaattgagttacgttccaggtttaggtgtttataaacagggtttccacatacatgcatgtccagtgggatattccaaagtgctgtcagacttgggagagttctttgttgtataagaagtctaccatcttcattccctctccacagaatgctattatagtaacactcttcaatcactgtgatagtcaaatgtcctccctcaatttctaggatgcctcttttttttgtggtctgtataatttggttaaatatctttccagacaaatactgatttgtgaattaatgaaatagcagtattttcggagcacctaacctatttctgagtgatacagttgccatttttacaagactaaatgaaattaccatttcagacctgccagattgtctagcccagtcttttacaattctgtgattatcactgcaattataatctattttcaccacttgaatggcatgatctctataaaagggtggtgataacactcatctattctccttcccctcacatagctatatcaatcgccccctaaccagttgttgataaatgcagttgaattttatgtaaaaattataagagatattattgtagctgtccaagacatttaaaatgctaaatgcaacttacgtggaggctataagagaaatatgaacccatttattgaagagattagctaatttagtaaaacaacacagatatacctgcatacagggataaatccctattgtctaaattattgagataaaataatgttttacaatgaaaaacttttagacaagtaggtaagtaaaatgcagcagtctatttgcatttcatctgggcatttgacaaagtctttcgttatactcttgtgaataagttggagaaatactggctagatgcaagataaattggatggcttagaagccacttcatgattttacgcaaaggatgtcgattaatagaccagtgtcaggtggtgatggaagatctctggtgctatgtcacaagcttctgttctcaaccctgacacactggatgtttttgacagaacatgagtagaactacagagaggaggcccatcaaacttatgggtgataaaaagcagggagggcaggagtattttgggtgacagaagccaaatgggtgtctggacaggatgcgttttaaggcacttttggtacttgatgtctgaagaccaggatcaaacttataggcaatctgaacatttgccaaaataacaggttaattttgacagaagttattatttgtatgctgtctatttctttaatacacctagaaagtattgaaataacattttttgcagacactcattttgaaaattcagaaaaaaaattgttaactttcgtggaagagtaacagaaactcagtcattgacagctaaatacaatgtgttgcccagtaaaatagtccaccccttcactttcatggctaatataaaatttgatgaaagatacaaattccaaagattgaatatctgtacatttgcaaagcaaaacacaattttgggcacagaattgctcattctcatttttaaacatcttggttataactgaacaatagttttttataacaaagataatattttcaaattattatgaggttcaactgaaataatttatgtgaaagcaatgtctaaactctaaaattctatataaatataaattattattcaataaattcacatcaagaaaattttaagttttttaagaacaagagcctatggccttgtttttagaagctgtataccttatcggtagtaggtttattgactttaattaaatttattgagtatctattaaattgccaggaactgtggtgtgaatctttgccctcaaataatttacagtaagttgtggttgatgaatggtgatgacgatgatgaatatccagactatagtaagtggtatattcataagtcagaggattcttaaaaccagatgcaccctcagattcattcctttcatgttgtacttctaattgaaaaaaataaatcctaaattatgactgttctttataaattttaattgatcttataaaaggccatcaatacatttcaaagtatctaggtcttttaaatgcaatttttcaccctggtaattaaaagtacgaaagcaagaaactttaaatctttattttgataagttttaattagctcaagctacttgtaatcccacatcttgtcttgtaaatcatatctgagccattaaaataggtttacaattagaagggcaattcttttagaatctacttaaactaagtcacttcgacaaattaattcatcgttcagttggttttattaaaatgtatttatttcactgtaaaatgtctagtaaagcaatgtatgaagtattttattttcatgttagaaattttatgtaaaagatatcccaaaatacatagacattcagatactctctgtatcattaaccaacatttactaacttatcatttagagaaggccaaaattgtatgtactataactttgtataatttcataagaattaaaatattcgattaatgcctgtaatgccttctttctaaatcaaatcctcaagcttacctcgagttcaaagttcagtatttattgtaacacatctcatagatgacggatgaagatggtaagcaaaggaataataatttcttttctcttttcacacatatatacacacataccccataatcctaattcatataataataacagaaaacaaagggcttttgagaatagtgacatattaatatccattatatttacttcacagggagactggcaagtctaccttgagaggtaatgtcttatagtacagtggactagattgtttcaagatttgtcatttattttggcaactcacccagcttccctgaaagttaagttcctcatctataaactgttcatgataattacaacctgcctcattagcctcatcaagctatttaaaatatgaaaggaggtgctatctgtggatcctgtcaaaggagcttgaaaactgcagaacattattttagtgtaaaatactataacaatacatgttgaatataaaatggctttttcttaacttttattttaagttcaggagcacgtgtgcaggtttgttatataggtaaactcatgtcatgggggtttgttgtaccgattattttgttacccaggtattaagcgtagtacacattagatatttttcttgatcctctccctcctcccaccctccccactccagtaggcttccacgtctgttgttcctctctgtgtccatgtgttctcatcatttagctcccactaataagtgagaacatgcagtatttggttttctgttcctgcattagtttgctaaggacaatggcctgcagctccatccatgatctctgaagaatctccacactggttttcacaatgactgaaataacatacactataaccaacagtttataagcaatgctttttctccagaacctgttatttttgactatttagtgatagccattctgactggtatgtgatggtatctccttgtggttttgatttgcatttctccaatgatcagtgatgttgagctttttttcatatgcttgttggtcgcatgtatgttttcttttaaaaagtgtctgttcatgtgctttgctaaaagggccctttcaaatgtgtattattaaccacaagagagtactgagtaagagactaggtaataaaagtcacaaatatttcgatatcataattcagaatttagatcagcggttatgaaattgttcgtatttccaaattccactgacaggactctactataagtttatttcatctgttgatatgtttttagccacttctttcttttaaagtgaatctgttgtgtgtttgccatttgatattagaaaactgaacctgcctgctttgctgtcttctgaatattatgtatcaacaactaacaagctacagttagttgttttgttctgtttttctctaagttattgtggatgaggatatatataactgcacagtcttatcaggtttgtaagagatgatcttaggctcatcttttaaattggtttttatactattttaaacaaatccttttaggagagaagaaaagctgcttagtctatcaacattaggaaatatatctttaaagagtttatcactgcaagtaaccaaagccaacttaaaaattcgcattatacaaatcattgagaatttatttagaacagaaatgtgtccaactataggtcaacaccaattttaagtgtgtaattatctgggaagtagtgttaactgcatttttttctaaagatcccttacagttgtataaatgcccaaaaggatattttgagtctctgtatattaaccaaaccaaatgtaattcattactcccaacattatatttcaacctctccaaatagtaccttttcgtattgtatcagcagaaaaatataaaatgcagatcttaaagagtatcaatctctttaaaaattcaagaaagaaaaaaatatgtgtgtatagagacgtgtatttcatctgctcataacactgtgtacatttctttatcaactaatttttttcagtgatttatgagttgaaatacaaatcaaatgaaacgggtaatgcaaagtaaagtagaaaacacattttctactgctgtctcctaatgcaggtcttttcaggaaagtactaatggttttagggaaagtgtataattatggttgtttccctaatgataaattcgcaaatctctattttaaaaacattcataaggttaaaaaaatgagagatgaaatgtgtctttcaaaattccttacgtgattgataatgcctatactctcttactatctaaagtctaggtgatatgtatattttttttaaaaaataaaatgtctgtatcagtgaaggaagtttacacagatagcttcaaagctgtggtttatctttggaggattaatctatttctcatgccagtgtgttgctactgcacatgttaaaaagtcatcctgtggtgtctggggtgacaaaagatgggaatgagttttctgagaactaatcagcaatactttgggaacatttaggtcatggtttccaattaactctggagagtttgagtaatttagtaccagacctcaagagagaggggatgaaaacctcgttaattcatatgttggtgaacggcaaaccagcaaatttgcattaaaaatggatttttattttaaagcaaagagcagccagatcttttctgcaatagtttgggtaggagaatatctttgtatgtatgtgttcccttatgtgtaggtatttgtatgtttcaacgaccctgcatatggcaataacagaaaattaaatttgtgctctaaaatgaagaccaggattcagtgacataatcttccttgtgcctttctttcttttagtacaatgaatatatcagagaggagtgtattccaatatctgtcttcagagttacaaaaacttcttttctagaatgcaagacttgggctatacccccagctctgccacttaacttgtatacaaccttgggaacatcattacaattctctcagaatcaatctctccagccctaaaatgaaaccagcaaaagcctgtactgtatatctaaaaggttttttatttttatgaaaattagttaggcaaacttttgttaagcatccatcactctattttgagataaagccttgctggatgatctccacctcttttgatggaaagagtaaaacatgtttaagatacatttatcacttgtttggcaaattgagatagaagtttatgaaagcagattgatatatgttacatttgagctactgggaaggactccagatggtttatagccttaattacattgtaactctagttaaatgtttacctatctgtaccctctgttaaacttgaatatgttaaataccaaagtccatgtattattggattttctgtcaccatcatcaggcacagatcctggtacacaataggtacggaatggatgcatggatgaattattgaattagatgttggtaggcatgtggaaataagaatgaggttcagaattaaagataatctgtatcgagtgtaaagccattggcagagaatgaaatatccagctgagtatacatagaaaaagaaggtaggtagaaaaatggaaaatatcttatgaagtgatgatagaataactctgaatatgtttgaaaacatataaagagttatgtggatgttagctttaaaaattatcttccatgctgtacattagatctgccattcttcatgctgtggatgaaaagcaagcatcagaagttaaattaaaatgatgtcatatattcctcgccttacagtttcataacagaggagaaaagagaaacattctctcattgccaccacccttctccagtcatatttctaggtagatgttgcccaaaaacagataaaaccacagagttggttttgctaggaatggactactaatccaggcaatgttgacagcttttgcttctcattagtgcacgttactaatagaattgctagagattaaaaggaatcctttctacaaagtgctgtatatccataggtgacaaaattctagcttcccctcacaagtacaatataaagttatgttttaaaatcaaaatgcaatttactagcaaactagtaggaactgttatggttacaggaaatttgaatttcagattaactctggttctatgagtagcggttgatatggcaagaatcattttgatcttacatccaggtgctactaaggtctctctgacctatatctcaccaaaaaaaggaacaaaataatgatcctttaatctttctcctaaaatatcataggaaatgatagtggctaaattgcaaataaactaggaaggaaagattcagagtattttatgtgattactctataacaatgccaggccatagtgaaagtgttatttagcagaagactgagttctttgaatgttcctaatttatcacattttaaaaataacctgggcaaaataacctttcatatcagattgagcctttttctaaaaatactcaatatgtttctgtaattatacctacacacttacaattccacagtataatgcaccgataaagtatttttcatccatatatctaatagtagaatggtgtgtatacaataattaagctctttaggcttaccccggaaagcaacaagtttcccttcctttttcctttttatgtattatgttggccataagaaattgatgatattcaactcaatgcagtcttagagatttattcagaaataccatggtgtgtgtgtgtggcgggagtagggttctaatgacaggtcagaacttacttatttgatttcttcattgataatcaggtcttaaaaagaaaatgggtatgctgaaaacatgccttctgtgattctttaccttcatgtgcagttgtctctggataaacactttctttggcacgtatagggttgcactaagctttatagctccaacactccgccccttcagtagattcttgcttgtaactgatgataatgcaaacctgtattatctataggtctccttaaagggcaaccaaaagttcagtagcaattcaggcacaattactgcatgtgagaatcctccatcttgttccctttggagaccacatatatttcttaggcaagtatatttttaaaatccttgttcagcatgacaattcaggaggtcaagttctcccagaaagcagattctgagaaagtgattagcatgaaggaattttattggagagtgctctcaggattaacacctgtgagcggaggaaaggaaagggagcaggattgggcagaaggagaagctgggctaccatacagtcacaactacaacacaatcaaccctccgcctctccttcctagccttccccaggaggatctctgaagtctgaaggtagaatagcccttcagaattgtcctgagttgcagcaagggacccaggattttataccccacaactctcccatcaaccaatacgtgcagcccgtctcggggacatagtgggtaactttgggctaggcacctctctttagctgagtccagctctcagacaggaataacagctgaggactgtcagccagtagcactaccagcagctggggtcagaagtatttcagtcctgaaaaggggtccgggcagcccagcttagcatctactatgccagtcgttctcaaatctggttcctggcaactgtgattctcaagctttagcatatattggaaggcttgttaaaacacagcttgccggattttacccacagagtctctgattcagtagagctaggctgaggcctgggaatttgcatttctaataacttctcagacgttgctggtgctgctggtccatggactatgagaacactgtttcatgctgcccttatttacatactgagaatggtacacagtgctcttatgaatagaatgaaaaccttttgaaatcacattattccttactccatcaaattctcagctatttttgtgcaccataaagctggaatagctgattataaaactttgttatgtaaaaaagtacttaaccaatacagtagattctgtttgcaaagcattattacagtttctaatatctggtcattgttacttgtaaaattcagccaaattttctccagggcctgtagtttgataacttggacaaaggaatttaaaaaaaaatctaattcaagacctttggttttttttctgaacatatcttttttttctttatgattcttatttttacattttacttatcatataagccacttaaacccatatggttccggaaaatttaaaactatatgatacatttagagcatgttgaatgcacagatatggaaattaagtattcttgactcattctagactagacctggcacaattaaaatttagggattcaacgtacacacacatagattccgagagaaatgttgaagccgtaaaacccccacacaagcaggaaacaacagtcttacctattattcaagaggcacgtaaaggagctcatttgaggagattttctgctgttattgccatcgaatttttaacgtattttccaaattagaaaatattcagcctgatgttgtcaatatttcagaccacaagggtatcatttaggaaaatggtttcttactgtcctgaaagagttactgttcttccctaagggcctaatttacaaagcagcaaacttgctggtaggatttggctgaaaatcacattgtctcggtagaactctttcatctgatttatgtgcattgcattttgcaaataactcttggaaagttatttactagttactttctctggaagcagagggtaagcggcatttctagtttaaggatagaggagctaagatgcatcaagcgcagctcatcatgaagctgatgctgataaaatgcacaatattacattctctaagtttcactctgccatgggagaatttcatatttttaaattttgtttgaaattggactacattagaaaatatgtcaaatgtctaaccctgcatttatattctggaatgtgacagcttatttctgttccaaattttgcactggagatggagtaagtcttaatgcaaactgcatgaaactgccacttttataggtcacacccagtcaattgtcagcagttacacatggttcaaactgtaaggtgtatgcccaattgtagcattgagattcgtggagttgttgcagtggttctgaatttttcaagcatgatacataaaaagataaatgactcttttgatatttctccttgcattgatagtttgcctgaaaactagataagcagggagccggcagtccacgttagcccttgaactacatgaggtttaatttatttgcccaaccagaaccctacactacctttcagctgtgcagtattaaagtttatttaggagttgataaatagcttagtgcaatgcttccttttttccagtagctacatcctcataaacctattctaccctccaccagttaatgcagacagaagatttttatccagtatgagcactgaaactccactgtggaagactgtgtgctcagcaaaaacctcacccatgatgaataaacagctcttccgggggctttgctgccgctggctcggcaggagttgtttattgcctggtttgcacatcccatgataaagttgctgctgaaataaattgcagttttgcataattattgacaatcacatcttaacaagcaatgtgtatcatattcaagtgttcaattttttaaaatccatttttagcttatgtttaatcccagaaagtgtttgtgtagtaatagaaggcaaataagacatttaaatagagtactaatttcctcattgcagacaaagtttacctgaatctttttccataggactgttactgcctaaggcaattttcctttctaagctattattatatagatatttgctgagggcatatgtgtgtgtatccacaatacatgcattttatatatatatatatatatatatatatgatcaaaaatatgaatacatttttagagtttttgtcatgaaagagtttgtttcatctttttaaaatattacaggaatggggaaatgggatatgggtagaaggaactaatgtttttgagtaactgtaatgtataactgtataacgtggggcactcaacttcacaggaattttttattttaattctcatcacagcaatagatattgcagatgagaaactgagaatcagagagggaacttgccatatcacgtaagtggtaaagaacactgggaattgaactcagatctgcctagtttttaaaactctactctttttcattacacataacatttttattttggaaaatgttctcagttgtatgatcaagtagttaaatatgaaactaacacaataattataactgatgtcatgcaaaatgatagtttgcacaaaatgatagtttctatgaaatgttatttctttacttgttaagtctttcttcctttgccctccaatccccttctttttgtcttttcctctagtcttttccttttgattctaggtttgtattttcttgacttttctccttgcatatcaaatccttgttttctgcctcagagcagcatcaaagacaagcatggtacagggattttagggttttaactataaaggtttgtctcaaatttggcagtatattaaaaataagctttcaaaattgaccaacaaaaactacaaaattgaaaaaaaggtactttgaactttcacatgttcaaatatatgtatatatatttcacatatatatatgaaacctcctctgtggagaggggtttatagaaatctgtaattgtcattcttgcatgccttcccccatacaaacgcctttaagttaaataaaaatgaaagtaaatagactgcacaatattatagttgttgcttaaaggaagagctgtagcaacaactcaccccattgttggtatattacaatttagttcctccatctttctctttttatggagttcactaggtgcaccattctgatatttaataattgcatctgaacatttggtcctttgcagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagtaagtcaggcatttccgctttagcactcttgtggatccaattgaacaattctcagcatttgtacttgtaactgacaagccagggacaaaacaaaatagttgcttttatacagcctgatgtatttcggtatttggacaaggaggagagaggcagagggagaaggaaacatcatttataattccacttaacaccctcgtcttagaaaaagtacatgctctgaccaggaaaacatttgcatataaaaccagagcttcggtcaaggagaaactttgctcagagaaataacttagggattggtttattaaattttaaaagttgacatttttgagtgtttatttaatattttacagggaaagcatctgtatgaattgtctgttttatttagcgttgctaactgaatcagtttcccttcattactttcaaatatgttttgaaatgttaatctggcattttgtagctttcttcctaacatgatctgtgaaaataagaatgagatggctgaatttgtcgtagttaatgatcaaacaattttcagacaattgtttttcctagaaacaaaaattatttccataaagttccatatgcataaacagtgaaaacagaacgtggggtagttttgtttaaatgaagtcttggtgagaatcatattctgtagtacaaggaggctcttaaagtttattctcaatacctgatataattttcctgaactattatggagttttgttatgtatagttggtttttctgacttgatataataactttactagtctctcaaatacaatttggatataaatcattataataagatgattgattttttagactaactttattttttgatatttttaaactattatgaaaaactattatgaaactattatgatatttttaaactattatgaaaagtatattctagtttgaataattccagaatcaaatcataataagcagaagttcttctcctctccctcctatcgttctccttctcctgtttttcttttttgatatgatagttgatctactttgctgctctgttgcatagagtacgtaacagtggcaatgtatggctcctgaatttatcgttcttgcttcatcatcctgctttgaccccactttctcctccaaaatgcgtgttgagttagtttgatcatttggaggtaatttgtttggaacagtatcagactttatagatatctcccatggcttgtgatagaatataagggcaatgcaaatgtagagttttttgctcactcttcgatgtatggttagacaatgtaccactgtaatatatttggcttaggctatttcataaataaaattttattataaaatattataaatgctgataaagctactccagaattttaatagatatgtgggtttcccggccagatgcggtggctcatgcctgtaaccccagcactttgggaggccgaggtgggtggatcacctgaagtcaggagttcgagaccagcctggccaacatggcgaaaccccatctctactaaaaatacaaaaattagctgggtatggtgacctgcgcctgtaatcctagctacttgggaggctgaggtgggagaatcgcttgaacccaggaggcagaggttgcagtgagccgaggtggcgccactgcactccagcctgggtgacaaagtgagacttcatctcaaaacaaataaataaataaataaaaatacatgggtttacattttacccatcagctatggtaggtaaataataagctttgattaagtctattttagtctatttttagcagattactttgaaaaataaagaataacccaatgactaaaaaattattttatgtcagggatttaataaaacatatctttaaatctagttgagggcaaaaatacgtctattttctactatacaatttgtatttatatctgctgtattatataatgaaaatttatctctatttctaatctcaagaaactgcaagcttctgaatcattaaagggaagattcaccatgtgtcctaactatatttactatggaagcatggaaaataaatattttatgtttagatttctgatctctctttcaaaagcagttggaaattatgctgagaaaatgtcttagcttatcccatgttactcaagaaaatgtatttattcgtttttgtccagtggcttaaccaaaccacagtttatttgttgctcacataaagtccagtgtcgatcaggctactcttttccatctttgagctaaggcacatattacacataactttcagtgtacccgaggtagaaaaagagagagcttgggaataaggcaggggctttttactgtctcaaccccaaagtgataaactacatttattctcaaaatccagataaaactcccatagagcctctgaaaacctcaacatttgcgtcttaactataataaggttaactaagattccaaaattattttaaaacagagacagtttccctcttccctggcagctaatattgtattttctataaatccacttgcccaaggtttaaactacattttatggattgaaatgacatttatagccaactcctgatttttagttagatggttggataatgatcttttgatgaaagactcggagatgtcatggtaaaacggtgaactactgaaactattgattattgttaatggcacatttcagctgattgaattgagtcaagaaactggtgttgaagagcaacaaatggaaatgccgagcttgaaaataaataaagcagcataccttaagagattacatgcaatttcagtatttcagctaaatggaagtgtttgctttttttcctctatgaatttttattttgaacaaaaggaattttctataatatgtaggtaggagaaaagtgaaatggcatgctttttcacttcatttgaagaagctggtagcattgtattcatagattcatgctgtatagcaatcatagttctcatatattaaaaaaaaaggaaatttgaaatgcctagccaaagcaacagctctgccaacagattttgatatatctgtctaccccaaaagtagtgatgatttacttcatacaaatgctagtgaatgaagagagagggtgaaaaccttcacaaaatgtgtttttctctaagactgtcaatccgtttttctatatatggagactccagctcttgctagactacctatcactttcgtctatcagccacttcgtaagatatttattctctcagcaataatcataattcatagattctttaaacatacatgtaatataaagcatatacattctgaatggaattaacatgattaattcttctctgaaagacattagaatttcctcccgtattataaaaaggtgtaactcactttccttactaaaatcaagaactttaccgtcgtccttgtacttcaggataagggggtgtttcttataaatattgttatttctgatatgctaactggaatttttaagcaaatgtatttttatagaacgccatacaaagcctttaggggtgaaagtttcaggatttttaaattgcagatttatcctttaaataaaaaaactatattcgtaattgaatcggattatttctctatccaaaacattttctgctttgggcctaagaagagttgacaaagctgttcatggttcaaagtactaccataaaaccctgggtaactaactgaaaatggaaagactctgtctttctgaatatttcacaagagtttcacaaatattaagtggttctctaagtacccctgagagatcattgtaatattagcttgtaaagacaatgtgggggtgtgggtatgtggtgacctttatgatgttcataaaggtggtgtaattaacatatttttctcagcaagacaaactaaggagcaataaatatatgagataccttcatctgtgatctgggtcatgtctcaggccatatctttcaaatcactcccttccctaatctcgtgttttacctacgtctcctctcaatccccccattataaaaattgtcttctgatgaataaaacatttccagagagacaagtttcataaagtttgaattgtacatctgagtacacctatgaattaagatatctttgatttctaatatgttattaaaattgggtgtggtggctcacgcctgtaatcccagcactttgggaggcagaggcgggcggatcacgaggtcaagagatcgagaccatcctggccacaaggtgaaacccccgtctctactaaaaatacaaaaattagccgggtgtggtggagtacgcctgtagtcccagctactcaggaggctgaggcaggagaattgcttgaacccaggaggtggaggttgcagtgagccgagatggcgccactgcactccagcctggtgaaagagcagactctgtctcaaaaaaataaattaaaataaaataaaataaaattggagaagtttctcaccaaaattttggcgcacggattaattctgaagaaagaagaaagaatgcaatcttagtagcacaattagtaccttgaataaattggagtatcgtatttcttggactatctgagaatgcagaggcaatttaaggatccctaattctaaggagaagaaacctttagtgtattccttcctgttgctttagtttgaattgagttttatatgtattttttaatctttctattttgattgttgtctaaagagtgtgaaagtgaattttgatatttttattttgcctggcgatgaatgccttctgctctggatatttaaaaattatatacacatatatgtgtgtgtgtgtgtgtgtgtgtgtgtgtatatatatatatatatatatatatatatataaaatttttctgagaacttttattaattcagcgtatctttgctaaacacctgccatgtgtcgtggtgttaggtctggtgatacaaacatgttcagagagatgattttctttcttttttggggggtgggtaagggaaagaaggcttatacaacagaatcttatttctcacagttctggaggctgggattccaagatcagggcctggtgagggcccctcttcctggtttgcagatggcttccttctctctgtgtcctaacatagcaaagagagacagagctctgatgacacttcctcttgttataagggaactaattccatcataagggccccaagaaaggtgcttttcaaaaacagttcagtaaaagtactgggttgtataatcactttaatgagtatcaatccatatttttaagatagaaatgaatgaaattagtaaaatagaatagaaataaggagtccatcacttttaagtaagtttcaatattgttcgtaaaactttggttcggtggtttgtgtgtgtgtgtatttgtgtgtgtgtgtgtgtgtgtctgtcggtgtggaaatactggatcactttgtaacatatattcaaaagcctctgtattttaacattatttctgcctttgagaggttcacattccagaggtgaagacatacatcctaagacaaaattataatagcattatgagaattacagtagagagctggacagggtctagcaaaaacagaagactaggctaaaccttccaaagaggccaggaaactcacctagaacggtggattttaaccttgcttatgcactgggggagattttaaaaatatctctgcccacaatagataccaactgaattgagcatagcatgtcctacccatgaatctattgtccagtgagaacctctgtttagagaaagtcaccttagaagaattgttaggagttatttaggttcatggggttgaaaagagcattcgtgatagaggaaacaccatatccaaaggcttagtcagtgtggtagtgtgagaatctgaaggaacttggctggggtatggttgctacaagaaaatgaaattagatcaactggggctaaattatgtggaaagacagcatgatgtagcagctagagtatggaccttgtaagcaggaagaccccttatttagcacttactagcttattgtctgacctctgagtcccaattttactcttctatacaatgagtacatcacaggattttatcaggtttaaatgataagatatatgtaaaatgcataccagagaggcagactattggactcgaagggctcagtaagtgtaagctggctctctctgccccttgccacctatttttcagactctggacttttatcactttaagtcatagcctagttctaagcaaggaaatggactaatcagacatgtttttaaaagatcattctggtagtggttaggagaatgaattggaaagatatgagacccatgcagggacaacagttaggacattatttctgtaataagccaagcaagaattgatgatcaaagtggtgaggttgaacaaacaaaacagatacgtgagctatttggagataaaatcaacactgtcatatgttttgtgggaggtggaggtgagcagaaaatgtgaggtaaaatgagaaatcagtgcctgcttaccacttggcatgattgactgaaggtagtgtcttcactcaatcatgagttgcagaattcaagatggcaaacagttgtgaggagcaaagtcaagaacgtgtttgattttgaggtatctgtaagtgaaaaatcagaggtgaaaaccttacctctcttgaagcagttgtgaatgtaaatctaaggtttggaaaaagatctgggttaaagatttaaaattgaaggacatcaacatggaagccatagaaataaattatattacacacaaatttatgtcgttatttgaatttctccatggtccactcagaaatatatctaaatgtcaccaaaatgttacttactgtagtacagaattggtattaagtgatactattgtccatgttattcaaaaagacagttatagggaccctcttaataaactaattgtgaaaaaggcaaagaattagcaaagctttggcataaaattcatatcatgggccaggcgtggtggctcatgcatataatcccagcactttgggaggctgaggtgggcagatcacctgaggtcgggagttcgagaccagcctgaccaacatggcgaaaccccgtctctactaaaaatacaaaaattagccaggtgtggtggcacacgcctgtaatcccaactactcgggaggcagaggcaggagaatcgcttgaacgtaggaggcagaggatgcagtgagctgagatcgtgccattgcactccagcctgggtgacacagtgagactccatctcaaaaaaaaaaaaaaaaaattatgtcatggaaaaagtaaaagtctttgcataatgtatccaagatcatgaaaaactcttttcaataagataattagttccttttcttatataaacatggaaattttcatttttccttttattctcatattgatactataaaaaccccatcctcattcacaatactactgtctctaccctcgatagataccagttcaattgaacgtagcatgttctacccatgaatctattgttcagtgagaacctctgactataatgctcaggaatactcaagactcacatgattgtcttcttgctatatttagttactttattattttccattttgggaccctgaattcctgtagatctcagagaaaatccgaaatgaaataatgaaaataattaaaagtttagaaaagggagtcaatggggacaaatgttcaggactggtcttttatctcctgcaggaagaaagactgaatgcagaaaattagaatccatttttcatccagtcaccccaatttaatgcaatatgagtttagctatttgattttaagtgttgtaccgttttggaccatgttaccatggtaacatgaaccatgtctcattcatacgtaaacatgttaattgtattaaaacctttaaaacctacttctggatgttgccattacattaaacaattatctagaatgatacaaagtaatgactaaattgaataactttgtaaattaactattggattttgtaattttatatctataaaccaaaagaaaagcccacattggtaagaagacactgtgcatactgaaaagtcaattttgttagcctccaataaccattgtgttttattcctcgcagagcttttgtgaggatcttataagggaataaatatgaaagcactttgaaaaagctttcaagtgaaaggtccttattaattttatgaattaccattaaacaaaagtcaaactgaagatgtaaatctaataggatgctcttaaaagtcaatggatcaaagttatattaattaataaagaataataactaaatattttatgtttcataattggcaaagtatctttactgtcattttctaatttgatccttagtgaaaacctgtgatgttggtactcctattatttccattttcatttgagaagaataaaattggagaggttaagtaatttatctattgctacttgttaaaataactactaaattttattactcccagttaggagggcaattatataaactaaaagcttgtcacaataaatgtttacttttctgggattaaagtcatcatgtatttttcaattattaaggggggtaataataataatagctacctttttaaaatagttactatgtgccaaggtgtgtactaagtgctttgcttgcatgatgtaataccatcgtatatttagtacagaggaaaaactgagaggctgggtaacttctactaaggtaacacacaagtactggttgagtatcccttatccaaaacacttgggaccacaagtgttatggatatcaatttttttctgattctttttttggatttcagattttttcagattttggattacttgctttataattatgggttaagcatcccaaaccccaaaattcaaaattggaaatactccaatgagcatttactttgagaatcatgtcggcgctcaaaaattttcagcttttagagttttttggattttggattttcagatttgggatgctcaacccgaatatatagaaaagtcagcatttgaacctaagtttgactttctgatcttctaccaactctactgtcctacccattactctacattgactcagcattacagggaaagacccaagatcaccaaaagcaagcttcaaatcactcatctaatagaaattagtggaaatatttctacttcctaaacatccatctttcctttacattttaaagtcaagtttctacatctgcctcccaactgaaacacttctctatgaaatcaccataactaccaaatgcaaatatttttatcaagtcctcattgccctagaaatctactcatattttgttattactgctcactacagcctactgaaaaatgtctcaccttttgacttgccagggtgatatattatactaattgtctccttgtctctctaagcactcattccttcctctttctttcttctttttttttttttcacttttattttaagctctaggggcacatgtgcaggtttgttacatgggtaaattgcatgtcatgggagtttggtgaacagattattttgtcacccagataataagcatggtacctgataggtagtttctcagtcttcaccatcctcccaccctccaccctagagtagatcctggtttctgttgttcccttctttgtgttcatatgtactcagtgtttagctccacttataagtgagaatatatggtatttggttttctgttcctatgttatttcacctaggataatggcctccagctccatccatgttgctgcaaagaacataatctcattcttttttctggctgcacagtattccctggtgtatatgtaccacattttctatatctgatctaccattgatgggcatttaggttgattccatgtctttggtattgggaatagtgcagcaatgaacatacagctgcatgtgtctttatggtagaatgatttatattcctttgggtatatacccagtaatggcattgctgggttgaacggtagttcagttttgagttcttagaggtatttccaaactgctttccacagtggctgaactaatttacattcccaccaacagggtataagcattcccctttcttcacaacctcaccagcatctggtattttttgactttttttttttttttttttttttttttgagacgaagtctcgctcttgtcccccaggctggagtgcaatggcgcaatcttggctcactgcaacctccacctcccgggttcaagtgattctcctgcctcagcctcccaagtagctgggattagaggcgccttccaccatgcctggctaattttttatttttagtacagacagggtttcaccaggttggccaggctggtcgcaaactcctgacctcaggtgatgcgcccgccccggcctcccaaaacgctgagattacaggtgtgagccaccacaccaagcccacagtatcaattctatgcattcttttctgatttcattaatctcattatcttcatttgatatttagtcaatagttactgtcagttatgtgttagttattatactagaaacagtcttttctccatctcctttaatccaatgatttgaacatttttattcctttccaatgtctgtcccacatttcttactgtatgtaggacatttcttactcaaatgtctcacaaatgacataaattcagtatgacccaaataggccattttttataccaagtcttatttcctatcctgctgttcatcccggtaccatcttttcagtcagagagttcagatcatatagtcatttctaaatctcccacttacttgcctcactttcaagttcatttttaaggtctgtagattctgcctccctaattctttatgaccattcctttctcactagccccttacctccactctcattcacactcttactattttttaccctcctccactcattcctgcccaccagtggctccaatccaacttgcagatttccatttaaattaagcttcctaaaacatagcttaggttgtaactacaatgcaaattccatgagagcaaagatttcatctgctttattcacttgtatatatccattgtccaagactgtgtgtgtcacatgaaaagtgttcaataagtatttgtcagtgaacgaaaataatatatgactcccctcttcaaacaccttttttgacttcaaagcccttcagaatattctacagactccttcacctggctctccacaattgcccctgagtctcgtttccaatcttatttcttattttacctctcaatgcaccttcaactcctactaaaatgaacagctagccagcttacttctgtgtctttcgatgatcttgttttttgtcttgagattcctttttttcatctaagcttacccaaacattacctacttttcaaggaaagccattttcgaatcttccctttttccctgagcccccaagctggaagacatcttgtctccatctcaattcctataggcatttctctgcactttaaatgacgtttagtacttctgacattgcattagagagaggctggggtggatagtgtttcatagtgtgaactttgaagcccgactgcctgagtttaaatcgtgattctggggcttactgaccatagacgcatttctgaattgctctcagattatggagcataaatcaaaagtaatgacagctacctcttcaggttgttgtgagggtgatgcgaattaatgtactgaagtgcatggaacagtttctggcacacggtaagcacccaataaacatagctaatattatgttattactattttcaggcttatttttatgtatacatatagtatgtaattttatgtcaatatgtataaatagactttggtattgtttatttcactatcaccttgagagcacaattctcatttgatttgtgtgagaaactacttagaaagaaatagacgtgtgaatgaaactatgcttgaaatattggttactgtgagtgttgaaaatccattttgtttaaagaaagcttcaattgttaatcttccataaattttagttcttaagcgttcatattgactcgttttggaaaagctctttaaagtcttgggatataaacaaggctgaataccctcattcatgataacaaacatattatactgaaaattgtaagagagatattttatctttcataatgccctccttgggaaaatacattgacttggcccttctctttcaatcagacaccaaagttgagattgcctgaaacacagtttggtaaaaggagtttctttttcccaaacatcctgagtaacacaggaaatcacaccaatgactgatagataacgttaataaaattaataaagttgttttaaatgcataccatggggcagtggcaatgaaaacattgagaaggctgggactatttgccaactttctttgatctccattagaacctggacaagatccacataatttcagaacttcttctccaaacaagaattgaaaaggtcaggaaaagtttgaccacagaaaaatgtcaaagaattttgtgtcactttctcctcctcccttcctctaaccttgaataattttttagggttattggtctttgggagcagactttctagaccaaaacaaaaaaaatgatattcctctatgtgataggtaacaatcactacccatcctactggaaaattctcaaagtgtaaattgaggggataaaaaaagaatcttaagtcctttaaattatttttaagatgaactacattagtgcctctcttgtgcctttcataattctgataataaaacattccaggtattagtcaaagattaatggtattgaaaataatttaggttatcagcatgtgattttcattccacatgaggtccttttgcagtttacatggttttctaaattatattaaaataaaatgtcagaaagttcacatttttttcatgtttaacagcatcaatctttaaagaaaagttattgcacaaaggtctgtgcataaatcagccattctccgaagaggtaaaagaagtcattacgcctggttatgagagagagtttcatgaatgtaagagacataaatcatttcccactggagatcatattagtctagatggaagaatgtctgtttcttgatagtgagaaagcaacaaattacttttgtttgctcctgagtctgtggttgtccttgagaggtctgttagcatgttgactattgactattcaatattagcattataataacttacaatgatctgagtcacataaatataatctttcagttctctaaagattttactttttcctctctaatatctattcacctccaacacctttgcaaatatattattctctgggagttacaaagaaagttattctctgcaggaagcagcatttcagttgctctcaggagccaaccacatttcacctcaattctttgctcccaattcaacaattcaatattggattaaattcaaggctgtgaccccaaatagaatgagacctggatatttatgaaccacttgaccaggcattcttcccatgatttactccataaatcctttttagtttttgcagtagctttacaaatatttggaaaatggctgtgcaatgcagttttaaaaagtgcaatgagtagaggtagcttcttcacctggtatggtaaattgttgattctcttttggagtggaaaacaagtgttcttatttggatgcaaccattgcattgattagacaaccctaaattcatctttcatccatgacctgaaagaaattttgaaattcatgcaatatatacccgtagtggaaaatgtactttttgaatggattcctgaatgtgacttttaagaagagctattaagaagtgggatcttctacagaacagtaaacaggcatgaaaatatacaagttgataagatatggaactaccccaaaagaggaattaatagtggtggggcttggggcaggaggacagagagacctagccaaggaaggaagggctatattataatagagtacaaagtcctttagtcatccaagagaaggggcaccttctgcatcccttatgagtaagatcagagaaggtattctagttaacttttgctacataacaagccagcccaaaacttcatggcttcagtaaaaattacttgttttgttcatgaatctacagtttgctcaaggttcaatggggcttgcttatccctgtttcagttgatatcagttggggtagattgcctgatgctggaggattcacttccaagagggctcactcacatgcctggaaaataggtgctgactgtcagtttttcttcatgtggacctctccatggagcagtttgggctttttcacagtgtaagagttgggtcccaagagcaattatcctaagggacaagaaattaaagctgcaagcttctcaaggcctgccctaaaagcaagaatggttttgcttctcccatattctatttgtcaatcagtgacagagctctgattcaaggggatgagaacataaactccacctttccatggagaagtatcaaaaagttttgatgccatttaattaaagctgccatacaaagtttcttataaatgacactgagctgaatgaatactaaacagcaagtagtcattatcccagtcaagagaagttatctttgctcagaataccctttctctccttgtctacctggaaaattcaactcttggccaaagccctacctcttctcgaaagcattaccaggccttgcctctaagtgtacaattggagatacaccagtatactgatgtttttaaaactttaaacttttttctacaataaaacataaattaaataacttcccttctgacttaaaagctgcaaaatgctcatgacagtaactatataaattaaaattaaatcttaagcacgataaatacctctcgaatagcaacatagatgcttacttctttatttcacttctttatttgcttttctttgtctatagtttgccccaaaggtattttaataatatcgggttccatgtataccagtgtgtaccaattaatatttagaatatacctgttaataacctcatttgcatagccctactaatctgagcacagcgcagccttaagaaagtcttagtttttctcagtttagttcatctctcttctcttctcctcctgtctctcttatttcctatttctttttcttttcaagtgactttcaactaagtagaaaatgcatttcacatcactatgccggcctccaggctctgtctatttcattcacccaggaatgccctttctgaatgctttctctcatttagcagctatctattgaagttggacaaatgatagaaattcatttcttaaagagccagaacatcatcttgaacaagaagttaaaagaattcagcaaatcaaaagatgagctaatatgggtgaatcttagaggcattatgctaagtgaaataaaccagacacaaaatgaaaaatattgtatgattccactggtatgagctacctacaacagtcaaatttatacagacgtaaagttgaaggatgttaccaggagctggaggaagaagagaatgagggcttattgtttaatgagtacctgagtttcagtttgggatgatgaaaacattctagagatggatagtggtgatggttcaacgataataataatataatattaatgtacttaatagtactcaactgtatacttaaaaatggtcaagaaaatggtaccccgttatcctgatgtgattattacacattgtaggcctatatcaaaatatctcatgtaccccgtaaatatatgcacctactatgtacccataaaaaaaatttaaaggctaaatggccaggcattgtgggtcacttctgtaatcccagaactgtgggaggctaaagcaggaggatcacttgagctcaggagttcaagaccagcctgggcaacatggcaaggccccatctctacaaagaattcaaaaattaactgggtgtgggagctcatgcttgtagtcccagacacactggaggctgaggcaggaggattccttgaacccaggaactggaggaagcagtgaatgacactgtaccccagcatggtcaagatcccaaatcaaaaagaaatgattaaaatgatcaattttatgttgtgtatattttgccacaatacaaaaatggggaaaagcctattcgcttttaagtatccttaaaaaggcacagcttcttcagctaacagactctaaaactttttttaatagaagtattaaggtatttagagagtgcaaaatatcttattttaagtcaagaagttagggtcctgttcctaaacactagcctctgtaatcctggggaagtcagtgctgttggagatctcaggttgatcttctgaaaaatgatggatctaggtaaaagatatgtttctccaggtttacataccacggacaccatctttacttggaaactttattaaaaatgcattgtgtcagaagctctctggggatgggtcgtggaatctgcatatgtaaagagcccctaggtagttcttgtgcccacttaaatttgagaaccactagaccagatgttttgcttatggccctttcagctctgaaatttgaaaaaaaaaaaaatgattctgcaagacagagtctctgtgcttttgcaggataaagaaatgaagaaaataatacttcctgcttgtgttggagcatttttttcatttggtatccccatctccagtggctagccaatcaagaatagtattgtttattcttcccactgttttgaagatacaaaaggaaaagctaagccagatgacacctaaaggcttccattaccattttcatgtttttccctttgcataaaaactgtccatgcctccatcagagccatgatcactagtacaatgttacactctaatgactcatgacattaaattatatcttagcctaatatgaccaaattacaatatcagaataaaaatttcttttttcaggttgaatcccataacttaatccaattataatactggctgaatttttcacaattatgtctcagtcttgatttagggaatcttctctttatcataaaaatgcattttgttaaacatgtttcattataatcaatttctcaaaagtaaagttaatcaagagaaggaaaaaaggttttgttttgatttgatttggaatgtgtatgtgtgtttactgtattgaaatagattctgtctgaaagactgtatataagataaaaagtacagaagagtagtcagagagttattacccacccctgactgatggtgaatagattatctaagtatcccgtaaaaggcacaactccttcaggtatattttacaaattaattagtaactttctagccaaatttgtgtcttaaagacaccagctagaacttggttagttctagcaaagaagattattttattctgaaacaggtttttgttgtcgttttacttatttgaacttttttcttgaatatgtatttctttgcacataaaatatattgacttatgaatgtgattaaaatggaaaataattagttgattttagagagacagagagaggagaagagaagtgtgaaggagagagggaggatagaaaggagagagggagaacaggaaggacagagggagaatgggaaggagagggagagagagagacagagagagaggaatggagtgggtaataagcaagagaaaaatgccaatcatatgctttgctagtgtgtaaagtctgataacccaagggagagaggactactctggcctagtgaaacaaaggaaagagaaatatggtagaatattctcctggtgcttcaccaaatgtgacaccagaagtctgacagaagtcatgtcagcatttgagctccataaaactcaggctatcgacctaccatgtgagagtctcaaaatgagtttaggtaggggcagaggagttgaaatccagtaacatatgcaacagtgatcacaccaggattgcacatagaaagcaaattagtcctctaatagagacgccaatttgaaattcaccctctgagcaggtttttaagcacactcttcttttacttttctatttacaaaaatggaacaccaccagaaaaacaagaatttgaaagacgagatgagaaaagtaagttgtaattggaaacagacagaatgtgtacacaaacacacacacacacgcacacacacgtgcatgcacaggtgatgagagagtagtttgcctacatggtgtatctgactaagaagactttttgctctggttgtcttacaggaagtgactaaatctcatgatgtgaaatattttcttgcatattgtattggaaaagaaaataattttcccaaactccttaggggcagtgttgtcttataattcccatatagtatatgctcttcaagtaagtaactccagagttgagtaagacaagactcgtgactcagatggcatgctctgctccctagactagacattgcatcagtctgcctatactcacatccgctgttaaaggattgcctccagtaaaatatgtcttttaattccttatacaagaatctggaaaaaaaaagtaagattctctatttcttaaatttagcagcaggttaatcactgataacaataaaaatacataacaatcatctagcacgggtaaatattgtggcaaaaattacaccctgaagaattcagtcaaagatataagtaagtacacatcattgtcatgttccacaatatatcatctgctttaaagaaactgttatgtagctgtagtagatttaatcattaatcccatttcttctccaccttctgcaatcacaaccttaacaatgcctccttatgagtggaatgtacttcccaacccctagtcttaggggttggccatgtgatttgctttagcaaatggtaaatgagcaggagtgagaggtgacagttttcagcctaggccttaagagatctatacattcctgtttgtgcttctgctatcattctgagaacacgtccatctaggctgctggtctcaggaaaacgataaaagacatgaacagcagggctgcactagccattcacatccaggaaaagaaatgattgttgcataaagccattgagctttattctacattactgtgacaatagctaattgaaatagtaaatatactttggtttttcctaaatgcatattgaaaattaataatattagccatctgtatgataaaaatataaagcctatgttttattttttaatggttcactgccctaaataaatttccaaaaagtagatgttcccttgtctagtgatgtcattatattttatttatacatcataaacacactgtttatttctgctcatttttttgtaagtaacatgtgttaccgccaatcttgagatgatacacacacttctgtactaaattttggaaaacatattagctacccactccttatatcaaaatattgcctaataatgtgttttgttttaatccttcatgaatttccaggagaactgaactgatacttgggtttgtgagatatatgaaaatagtgaacatgaacttctggtttaacccttgtgatgataatggaatcatagctctgttaattactcttgtggtttgtcttcctagagataatcatgtacaaaattcctttccaatttgttatataatattagaaatacttccaaaattggcatggatttattgttatcatttgttggcacaatcattaaaacgaaacccataaagctagataattaaatgtttacaaagctatagtactcaaaacaaaaacactgtgaaaagagattttttaaataatagtttttgcatgccttttgaataattggattattctgaatttcttcatgtttagtccctgaatctaagtcataccgtctacataaaaatagatgtcagctgaagaaaaccaggcaatggatttgtcttgacgacaatctttttatatgttcagacttcatttaacattagacttgtctgtatttgaaattggtatttctttacatttctgaatttagggaaatggcacaagagaataacattaatttcctctgcattttggcctaatcaaatttgagcctttcaagagacacagccaagtcaattcaaagagacatatgaaaagactactgttaatgtatctttaaaatgaattagcggcatgaactgttgctaggtgagttaggtatagttgtagtttttagtaaccctaagagaagatgcagtgcattctaaaatgtcacaaggagtttgattgctcaaaattctgggagattggctctctgcaaggcttcttgatgtcattgttcctagaggaatgttgttccagtacctatagcgattgcagccataactatttatgtgtcattgtagccattgttattactacatgcttcacatacctctactgaggtctaaagaattagtggacttcatattctggagagaacacttgaagaaccaaacagaagtttgatgtgaatctgcatatccaccattattgttcataggttctcaggattagttgagtgatgccttaaagaaagaaagtcagatgataggtcttcctgctgcccgcaccacatcatgagtgttattcctatagaggaggagtaaagagtgggaagaaaatgaaatctgtcaatactgtgaatatataaataataaaagtagcagtaggactgattaattctgaatcatctttatgaaatgactggagccgtgaaaatgctcagtctgcacagctgattgagaaatgtatgcaatctgttgatcggaatttatttgtgaatgctctcttccagagatttatataccagagttcttaaaacgaattttgtccccatgaaaagaaaactacagatctgtaagactgcaatttaaaatggaagaaaacatgttcccacttgaagaacaactttcaaacaaacaactgatacaaaaaagtcaaaagctgttttgttttatataatagtttcagaatacttccagtcaatatataccttggtttggtgaaaaaataaaaagctaaatccttagatcattaactagaaatttttgtaaaataaataaaagccgtgggttttagtgcagtgatcccatgaagaggaatatattcaccattggtctcttaatctcagatagaatgtacatgttactttattttataacgaaagcaactgtgttgtgatattatgtataatattataacaggagaagtcctcttagctaactcagtaatcaataacattgtacgttgtgtgttattgtaaccaaaaactatgacagaaccccatttcataagatcagtttatccacctatatgatttatatttgaatattcatttcagtacttatgttgcttaaacaaagctactgtattagtccattttcatactgctataaagaactgcccgagactgggtaatttctaaaggaaagaggtttaattgactcacagttccacatggctgggtaggcctcaggaaacttacaatcatggcagaaggtgaaggggaagcaagcatcttcttcacaaggccgcaggaaggagaagcgcccagcgaagtaggaagagccccttataaaaccatcagatcccgctatcatgagaacagcatgggagaaactgcccttatgattccattacctccacctggtctctcccttgacacgtggggattatggaggttatggggattacaatttaagatgagattgtggggtggggacacagccaagccataccaaaaactctgttttttgtttttgtttaatggaaatgatttagaactttattttctgatgtttctttttcataaaaccacgacaccaaaatctacttttcactgctccattcaactagtagagaatatctaatctcttctcaagtatttctttctcaattatggtggttttagctaagaacagcttatggcatgcttttctaaataatattagaacacataaattatctgtacctggtattaccacattcattgctcattttaagatctcaattgatacattcaattcatatatatttaaaattgattcatttagagcaagagatacaggcattttaatgtattacactgctactaaagcttagcaaattattcttttttgtgcccacaaattatcatccattcatgtcctaaaaataaaattgaatttattatactttcccatttatccaaaaaaaaggttttttttaacaattgatgcagatacacattttcaagctaaaaatatgtgtgaaagtggcctctttctcatagtatttattttaggagtctagcaataatttttcttaggttatcagcacatgtcttagcctgaattatttgaattcagtctgtgtcttcaagttcagatggttatgtgatcttgttaagatctcaaagtagtgggaatgatggagtatacaacaacctcattgttttttatggcaactgtcatttactgaaggacataaggctagcagaacatggtcagagaaggaatcaaagtttggtcagccaactctgctccacagctacaagctgctagacaggcataaatttttccaaacctacacaaagggacttagggcccttggctgagagcgacattctaaccacttccttatttatggctggtggggtttgtacattttctcatttctgtataacatttcttgactgtaataagcaatgtattcattctgctttaccactttcactaaccttaacctcaatatatactcaattaagcaattgaaaacagcagttttaatcttttgacataaatgatttcctccgaagcaaaatgctggaaatcccctcaaatgcaccttttattgatgaatacctataagcaccacctacagtcgctggaggctgacaggaaccaaacttgatgataaccactgagctgagaattttcaactcactctttttccctgtatggttcttctagctgcattatttcccactatttaaagctacagctggtgaactattcaaatatttaaactttggagaagaaaatatcaacttatcacaaccctctttttatattctaaattcatatacctgtttggtacttaaaggaaaaatatgctgaggaacaggctggtcataagactgtatagaacgtgcatcttccatcctattgaggtgactcctagacaatgggaaaaatgccttcactcgacttgctcattaaatgtgaccgtagctgctaatcttttggcgctgtctcgaactttaattagatgtgctcttctcttgaaggttggaactacagtatccagagaccatagaatcacagagttgaaaacaaaatcttggaaatcattgaatccacttatcagatgagaaaaaaaaaataagcccatggagatagccattttaaaacatatcattctatttagcctccaatgtaaaacaatgagttactatgtttcaataatgttgatgttaagaaattatttgatagcttcctcacttggtctcctatattcctccaaggttactagttaggaagactgtcattcaaatttggagactacataagaagcagaaaaagcatataaagaggcacatgaaattggaacttttctggtaaaatcttctttcttaaactctcctcaaataagctgttggtggcaggaggtgaaagacagcctccaccctttagcacagtccgtacttgtcagcatttcccaggaagggtgatgtctggaaatgatagagattgtggaagcacattgcattatgggtcaagaatgcgaaggtcaaggagtggagtcttcctttacgaagtagtgttaactgcttggcgtggcattgttgtaaacagaagccaccaggaaggatcatccttaggagggaacctgtagatatgactgaaaacaagagagatccagttttaccactctggaaacataggtaatagaaagcccaaaaggtaccttatcacttgtttgttcctttctgtacaaaaggacttaaatcctttctgagcaagaaagatatttgagaatccaattttgttttaaacttgagcttagcattttggaactattccaaagaccacagaattcacagtcattagcataccacagcagactcttttcaaatattgcaaaccagaacagtctgcttgaaaacctggaaatacgacctagtgggttcaacttgactttttttatttctaacccttacccctaggcaattattgataactcattctggtacctggtatgtatatggactttgttagaagaatttgacaactttctaatcatctgttttttttcttttgcttgatagacatacatttagtagaactttactggattgtattgattataaaccacatttcagttcatatcagtccattttgctgcacaataaacaaccaaaaaaatttaattcagtggctaataacaacaatattgatttattcatggagctgcagtttggtagggtttggccaatcatggctggaaatggtttagctatgcttatctctaggccgtcggttctgttcgggtctataccacatattttcttctgagactcaagctgaagggacatcagctactcggggtatgacagagtagcacaaggcaatgacagaagcacaaacaacacttttcaaaatctctcctcttgtcacatttgtttatagcccattagacaaaacatgtcttgtggccaagcccaaagtcaaggggtaggaaaatactttccacctatgtgaggccatggctggagcgtgaatgtatgatactactagggatgtgaaaggattgaggccaataattcaatcttctattggagacaagctcaacgagttagttaaaatggaaggctaatatttactaactttgcaacccaaggaagagaaagcaggatctctctgacgatgacggaatttcataccctcatctttgaagttatactaaagcttaggaacaaccgtcagataggactgaattgctcccccttccagattcagcatgtgaagtatgcagcatcttattatagcagtagccaaaacagccgttttcttcaatttgggaatacaatgtaggtgtgttaattttcaattaagagttctaaacttattatctgcttggtagctcttccatgtgacagtcattccatctgactcttcatgttggcttttgaactaaattttaaaggaaccgccaaaatttaagggccatgtactttttataacctgtttgtggtctgggtaagaaaataaaaattatacaactgttctttttgaccagccacaagcatgtaatgaaaatgactgttttggctagcagatgtattagaagctttcaaggtgtttaaaaaaaaaaaaaaaaactggagaaaggagccagtgaattgacctcaaacaaaacaagaacaaataaacaaaacacttgtctgcacttccaaggaagggtgatatctagaaaagatagagatgatggaagcaccttgcattatgggtcacaaacgtgaaggtcaaggagtggcgtcttcctttatgaagtagtattaactgcttggcagggcattgttgtaaaaagaatccaccagaagtgaaacaagcagcactaaaagttaaaagatttatgtgtaaacctcatctaaggcaacagaagccatttctataaaatagtataggaccttttattatatatggtcctagagtatattaaaataagtctgtttgggtccatttgcagctcatttgaagatttttataggaaaaacatcctcaaaaatatcatactacagtgccttgatgcttttttctttttataaggtactgccagcccaaatagtaagaaaccgatatgatttttgtccatgtgaggtgtttaattgcttcccaaaatatggttattgtgtagatgtcactaacgaaatatataaagagcagtatttgggaaaatttattttaataccacctttttccttttttaccctaaaagtatttatttttttcgtagcatacactctgtgtctcagtatcattgtttttcataaaaacataaattcttaacagaaaatttcctgcaagctcccctaagcttgaagagacaaaggagatttgtaatgtagctcagccccaatcagggtaaaagaatgcagggctgactttatacttataactcagaaaaaggttatgcttcccgtctcttcacagagctagtctcttaattgattccgaactaggaacatgtacaagtggcccacgatctggaacagactggcggataatggaatattgagaccttgtctatggtcagccatattaacactggataagtctgataacactgtgattacatatgtatcaatatagtatgctgttaatatattaaaaacttatttacaacatgattattggacaactgttacagtacagccacatcaatcctatatcaagttagaccatgtcaactggttttgtgttgagacacctgtgtatggacatagtctgaacttttcatagtttgtgctaaatgatagcaatcaacatcggtatggcacttacagtttactgataactttcatgcccattaacatagtaccgcaataactctgtgaagtgctgaatttgtgtcctgtttcatgattgtatttgtgttgatatctcagtcagtcagagtcccaacaagaaacagatggcacattcagattagggtaagttgaggagtctttatttacaaggcactacatactcaggattgggcagggtgtagggaaatctcacaagatagcacaagactctaggactagcagcagcagagctgtcacctctcctagacctgaagccgttgttggggagagaggtttctcagagcccagaaaaaaagaaaaaaaaaaaaaacatcatgcagattttaatgccttgggaggagcagtggctttctcttaaggacagaatttgcctcgaaatgatactcagggaaaaagagatgaagggaatcaatactctgacccaagactctcccttctctgcagtggtttgctagtcctctccttggtcaaacccaaacagaaaaccatagggcataggagtctaatgatgtaatccaagtcagccccctggaaggtggaaaaagaagggaaaatggatctggatctggagggataccaaaaaaaaaaaaaaaaaaaaaaaaccatagttggcatgcttgtttattgatattttcttgcatgatataagaatccagataaatatagtaagaggtctattttactaacaattttaggcacctaataataatactccttctttgaatgtataacctctagaattggttcagaaatgtaactgtgccgttacaatttctattagtattcaacagtagattcatatccattcatctatgactggagtatctgccatttgctggttagttactgtgtaaggtactttgtaaggtatagaaatacacttggggtgcgatggctcatgcctgtaatcccaaggatttgggaagctgaggcaggcagatcacttgagtccaggagtttgagatcagcctgggcaacatggtgaaaccccatctctacaaaaaatgcaaaaagagtacctgcgcatggtggcatgtgcctgtagtcccagctactcgggagcctgaggtagaaggatcacgtgaacccaggaagtcgaggctgcagtgagccataatggcacaactgcactccagcctggatgacagagtgagaccctatcaaaaaaaaataagaaataaatttgagctcagtgacctacattctagtgcagaaaaaaatgaccatagttgattatgagattttaaagcaataaaccacatgagacatactaatgagctcataagatcattcagaaattgtttattatgaacacatagtactttcagtgtggcattaaacagagatcactgtccttaaacaagttaaaagcagaatcaaatcatctgcaaattaacacaccactaaactttaagcttcttgagtgattctgtaatttttaaaatgtcttcagcatttcagtgtcaagatagtgcaaactcagtaaaagcttgtggaattgcattaaacaaaaccaaaataaatagattttattaaaactatatacaattgtctttctaatcatatcctctccatgaatagggaagaaataattttaggaatttaaatatcttctatcttaatagttcctcttatttccctcttaagcaatgttcactccttcaaaaatatttattgagcatctaatatgtacttaacactgtgccaggtgctgtgaagaatgccaaggaaatagaatgaacttctaattctttggagttccaattaaataacctaaagttaaattggtttcggagagaacattatgccttcgagactgtaggcttctcttgattagaaagtcttaaacattttaagtaactaaacagattaaggagaattcaaggatgcctctcactagtaaatttggattagtctggcaaacttcagaccttaaatgcaagatttttaataattaaaagaagagagaaaatgataattacatttctagagtctatgtttaccattcagccttcttaatcatttcctaagtatatctggtgatcaggattttataactccagaaaatctttctatacatcgcataaatctcttcttttaaaaagctcttcaattttgtattttgttaaaacttaaaagcctccatgaaaaatgagacaaaagtcagtgagaggctgtagcaataaaaatcagatgtgattttcttttgaataacatctgtttttacagtcctttcatgttaaactttataagaatttattataaacagctttattgacagttcaatcctatttctaaaaggatttattttcccccaatggtaagagttttcttttcttaaacctaactagttgcagatatttcagatactacatttctcattgtgtaaggtaaagtttctgaccacctgaatatgacttgtagctcctgagaacaatttgtttagtaccgatatcatgcagtgacattggtacaaaggaattttctttatttcactgtactgttttcagttttattctatagttgttaaataagaccattaaatatttttattagtcttatttcctgtttaactaggtgggtttttgatctctgttcagtaaagcattgtgctcttcagagcaagcaattgaaaagcaaatagtgagtatttctactgtaaaagtttaacattaaaagatatacacacagccaggcaaggtggctcacgactgtaatcccagcaatttgggaggctaaggcaggagaatcgcttgagcccaggagttcgagaccagtctgggaaccatagcaagactccgtctctaccaaaaaaattttttaaaaaatagttggatgtggtggaacacctctgtaatcccagctactcaggacgctgaggcaggaggattgcttgagcctgggaggtcaaggctgcaaggctgcagggagctgtgactatgctactgtactccagtctaggtgacagaatgagaccctctctctctcaattaaaaaaaaaaaaacaagatacacacacatatatttgcgtaggtaactctaatttcatttcaagtatgttatgtaacaaccatttgtgtagtgcttgtaacagtcaatatgtaaatactgactcatcttctttgacaattctacctagatacttattagagtcccccttagtcattgaaaggaaggttaaaatcaaaagacgttgtttgccaaagtaatgaaagaaaacttataaacacaatgtatcatgtctggggctgaactaaaacccttctgatatgtggtattaacagatcatctttcatgacagtaccagttattagaaataaaatgattggagttattattaatactaacaatagtggtattcttaaaatgacttccttatttatcttcacctttatacattctactactgcttcaagacccatcttgaattcttcttccacagaacattctgcattaatttcagccaacattgatttctctttttaaaatttgtcttgcacagtgaattagaaaaccaggaattggaaaaccagaaaagcttattaagtaagaagcagagaggagagagtttcaacaaagggccattctaaagtggtctactgcggacaccatactgattatagttggtgattaaatcttatctttccaactgattataaactcctccagggcatactcttatattccacaagatgcttatctgggtgcagagcatgcatgcagttggtatttgctgatttatcaactaactaaatcttaacatattattattaacaatttaaaataaagttaaatgtatcactctccacccctcaaagccatttctgttctttgttttcatagcaccattattatttcctgcatagtattttttaaaaaccgtatttttaaaatttatatatttgtttatttgggtatacttcactagattgtaagcgtcacaaaagcagaactattataaccccagccactaacacaatgcctaacaaatagtaggttctcaatatttgttgaatgaatgacctacagatattacttcattatgaaagattttgctaagttgttttacatctattttatccaaaactaaagttcttgaggcaaagcctagaatatcttctatgttctcacaatgctctgaatcagtgcttctcttaatatgcatagcaattgcctggagagcttgttaaaacatagattacttagccccaaccccagagatgctgattcagtaggtcccaggtgatgctgctgctgtcagtctctggcgcacactttgagtagtagggctctaggatgttatatgtacagacacatgctgaatagtgggctatgtgcttacttgctggctaaataataaatgttctcactgagtcatagaactttgaaatttgcaaggacttttgctattatctagtctatggatagcaaataacctgataccgtgctatagtgcttgactgcatttaacctgcagaatcctcatgagcagcccagcaccatcactccaagtgaaactactctcttcttgaggttgtccaattctatcaattaaagatgaaaaccaggttctgagagttgaaatctctggacttcaaaggtccaacagcccaggtcttctcaattctcgttagtgtttcagcagctgaatacaaatttattaagctgtatcagagtagtatctgtcaaattggagtgtccataatatgcttaaacagagaactccattccaataacatgaactttccttatgctttattcatcatcgcttgaaattttgaattttgcccaaagaagtttataccagtacatgttaaattacatcatagccttctttgtataaatcttagagtagtttactgaagtacatcgcaaagttttgttgtttcttaggtgattttaattatgtatgtttactttcagtaatgcatcttttctccttcatcaatattatgttatgctagctgtaagtacaaaataattgagaacaaattatgacaaattgaaccaagccacaaaaaaaggagaaaccaaatacttttgtgatttgagcttttttcagtccttgaaactttaagaatatctgtctttattaacttttgctttttgctgatggtttctctcattttattatagcttatagcattgtaaattaatttaacatgaaaggataaaaacgttgcttttgaaatgtttctcattaaattatgaaaaaatattacactaaataaaagaaaggaatgcctctggtaccagcttctgtttgctcaattattgcagtacccaaagtgaattattacacagttaactcagaggcaatattattgtcattatattataaaatagatgagttgcaatcttcaaaaaaaaaaaaacagcataggtcctttgaaagtgaaataccttttttccttgtgcttcatttaaatatatactgaccccagttttgtttttgtttttcctttttagagttcttgctaatgatgggcccaaagttatattaagaactgcaaagtaaatttcaaccaattactttattcaggggagtcattaaattgaggtacctctgaaattttggaaggaatgtactgccaattagccgaaagcactactcaatgtcctttctatggttataatctctctagtgtatttttaattgaagacaacctctatagaggaggtgagaagttgctatttattggtacttgttaggatggaatcaagggtgtggaagatattcatctatttctctctccagctcccccacacaaaaagaatggtgcttaatccatctgaagcatttggggagcgagggtaaagatgtaatatttaccatgagccgaaacagatcttcagaagtggaaaatggaagcatattgaagtccctcaactaaacagactttcttccatatggaattcaatgcattaatgttttcaaattctatagcttcaaattcttaatattttcaaattatgtgagcttatgtcaaaacatttaagtgagcttttaacaatgaggcaaatatttgaatcatttgtctacataacaaatactactataaagcatattaaatgttataaaaatcctaatatactaatgtaagctattataaagtacaaataattaaacaatatttatatgatcaatgttttataatacgataaacacattaaataattaaaaactcttccaccgtgcaaaaatgactaaataaattgttaatttctaaggctttttgagattactgtgaaagggggtatagtttcaggaaaggtgaaacttcccttcaatgtgtaaaccattaaagaacataataacctactgagtgtgggtctcaatgatatgccctggaaagtatgggcaactactccacacccaattttgtctttatatgataaggcacagcaaataattataatgcaatggataaatggtaaatcccaccaaagattaaccaatcagagcaggatgaaaattctgagtttggaaatctattggaagatttacagattagattaaagtgcccagtaaccaaactatcaaaattatatggcttcagttaattaatgatttccaaggtttttagtatactgtattacaaaacacattaagcatcttaagcattcaaacaacatttttttgatgattcagaaagcatcacaaattgttatatcagctgataataacttaggtacatatcaattaaacttgtattatagacacgcagaattcttcagaccagaagtcgaaagggcttctctagtttgtttatgctaagttgtttagagatgacataactctgagctaatttgtctattgcaatggttctcaaaatggggggcgggggatatttttacctccaccaagtggacatttagcaatatctggaggcatttttaattattattactggattggagatacaactgaagtctagtgggtagaggccagatatggtataaaatatcctacaatgcataggatagccctccacaaggaattatttaggccaaaatgtcagtagtataaaaattgagaaatgctagtctaatatagtgtttactcacctttcctgaaactatgtcccctttcacagtaatctcaaaaagctttagaaattaaaaaatcgtttagtcatttttgcatggtggaagagcttttaattatttagtgtgttttatcttatgaaatgttgataatataaatattgtttaattatttgaactttataagagcttatattagtatattaattaggattttatttaacatttaatatgctttacaataatattcattatatagacaaacgttttatttttttcactttaacaatgatttttaactctaattacataagaaaaagtatgagttaacaattttttaaattacatgcttggtttgagggccaaatacacatgaaaatgtggactaaaatttaaaatcaaataaaatctataaagtcgaggaaaaagctacttttatgacgaggcatggggaattcttcatagtttttgggttttatcagaagttagctattttttttctttttgctctgtaaacaatcagataagagaggctcaaatgacattttcaagtacatcttaacaaaatacactttgagcatcaattgagtaaagtttcattcttttgaaactttggttttcacaagatttcctgagagttttattttattggtgttctgtgggacttgggcatcataattcttacaaactactcagctcaatctaatgtgcagcgaagctctgggaacttttgttttgtctagtatccagttggaagattctatagctacagagcttgggtttaaaccccctccaagtctttaccagctacctttatgaccctggcaaattacttaaactgtgtgccaccattttctcctctgtaatacggaggcaataaaaatttccacttttagattttctatatgcggtttacaaattgacttactctgaagatcatctggagtaaaatctggagaaatatgatcccttataacttcttcaaccctttatatatttcaacatgagtaaccaatgctctaaatatggatataaattataagaataaaaaatctaggactattataatggtctaaactctcttcatagctaaaagtgttgagtaattaaaccagttgagcagctaaatcatgtacacacttctttgatccctcccacgatcatgtatttggcattgtaatgaaaagatatgtttattttcgagaatagacataactacctttaataatatgatcacccagaaatttttacaaacccctggaaaatttcatgaatatcaggctgtgctcataaaaccttagagatgagatcacaatagactgggtcaacatatagtaatgagcaggattaataaaacctcagatgggcatttacaaatgagtcaaaaccatgagtataattaaataattgtagcaaaaaaagagccttgggtaatcctttcagcaaacgtaatcgaagtgattgcatttagaagacaaatatttaatttggtgactagaaggtcttttattattccattatgtctttgtgtgtgtgtgtgtgtgagacacttttcaaggtcaatttttacttataaattgtctctaattaaaaattgacttggttattaaatcattgaaaattggccatcatcaaattcctcattaaaatatttctatgtgccatatatatatatatatatatatagaatatatatgtagaatatatgtatacatttatttttactttttttttactgtgcctactagagaaatttaaactacatatatgtagaatatatgtatgttttaactagacatactgttaagtacactatacctaatatttggcaatattaataccatctcattgagaaacctggaatatatgcacattttggatgtctattatatgttgggcactggactagtcattgataatacagagattagtaagactcaggttgacttcagccatgttgtcaggaagcacacactctagtttgggacagcgaggagaaattcaataagagaaatatatataaggcataatgctctaggagaatatgcagtggataactgcccaataggaccaggcaaggctttttagaggaggaggtggcatttgagtcaagtgttaaaggctgaatggaaattcactggttgagataaactccttaggaggaactactttaatagaacttgccgttagtcctgaaataaatggtgtgcaaaatcattaccatctgtcaattcactcagtctactttgctcttaacttcagaaaaaaatcagaaatacaattaaaacatttgagcctattttactgtcttttaaaatgagttaattcaaagaggaaattaaatataatgagagagaatctcccccgaggattgggggctggggaaatgctattgattctttgcttgtgtttattttctctcaaaaatacattatgcataaacttgatgatcaaaaattcagattattacatttctaaattggcaatgcaatttattgcatcatacatcaatcacaaaaatgctcatcttgctgactttcataaacttctaaatgaacaaaaatgcaaaaatagtttatactatattacactatagtagatttgttaaactaaaccagaacaatggtccatgaaaaataggcctctgactccaaacgctcacaccacaggatctctctgagatttttgtgtcatttcaagtcagagaaaattgtctaataaattgttggcttgtaacaatgaaaactaagatatctgtggggctattcttgttctcttcattttactacagcagctctgcccagtagaaataaaatgtgagccacatatgtaatttaaatttctctagtaggcacactgaaaaaataaaaataaagaagtgaaattaatttcaacagtatgttgtatataacccaatatacccaaaacattgtcattttaacatgtaattgttacaaaagttattaattagattttttccgttaagtatttaaaatctggtaagttttactcttacagcgcaactcagttcagatcagccacatttcaagtgctcagtagccatatgtgtctagtggttaccatattagaaagtagtttgagagatccacattaaaccaaaaggaaaagaacttccggcccttcactgatgagtcactcttcactgctaaccttggaagcattcccaaatgtagtctacagagtttaaatagtctatcttaacatctctcagggcttcagtcttaatgccatagtatttttaaagaatggtggatattcttttttacagaacactctgtaagagcaattagaagtttatgatgcacgtaatgcaaaatacaggtcatttcccaagcctattttaaaagcgcaaaaactgtagtcatttatcacccctgagaatgttgtcttaaatgtcttggtttggatattggtgatgtgagaactttgtgataagaaagtagtctttaagaataagatatcagactaaaattcatatctagaatgaaagtcttgtttttaatggaagattaagagcaagtctgattcagatcatgcatggggtacactagtctaggaaaacactagtctgaaaatatactaaaagttacttcgcaacttaacaagaaaatgtcttgtgggtgatgtcgttcttgatttttaggcaaacctacctacctttgcaaagcagctgggacctttttgcattggaagaatcatttggagcacaaacaaaattagattatcaacactttggaaaacaactacgaatgagcaatcagaaacctgaccttaagattacttgtgaattgtgaatcagcaaaataaactcgattgttcattgctaagtgtatttcaattatcaagggccttctagattataagtagtcttttttttttacttagtttacaattaagatgtgtggtatttgaaatacatttgccacagggagaaatataaattataattaatttcctaggctaattcaatttatgacatacctatatacattatctgtcatctataatttttcccttattgtttacttcccactggaagaatgaaaatggaatattattacatggcacatggcttgatacttttacaaactctgacaattatgtatttattttgggaggcattgagtttatttgttttatttatataaatttatgaggtacaagtataattttgttacatgcatagattgtgtaatggtcacgtcaggccttttagggtatccatcaccttaataagatgcattgtacccattaagtaatttctcactctcataaaattctaattatgtgaatttaatttaatctatttaatgtgttttaggcaaatatagccggtactataaacagttgattttaagatatcattgcttacattgagactaagtaaaacaaaatgggtcaataaatgtcaatctagataacaatgtcaactaaataagaggtcaaacatggcagtatttttgaaggtgatctgtgaaagtgattatagcgtttacactcatggaaaatgccttcagagtttcaactaagaatgccaacagctcattcctttatcctgatgcatattgtcttccttctcacccccagttccttcttcccctaacccctacccgctttcctttgctgattttgacagaaataggacccccaataagtcagggagatagcaggaaatgggataggatagaacccggaatgatagaatagctgagcctgaaggcatgaagaaaggctcctcctgacatctaaatggagacctaagagatgggttggtcaggtagggggaaggaaacatgaggagtattctctaagccaggcaacatactgtgcacaagtctgaagtcatgggaaagtgattttgagaggattgctgcttggtaaacctagagtttgaattgggagagatgaagctagaaagttagtaagggtcagattttttttttttttacttgcatgacaatggtaaaaaccactaaaggttctgtgttaagcagaggagtgacttcatttaaaaaggtaaattggattgaaatgaagggcataaactgaggcaaaaatatccttcgttaagttattgaagcccagttgaacacactggtggcttaaactggagtattggtataagtgggggaaagaggttaatagattccaagttgaaaaaaaaaaaaaaaaacatagactttgctatctagtaatggattaatatacaaaaggaaaaagtaaagtttctactttttggacagctagaaaccttcaccgaagtagggaacccaagacttagattatgttgggaggggcagggtattttagttgcacagggatttgctttacagaaatgactgaatgacaatatagagagatcaattccattaaaagaagtttgattactcacagttctcaagggaagagtacatactacgccatgcaaagccatgcaggaaaaaagttccagagtcggtcagcaggcagaaaaggaaagcacagcccaaaccctttattgtggtttccaaggaaaagaaatgagtgaggtagaataggcaagtctgagcaagtttaggactggatagttcaaataatttccaaaatttcctggctgtaaaagtggtctctggttgtctggtaccaagccctagggtgaggggaaaaagttagggtgggggaaatattggtttggtgtaacaacagttagatgaagaaggtagttggggatacggactttggattagttggtttgtataacgaaaagcaatccaacaaatccacaagggagcaagtttacaagttatttgctatctttaggaattagctagccctgggaggggcagtctctccctggccttccaaggacctcaagatgttcaagcatccataaaatatggaaattttttaaaaacattataaatacacagagtaaacgctgggcatgatataggacagtggttctcaaactttagctccactggaatctcctggaaaacttgttaatatgcagatgaccgttttacccttaagcttctaattggggaggtctggggagggcacagataatttgcatttctacaaagttcttccatgattttgatgccgctggtgagggaccaggctttgagaacactgatttaggacgtgtcctgtttagggaatatccaaaaggcggacaagttcagggaatattcttgggcagttggctgtgtgagtctgaaattcaggatagaatattaagctgaaataaagatttgggagcttatctacagtcaaatgataattgaaatactgagagtacggggggagagaggtccatgtaccaagaaaagtgaaaatgactaatcccaagcctcgctgaccattgagaatggagctaagtgagaggagttaacaaagctgacccagaaaaagtcataagggccttaggaggccaaggaaaaaaaatacattcactgccaacgagaggcacttacgaatggcttgactggctttgccagcatgcatgaactgcttcataattatttgtattgattacagtaacagatacatattttaacaagcaacttaagtaatacaactgatttttaattatcttgtttaaattgataaaggttgtatatattcatggtgtacaacatgatgttttgatatacccatacattgtggaatggctaaatcaagccaattatcgtatgcattacctcacatacactttatttgtggtgagaacacttagagtatactcttagcaagtatcaagtatataatacattgctgttaactatagtatccatgttgtacaataggtctcttgaacatactcctcctgtctaattgaaattgtctttccttcgaacaactgatttttttaaataaaaaacttaatacctgtaagttagaattcttaatggtcaccttaggagcctatacaattattcctacgttgttgttactattctgtgtctttttcttttttaacatctttaaaggtatcaaatttttatattttgaaagtagaatttattttttgtcagtctaaaatatttttatgttgaacaaaatgcatgaatggtaaacctagatgcaatcaatttttcaaataaaaaaagtagatacccatgaacatttcttttgtaattgcaaactgtcttgaaaggcagtttcaaaaagagtttagttcctaaattgtaccattactcactgcgttaaaatgcaacattcatttgagcgtataaccttttgatcaatttgtttttgatgtcttgttccctgagagttgtctcaaatagatacatataaatatacacatatctcagattggctctgagaaatgtcttgattcaaacgttcttgattctaagattcatggtacataggaactgtatggtgacaaccttgtcagcctatctttagagtagctttggattctattcagaacatttcccaaagctattctgctatcaagaatataaacaggaatagtcaagggaagctttttaaagggcaacattttcatgtaggcatttttctcacattgaaaactagtttactaaatgcagtgtattaccttctcattacaagaagtctttcacattagtataaatgcatatggcagttgtgccagaaataaattgcctctcaaactagcacatggaaagaagaattctgagatttagcacatatgtagcttttaaatagtatactctgtttcaaacattatgtgttagtccacgttctcttcagccattttcagttgcatttttactttatattcctttgtatatttatctttgctaatcattgtcctgagattcctttagctcttgaattctacgtttttaattaatagaaaactttctttttatttttcccccgacatagttgttttctagaaagaaacagttataggttataaatccaacactttagggccgacttgaacatgcatcaaagctactagaggacttgtagaaatacagattgaatggtcccatgcctagagttttacattcagttacagatagggtaggacctgagaattcacattgctcacaaatttccagttgattttgatggcattggtctagagaccaaaccctgagaaccattaaaaaacaaacaaacaaaaacaaacaaaccaaaaaaaaaactatatacagagattttcttcattggcttttgccactgaagacatttagatgaagagactccacaaagtgtaatcatttagttatgagaggggcctgataatttgcatttctatcaaattcccaggggatactattgttgctgattgagaaccacacttggtgaaacactaattaaaataccattaaaaagcaaaaacaatttaggccagcaaaacctcctaaagaatgaggcctaaagacttattttgttttatttttgccagaagcttcttatgggcaaaattatcaccaacagagctgaggttcaaacttgtgttcatagcaagcaaaagggataatttggaaaaaaagctgaggttagctttgtggttggtttgggagtgggaatgagtagggaggaagaaatttaaaaaaaaaaaaaaaaggaagaagccaaatattaaattgttcacagggcgaaaaaagagaaaaggagtaactagaaatatcttagactggttcggcaagtcgggtccctcgcagctaacagtggtcccaccctctggagtttatatgtttacattctttttttttttttttttttttttgagacagggtctcactctgttgcctaggctggagtgcaatggtatgatcacagctcactgcaacctccacctcctgggctcgggtgatccccccaacctcagcctcccaagtagcagagactacaggcaagtgccaccatgtccagctaattttttgtatttttttgcagagatggggtttcaccagttgcctaggctggtctcaatctcctaggctcaagtgatctgcccacctcagcctcccaaagtgctgggattacaggtgtgagccaccgcgcctcattggagtttgcattctagttgggaaaatagccaataaatttgtgacttattttcctttaaaaaaaaaacttattctggctattgtgtgactataggatatggaaggtgcaagagtatgaggctaacaccctgttctaaattccgtctcctctgagccttgttctgtcaagaatctcctccttctatactttttaagtcaccttcctactgatcctttgctgtcagcttaccactctggtacccttcattttaacaaacaaacaattgtccaagcttaccggtgctgctccttcacccctccacctgtacctagtgtcaattctctccctcttctgatggccaaactttgtgaaactgtagcacagctccatatgtgttcctgcaaaggacatgatctcattcctttttatggctgcagagtattccacagtgtatatgtaccacattttctttatccagtctatcactgatgggcatttgggttgattccatgtctttgctattgtgaatagtgctgcagtgaacatacgtgtgcatgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccaaacaccacatgttctcactcacaggtgggaattgaacaatgagaacacatggacacaggaaggggaacatcacacaccagggcctgttgtggggtcgggggaggggggagggatagcatttggagatacacctaatgttaactgacgagttactgggtgcagcacaccaacatggcacatgtatacatatgtaactaaccttcacgttgtgcatatggaccctaaaacttaaagtataataataaaatatatatatatatatctctaggtgatgggttaataggtgcagcaaaccaccatggcacatgtttacctatgtaacaaacctgcacatcctgcacatgtaccacggaacttaaaataaaaattaatcatagaactttaaaaaaagaaaagaaaatgtagcagagctgcctagctcaccttctttacccacagctcacttttcagtccatttatctggctattactcctaccgtgccaggcaaactgctctcactaagaaaatcaatagcctaccccctgccaaattgcctgactcagcttctccttgtaattttctcctttagttctctaacaccctcttccccaggttttcacctgacctgtctccataggacatttgagtctctttcctgatgattcatcctcagcctcttccataataagtatggctgctccccagatcctaccctcagcacttcttcactttccatgccacatctcttctgtgatctcatcttcatccacggctctaattagtatctataagcagatgactctcaaagcatatgctgcctatgtacccctcttggccattctacattgacatctgcaactccccagtgaacttctatatttagaccacaggactggtacctgctgataagcacaggtagggtgtactgagtagtgttttctctatttggttgggcttttgctaaagcagttgtcaaatattttgagtcttactcatggccacagacattttaacattagcatgtcccaaactgaaatcccctactgcctctattctctatttcagaagatggcaccaccatctacccaattatttaagctagaaacttctgattctggtgagacttctctcttttatgcatatgtctacactgacacaaaagactgcaaattttacctcctaagtctgtcttaaagcagatttttctctatgattctctatggtttcaggcccttatcactgtgaagtcaagcatacctgattcgaatcttgtcaccgttggcaaatttttaaatctcttctagcctcagtttcctcataaagttttctgtttcttagggtgactaaagggcttaaatgagattaccatacagagagtaaggtacataaaatgcaattaataaagaatagtcactataactgctgatgatgatgctattactattcgtatcctagaaaactccggtaacttgttcactggtctttctgcatctagcatcacttcctcagccagagttatcttctgacatgaaggctgatgccgtcacccccatactcatgtttgaaattcttcaatacctttaagataaattcccacctccttggtgtagcatgcaaggtcacacatgacataatctctccaaggccccatttcttccactctccttgagtgatatatgtggcagaaaatttaaggctgcctggatattatccaccttacgtcccaatacttccatctgccgcaaagaccttctacccaacttcccatcctcaacgaattcttattctttctttaaaaataacctcaaacttcagactagacctctggtccatagggcattacaaatctctcagtaagttgtacaggatgaacacgccccctaaaactttgtttcagatatttcaatttttattttattttattattattatactttaagttttagggtacatgtgcacaatgtgcaggttagttacatatgtatacatgtgccagatatttcagtgttaaaggtttaataatcacatttacagaaaaggaattagctacaaaatggtggcactggtatacaagtatgtaaagatacagtgcttacaatttaggattattgttgtcgatgttttaatattaaaatggctaatcatacagcaaagtcgaaagaaatttacggtcaacatctgtatacccagcacctatactttgccattgaaattttactatacttgatttattacatattcatctatccatccctctttctgtgatcaatttttaatattctaatactcttacccttaaataataagttatcttttcaaaaaataatgtgtttttacatagatgaagcaaaataaacttgcccttgataaaacaatatgcactgtagtgccttctaattcagtgcattgaagtatccattaacaatataaccagagaatataaaacatgtttattaatattccactgtacctgattagatatagaccattaggaagagttattataattaagaatctaggtttgtcaatatagaaaaaaacctgtgttttttatcccactggaatgtcttgtgaggaatattgttcccctttttctaaaatttaactttgacctttattttgttaatgcaccatgggttaagccacactacgacatgtgctaaatagacctggaagttttcaaactaggtttttaaagtgtatttgacattaaatcttcataacaccttattgattaatttaaatccattaccatggtaaggaaaattcgcagacaggcaggtgaaaattaaaatagaaacaaaacaacatggtaagcaatccttccccccaagccaatcagcatgtagtcagtgtgtccttttaaattagcaaggcgcagcttcccataaagtcccagcttgattttatatgctgcaatagtattgctaaaataaaggagaaggcaacttttctctataatttttttctagaagttttcacgcagcttagtatactgcaatgaccacattactcagttccagaattagcagcattccattgtgaatgacttaattcacattgtgattactcatttaacaacattcttgagggtttacaatgtgcaaagcattacattaagtcgtgtgtggcagaggttctcaaatgcagatgatctgtgaagaagatttcctcaataagcagagaaatgagaactataaggacagaaagagagagagagagaaagagaaattatttaagcttgtagcttgtcatcctcctttcttaggacagcctaccatttaggctgagactatgtctttctgattatttcttgtggttgaaataccccttccttaacaatatgatggtaacagtggatggtaaatcttgttttgttttaatagtttacctggcaaaagtatcattttatgtctgtatcagttatatataatagtatatcagtccattaccaaaccgcctcaaaactcagtagcttaaaacagtaggtacttcttgagttcactaatttgtgggctgatggtttacattgggtagtttatctgctctgactgggctcccttgggaatctggagggtagctgagagcttaagtgtctgaaagtggctgggtcaacacagctctatcgctcacatcttgaacatccctccagcaggctaaccagcccgagcaagtcctttttgtgaaggctgaggtgaagagtggaagtgcaaacatgtaaacaatttgttgagcccctgcttccattaagcctgcaatatccgattggctaaagcaagttttatttccccctgtggtaggcagaatcatgggcccctcgaagatgttaatccccagaacctgtgaatatgctgtgctccctggcagtagggaattaatattccagacggaattaaggttgctaagcaggtgactttgagatggggagattttatggactattcagatgggcctaatctaaccacagggttcatataagtgaaaatggaagcaggagagtgggagtcagagagatgaagatagcccctgctggctttgaagatagagaaaggggccattagccaaacaatgttggtagcatctaatgctggaaaaggcagggaaatagattgtcctctaagcttcttcagaaggagtatagccctgccaacactttcattttaatccatgaaacccatttcaaacttctgacttccaaaactataagataatcaatttgtgttgttttaggccagtaagtttatggaaaattgtcacagaagcaataggaaacaaatatacgctccattgttcaatcttttgaataacacatatactattatttacttaatgtttttcttaaaatcagctcattttgttttctgcttttagccttaagtgataattcccacaaaactgtagtctgatgttgcagtgtttttttccttaatacagataaaactaaatgaatattaaaatttaaactataagctgtttatctgtgtaacatggtaaattggctccctaccactactgttcagcaaaccacattttgggaaacagcgatttaggtggttcaaaggagcaagtgattgtgcaagaacaagaatttattagagaaagaagcatttggccaatgggtagaattgttggcagacaaaggtagaagagaaagacaaattattcagtatggctctagcgaactctttgcacttttatcacacaatctgaagcttgctaatcttgacatgtcttaatgttgttggattgctcattaaactggctgaaatgttcacaaagactctcacctgtcttctggcttaagctgagatttatcacacttcttggaaacatcttctggtctccagatctccctcagctaagctatacagtcagtctgttctgtaagaaagcccaaacttctctgcagtgttcctcagtctttttgatatcatgatgaacagattaagttgatgtgttcatcatgatatcaggtaagctggccgaagactctaagctgcctaaccatcccagggctgagagggatcgatatctgaagtacctataacccaatcagggcatgtgccttagcatacccattggaaagccctgttttagagcctttatcagctgtgaacttattgaaggcaatgattttgtcctgttaatcattctattcataattttcaacaagatacgtggttgttgttaataataattgttggttgaaatgaagttaaataaatagcaattgacttttccaaggtgacgcattgcacagatttatttatcttccctttgctgccctggagtaccagttgtatctaccaataagcttcatttataggccagcctcatcttagtttctgaattagtctaagtggctctggtagcgcatcaaaaatcttgctttctgatggtctttgtaatttgaattctgtgacttacagacttggtattcaatatgtcaggaataaacctggggtgtgcccaaatggtttgaaaaatcccagccttcctgatttcctctcttctctttctcccctggccaccctaatagtctgatagtttttgttatttggatactcctaaactcttggcaatttttcttacatctgttctctacaggctgtcacaagtgagtggaggcaggatggcatgggctgcagtggaaagaccaagaaaataagttaaaagccctgggttccagtaaatgctctgtagtgggatttagggcaagtctcttaacttctctcagcatcaatctccgcatctgtgaaataagattaatgacacctgtcttgcctatacttcaaggttgttttgaggttcacatgcattttccaccccatatagcctataaatctctgatgcctacagataacctataatgttctccagtaagtttaatatttccaggattttaaaactcaatgactagcactgctctgatctaacataacatattgtgtcaatatgtgtgggagtctctctggttgatgttaatggaagtttgtatagtttacctaaaatagaataaagctataatattaatatatatcatcgatgtgttttaggtgatttttttcaatataaaggcaattttggttcaaaattaggtagaacatttaatttttactaatttacaaataaaatgataacatcaaaagggccccttcttttaaagataagttgtaactctcacattgatagtaatctgtcatttaggacagggaatccatgtagtttgaaaattcattggcatcatggagctaaaacagtggctttttaaacatgtcgatttcagttttctttgttttacaagtcaagtagtgatattactgggtacatatgaagcatactgattgaccaaaaaatagtaacaaattttgtaaacccttcacttaaccattattcacctttcccagccacataagaatcctttctctttgtccttagattaattgcctttctttaaccttttcaattctaagtccagacaagctgctgtggttctttaaaaggccacacaaaataagtattgtccagtgctaacactctgaaatgtgatattgtaattactaccaagtgaacattaatcactactagattagaatggaattacctgttatattcacattaatagcaaatgagctttccctgattgatgttgttataatgaatacaaaaggaattaatagtgatctggcactcaccaaaagaggggtagtcattaaggacatgccatcaaaaggcgggtaatactttacaaaaaacaagtattaattaaagtaatatcacaacgaatgcctattgaataacttatatccacattacaaagatattatatggttgcgattaatgtgattgcaatacattttgtaaaaattaataatgactaaccctttaaaatatttaggaagcagatatttgtttatatttgctaaatagctatgccaactctttagcttttgtgagtgacttctagcataggaacagtgatggataatatgaagcactatatataataactcatcggccgggcgcggtggctcacgcctgtaatcccagcactttgggaggccgaggcgggcggatcacgaggtcaggagatcgacaccatcctggctaacacggtgaaaccctgtctctactaaaaacacaaaaaattagccgggcgtggtggtgggcgcctgtagtcccactactcaggaggcagagcttgcagtgagccaagattgcaccactgcactccagcctgggtgacagagtgagactctgtcaaaaaaaaacaacctcatatatttttacttgaaaacatacattttgcctttaggatttttacttgttagaatatcctaaaggacctataattgtaaatgtaaaattgactaatttctgggttttaaaaaaaagtatttgaaagctgatctgctgtgaacattgaaccagatgttaagaaaaatgctagtaagaaatgagacttgggagcaaagaagcagaactaaacttttcatatatggtttctatggagtaattgagaacgtacatattaacagggatacaaagtcaggccctctcattcaagatgctttctgtctttaaaaaaaaaaaaaagtaatttttgaaattttctgtggcaacagtcccatagcagaaagcaaagagttttgaattaagtgatcagaatatcattcttataattttactacactgaacattatttagaaaattttgaatgatattaaaaccgctataaaacatacttgcctaccataagacttaggatttaagccagattaaaataaatatttatttagaaggatgtatgtaagaactggtgaaatataaatgaggtctgtatttgagttaatagtattgtgccaatgtcagtttcctagctttgatgataatgtactatgggtatttaaaatgctatcattgggagaagctgggtaaaaggtgcgtgagaagtctctgtactatatttgcaagttttgtggtcttaaaccatttcaaagtaaagttattttagaaaatatctaaatatatattttagaaagtattatctttttctctgtaactagtggctaattagctcagtctgaaagagtatgtagaggtggaactgctaaatatatttctgatctagacttacttgatgatgcttgaattagtaagtgaatgttatgtgccaacatatgctatgatacatataaatatataagattaaatgataggagctaattatttcttggcatgttgcagtgggtccatttaaaactgtttatgtaggaaactactgtaattataaaaatgagcacagcccaacagcccagtatattagttgaaatataaaaggcgttgtgtccaagatttgaaatgccttacaataagcttggcacttacttaccttcacacaaagcagacacattttattgtgattttagtgttccatattatatggtacagtaccaaaggaaaactctaaaatatgtactcaaaatcctgatgtgcccttctttccaaacaggtggcaccacaatgaatataacctttagagttaatatctgaggacaaacccagcagttacaccagcatgatttaggtcctgctgttacaattattattattgtatttatttcacaattaagttgcagagttgagctcgatatagttccagctgtggcttttttttcaactgtctcaatagttcatagatatggccaaatgttcaataatagtgaaagcttatagtccacatattatttctgtagcaccaattttatgtgaaaaaatgatttatctaaatctcagagaatttccataactagttttgttatacatctacaaaactaagttaaaagaacagagcagactttttaaatagctagattggccaaatccacctcattatcatcaagaagatactgaaacaccgtgtttatacaacaagaccaggcattgtaaaagaggaggaaaggtagagacaaaatttatttagccctcaggaatctttcattctgatagtgtaaatttgacaactttagagggacttattaacatgtatcttatatatcttgataccgaatatatattttgtgattgcattagagccatgaaatattacacaggtcatttgaacatagcattttcatagagaaggtgacatttgcaaaagattaggagaaaagtaactacgattagaaaatcgtagttttattttgtctcttgagaatgaattgatgttaattttatgtctgatttggccaaatacgatgtggaatttgctaaagactgaaaaaagaagagacatcaaatagagggttgcaagttaacagaccatgttataattaaatgagggaaaaaaaagtagagttgttaaactcccagagaagtcatttccccttggtttggtgcatttcactttggtggtgaagtaaatgaccatatgggcacttttctagctctgtccgcaggtagcactgggtatttgtggacaaattacctagcttttcatagcactagtttccttgttgatagacttcagaattctaaattccattttacatccttatttctatgtttaacttaaagataatcctttgcagccgggcacagtggctcacacctgtaatcccagcactttgggaggccgaggcaggcggatcacgaggtcaggagatcgagaccatcctggctaacatggtgaaaccccatctctactgaaaatacaaaaaatcagccgggtgttgtggtgggcgcctgtggtcccagctactcaggaggctgaggcaggaggatggcatgaatccgggaggtggagcttgcggtgagccgagatcgagtcactgcactccagcccgggcaacagagccagactctgcctcaaaaaaaaaaaaaaacaaaaaaaaaaacaaacagatcatcctttgcactggaattatcctgcagtggaggatagtaatgaaagtgtagactctgtttctgaacactagctatgtcactttcaaactgtgtgattttccttcaagtttctcaatcactccaggtctggtttctaaatagaggaataggagtagagattaatattgtgaagattaaatgagaaaacttatataaagcacttagtacggtgccctgcatattgtgaaggcttggtatgttgttagtagattcattttattatcattattaataatactgaaccctggctgttgggggaattggttctatcctcctgtctcatagtcaaaataggttaaagggccttctatctcttatttctggtggtgcattataattactaatagtaatgtgcttcatttgtatatgatcctttatagtttacatggcgctgttttatgtaatcttactaaaatttcaaaaataattttaaaaagccagaattcacaagaatgtgactcggagaagaagtagatgtttttctaagtagatctttcagtttaactgattcaaattttctcatgtttcatatacatgattatcatgtcttttgataaacagaatgttaaccagagtacaaccttgtatgaacatatttattcagcttagaaaagatccagaggtacaaaatctagatcccagtgtagaagttagcatacacagtacaatttctagtatgtccataaacaatatgttaaagtattagtttgagccatataggattgccaatatctgagtgttatagagctacaaaattagtaggaaattttgttgctttaacctaatcattaaattagaattgtgtgacttaaagttacaaatggtttccgaatattttgcagtaaaaaagtagtgaggaaaataaatataaatactaaactagacctgggaaatttaaggctataaagaattctagcttacagagagaggagtctttgtttgcaacctcccactagctaaatttaaattatcacaaatttcatcctctcctttacttaacccttgactcatgcaactagtcaaatgtctttttcttgctaattttttctttccatagatcacttatagggagttctggttaaaaatgatgtctctttaaccttcactaaaatgagaataggggaattaaaatgatatttaccacaaagagaaaaaaatctgggaggaaaaacaataaaataaaaaagataaaaaatttaggaatatgcagagaatggaggagttagcatatcttggaaacctgaattccaagtacttagaacttgggaagtcctagaaatgtgaagcaccagctactgcagaaggcagagatgaatgtgaggtaagatagtgagactgtgaagagaaatcattcagtaaaaaatgcattatcaagccaactgccactggtctagtggagtttaatcccactggggaaattctaaatggattgaagacatgtgtttaagagttagttattctttcaaaggggcaagggagctggggtatttatacacaaaatcctgctagtcattggtttaggactgcttccaacgggggaattattttcctagcatttctggcataccaccttggcaagaaaaattattttgtgtccagagtatgtctaaagccattagggaaaaaaaatgtggatcctcatagttgaaagccaggccagtctgcactaaagtggtaaggatgttttcttttagagatacaggtctaagaaagaaatctgaaggtggttacctcttatgcaagaatttaatttgatggattcaaggtgtgttggttaagagaaatggggaagggttgcttctcatgactgcggcacgattctactatactaaatttttcttttattaagcagcattgccttatgcaatgataggaaacatttgttatatgtgaaatcacttttatttttattttttaatctattcctattcttttcatttttttaacttttattttaggtttgtggggtacatgtgaaggtttattacataggcaaaccggtgtcacaggggtccgttttacattttatttcaccaccgaggtattaagccaactactcagtagttatcttttctgctcctctctctcctcccggcatctcttttaaaagaaaataatttttagcaattctttagaataagtcttggccacctaaaggtttccaggactctagttcagggagtatttatctaagtcagtagttcttaacctgatataatttcatccccagagaacatttgacagtatctcaagaaattcttggttgtcacattgggggcggggatactgctgtcatcaagtgggcagaggccagggatgctgctcaacatgttgtaatgcacaagacagccccccacaacaaagaattatttggtccaatatgtcagtagtgccaagtttcagacatcctgctctaaatcaggactgtgatgtgaattctctgcgatgatgaagatattttatatccgtgatgtgcagtactgtagcatatggctactgagcaattgaaatatagctagtgtgactgtacaccaggtgtgatgttccataccgaggaaagaagtagaaataagatatagtctttgaagtcagagctcacaatctagtagcggagacagatttttaaaaattacaatattttaaaaatattgcaatagaacatggtaatgttagaagattaataacatgctaaatttgaggcatcaggactcagacagacaattaaaaattctctgaggtgaatttccacccttagctcagaatactgtaatgtttaaaagctgttttctatacacacacacacacacacacacacacacacacacacacacccctttaaatcttttatcatgtaactcattgcttcttattttacccttttgtcagagaatacatataaaatactggaatctgatgggacattctactttatttaacaatgctattgagtttctcaaaatagtttcctaagaaagtctattaaagtattgattttttcataaaggataatacaaatggcatgagtctgtttaacattttaatcaagcttaaaattagtcttgcatttgaaacaaacttgcccagagaaattgttgagaaacttaagagaaaaacatcataaaaaattgatgggccagccaggctgtgagaatattaaaatccaaatctaaattatggttaaccattgtcacatctttctttgaagcttaagtaactcgatattccctgtaggatacccagtgattcaaagtgacacatatactgtcagctcattttccttcccagcatgctggtacaatttgtatccatagaaatatatggaaaaacctattagtcttgagtgccagaacctaccaaaaggaatctttgtcatctacaaataaattaatgataacataagataaacaatcctattaagttatactggcccgaaaagggaaaaaagaccagtttatgaattgacaaaagaaggtaaatgagattagccatatagcaaccactcagataataatgtgttttctctgtttagtaaaaaagcatatttgagagaaaattttcccttatagaacaattcttaataatatacatagatactcctttcctgggatgtagagtttaatcctcccctaagcccctccatgaacttggtaacttacttccagataatagaatatggaaaagtaggaataacaatggagaagaaaccaggcaggcaccaagttaactaagtagtcaagtataacatcgccagtgataataatattgatatcatgtctcctgtgatatgatgtcatgaaaaggacatgttatctctctggtattcttccccaaaacctgtaacttcttctaatagggaaaatacttcagtcaaatcttaagagacttctagaatatacctgactagtcctattcaaaagtttcaaggtcatgaagaacaagaagaaactgagagactgtcacagactagaggagaccaaaaagacccaaggaccaaatgcagtaggagattctggattggatcctgaaacagaaaaatgacatgagtggaaaaactggtgaaatctgaataaagtctgtagttttgttaatagtgttgtatcagtgtttgtttaaatgtttagataaatctctcatgcgtacagaagagttatcattaggggaagctgtgtgtcaggcacttagaaaactttcagatacataggtaccttttgtaagtaaaataatgaattaatgggtcattttatgtctgtattttatataaggctacatttctaaagagacaaaattgtgagtcccataaaaatataaaatgaatatgtgtaaaacattttattagatcattaactgatgaaggaattagtaagatgttagttacagttggttcaaaggagagtctgaagaattggcatatatatatacgtatatatacgtatatatacgtatatacatatatatacgtatatacgtatatatacgtatatacatatatgtgtatatatatattttatatatatacacatatatatataaaaaacactctagaatgctgataggaattttataacagatacaatactgatcactaactgtagggcaggaatctattgcgttccatgagaaaattttactggcatatagtgaacaagaatcatttgtgtcaccatcagccctccacaaattgacttttaaacgtacagaattgcaaaatagcataaccaaagtctaaggtacagactcttagataatcagataactcctaaggttttcctaaggaattaaagggaaagagacattctcagattaaggaaaacaaagaatttcttgctagcaaatctgctctaaaagaatgacatggtacctacaacagcnnnnnnnnnnnnnnnnnnnntagagtaaaataatagactatcctatttaccataagtttgaagtgaaaactttaacaccacctgatgtggttctcaatgtatgtagagaaaatacttaagagttatattttaaaagaagacatacctaagtggaagtaagagtccttctacacgtcacctgaagtcaattccagtagattgcaatgttaatgcgtatcgtaatgcctggaaagaccactaaaaaactatacaaagtgatacgttaagaaaatacaacaaataaattttgatggaatcttaagaaatgttcaaataacccacaagaaggtaagaaaaaagaaagagaagaatgagaaataaagaaaacaaacagaaaccaaataaggtggcagattgaagccctaatatatccataattaccttaaatgcaaatggtctaaatataccaattaaaagagatttagctgagtggattgataaaagctgagcacacaatatgccgtctaaaagaagtttatttcaaatacaacctaggtaggttaaaattaaaagaatcgaaaaagttacattatgcaacaattaatcaaaagaaagcagcagcagtaatgttaatatcagataaagtaggcttcattgcaaagaaaattactagtgacaaacagggacattacataaagattaagtgttaattcactgggaagacataataatcctaaatgtgtttgcacctaacaacagagcttccaaatacatgaagcaaaaatgaatagagctgaaaaaagaaacagacaaatccatatttctagttagggacttcaacactcctctctcttcagttgatagaactactaaatggaaaataagcaagggtaaagagaactgaacaacaccatcaaccaataggatctaattgaagcactcctcccaacagtagcagaatacacattactttaaagctctcatgaaacattcactgatataagccatattctggactccaagcaacttcagcaaatttagagaattcaacttatatgttcccagaacataatgaaaccaagctagaaatcaataagagaaagacaaaagaaaaacctcaaaacacttggaaatgaagcagcacacctttaaatcattttccccaggtcaaggaggaggttgcaaagaaaaattttttaaacacaaagaactaaataaaatgaaaataaaacatcaacatgagtgagattctgaagcaaagggcaagcatatctactgtctatttttaaagattaagcttccttaagctcagggtttctctcctgtgatgcaatccactgtgtgtacaggtgtctcctgaacttctttgggattactctgtgggaactggctcaataaaatgttggttctttgactactgctttgctgtgagtaatctagtctttttctctggcaaaaaaaaataaagtgagatgtcataaaagcagtattgagaataaaatgtatagcattagattatttagttagaagacaggaaaggtctaaaataaataaatgagcctagagacaaaaaccatcaacaaaatattaaataacatgcgtcaaagtttaaaaaaagagtgtcataccataactaactgggatttagtattgaaggctggctcaacatttgaaagttaattagtgtaatctaccatatcaacaaactaaagaagaaaaaatcatatgattatattgattgatgcagaagcatctgacaacacccagcatccattcatgataaaaactatgagaaaactgggaatagaggataacttccacatcttaataaagggtatctacagaaaactacagttaatagcataattttaataatggaaggcttaatgtttccacccatgattgctaattagggaaggatgcccaatttcactactcttttttaacatagttctggaagttccagacactacaataaagcaaggaaaaacaataaagcatgcatattgaaaagtataaaataaaattatttctatttgtggatggcatgactgtgtacgtagaaaatatcaaatattctacaaaaacaaaagcaaaaataaccaaaaatgctcatggagctgagaagagaggttaacaagatccaaaaatacaagatcaacacaccaaagctagtcacatttttatatacagatgctcctcatcttatgatgggcttacatttagataaacccatcataaagtcaaaaaatcataaggcaagccatcacaacttacggattatctatgttggaaatgaagatgtgaaaagtgaaattaaaaacacaacaccatttataattgcttatccaaaaatgaaatacgtaggtataaatctatcatacatgtacaggatcggtatgtagaaaattataaaatgctgatgaaaggcattaaaaacaacctaaataagtggattatatggcatgtttatagactggaagagtcagcatagcaaatatgtcagttcttctcaaatcaatctaaaggtttaatttagtttctatcaaaatcttatcaaggatttctgtacacatagacaagcatactctaaaatctataagaaaagtcacaggccacagaataactaaaacagtcttttaaaaaggtaaataaagtgggagtaacctctctacccaatattatggctaacaatatagtaaggctatcaatacagtatgatgttgctggagggatagactcatagaccaaatgaaacagaatagagaacccaaaaacagacccatgcaaatgtgcccaacagatttttgataaagttgcaaaagcaattcaatagagaaagctcaccttttcaacaaatggtcctgcagaaattggacatccctagagtgggaaaaaaaaagaacttcaacctaaatctcacaccttgtaaaaacttaattcaaaatagatcatggacttaaatgtaaaacataaaactatcaaaatttagggaaaaatgagaaaatcttcaggctctagggctagaattggcattgaaagcatgatccacacacagaaaaaaatcagttggactgcatcaagatttaaaacctttgcactgcaaaagacctgtgagggaggatgaaaagacaagctacagactgatagaaaatattttcaagccatatagccaaaagatggatgtctagaatatataaagaactctcaaaactgcaaggtaaaacaagaaacaaacaatgcaattaggaaatgggcaagacacatcaagaaacgtttcaccaaaaaggatatacagatagcaaataggtgcatgaaaagattatcaaaaacattagccattagagaaatgcaaattaaaattattatatattcctacacatctatcagaatggctaaaacaaagtagttacaacaccagatgctagcaaggatgtggagaaaatggatcattcacatattgctggtggaaatgtaaaatggtacagccactgtagcaaactgtttatcaattttctgtaaaactaaacatgcagctaccatacaacccagcaattgcactcttggacatttatcttacaacctgtacaaaaatattcataccaccattattcattatagccaaaaactggaaagaacccagacggtcaacaatgaatggttgtacaaactacggtacatccatacataccaggcaatactattcagcaataaaatggaatgaaatatttatacatgcaacaacttttagatcaatctccacagaattatgctgagtaaaaacagctcatctgaaaaggttacataatgaatgattctgtttatatagccgtcttgaagtgacagaattaaagaatgaagaacagattggtgattgcaaggagtccgggacaacaggggaaagagagagagagagatggatgtgactccaaaagggcaacacaggaggcatccttgtagtgttggaactgttctttaccttgattgtgtcaatgtcaatatcctggttatgatattgtactatatttttgcaaggttttaccttcagggagacggggtcaggggtatactggttttctctgtattatttctcacaactacatgtgaacatacaattatctcaaaactaaaagtgtaatttcaaaaaacaaataaaacaattcagaaattttaagacttcaacagtcatttatctcatttgttattttactgttgagaaaacaggcacaaagaaactgaagtgacttactttcatgcttcacctaagtctttttttcttttctccatcactcagttaagagcttctgtaatacagaaagtatgtcttgtattcttttaactcccatattacttcaagcaatgttgaacacatgttaacattgtaaaagttgttgtctgagtaaatgggaaagatagaggtctatgtctatatgcaaatactttgtattaacatgtttcagtctgatataactttccacacagaaagtacaaaagaagatctgttcaagttatctgatttaattaagatagtaaaaagaaagctgataatttagggggtcttatttgattgtttttaattttacttattttccactaggtgatcattttgatgattcaaaaatgaaaatttacaaaaaggtataaaataaaaattatttctcctacctctatgcactgtcgaatcaattcccctacccaccaccaatcagtattgtcagctgtttgtatatccttcaggagatatgtacgaatttcaagcgaatatgcataagtttatgttatgtatatgtgtgtgtctgttttctatatatatgcatctttacattaatggtagcatacgatacacattttcttctgaattatgcttctctctcaacaatgtttcttggacattttcctgtatcagtacataaagaatgtatttgtttcctatgactgcaatagtgaaataccacaaactggatgacttaaccaaaagaagtctgttgtcttacagttctggaggatagaagtctgagatcaaggtgtcaggagggttggttccttctgagggctcggaaggagaatctgttccattccattcccctagtttctgatggtttgttggcaatctttggtgctccttgtcctgtagatgtctgccttcattttcacatggcatgccccctgtgtacgtgtctgtctccaacttccccttttaaggacagagtcatattggactcaggcccaaccaaatgacctcattttaagttgattatctctgtaatgaccctatctccaaatagggtcacattctgaggtaccaggggttaggacttcaacatttaaatttggagaaaatttggacagaattcaacccatagcaaagaacttaaccgttagtttaatgactacatattgttccattttgtggatgtatcataatctatttaagcagtgctctgaacattttattggttttcactttcattgttttgccttaatattggtgtctgtttcatagaatagatttatagtattttaggcttatcaagattttatttaaatcttggaatttaaattccctgtaaatttcaagtgccttgaaggcaagatatattgaggaggggagacttttaaagttcatatgaaataataaataatcgcaagtatctcaggaatgcatgaaaaataataaatgtctctgcatcaataataagggagggggcttgccttatccaatattaaacttgctgtaaagctactgtaatccaaatagtatagtattagcacaaaacaagacaagtagatcactgaagcaaaattgagagtccagaagcagatcagattgtttttggaggccgggcatggtggcttacgcctgtaatcccagcactttgggagtctgaggtgggtggattacctgaggagttcaagaccagcctagccaacttggtgaaaccccgtctctactaaaaatacaaaaattagctgggcgtggtggtgggcgcctgtagtcccagctacttgggaggctgaggcaggagaatcgcttgaacccaggaggcggaggttgcagtgagccaagatcgcaccattgtactccagcctgggcaacaagagcgaaactccatctcaaaaaataaataaataaataaataaatagatacaaattgtttttggaaacattatatggcaaatgtgttattttaattcaaggaataaaggtgttttattcaataaatggtgccagcactctttgcaattcctcttagaaaacacagattgcctcctagcttatgcaatgtaagaatacatttcaaatgcattaaagttttaaatgtaaaaacaaaaattcttggaatgaggaagacgttttctaaacaagacacaaaactcaaaagctataaggaaaaaatataccttgttactgcttaaaataacagaagacaaagtcaaaagaaaaacagcaaatagagtagatgtattcgcaacatgtgacataaagagatgcatatacctaatatacaaatttctcctacaaatttgttaattaaattaatattttttaaaattcaaacaacccagtacaaaactggccgaagtataggaatatgcaattcccagaagaggatatccagatagctggaaaaataaaactatgataatatgcttcctcatagtagtaagggataggaaaataaagaaataagacaccatgtctatctaacaaatagacagaaattaagaatgataatttttaatggaagagagcactctcagatattgcagatgaaacgcaaattgctgtggtctttgaggaaagaaatgtggtatgatctacaaaaattttaaatgcacttaccttttgatcagtcactccatttctgagaatcaatactacagaaataaaagtaccagtatgaaaggctgtatgtagaggatgtgtattttggcattgtctatgatggtcaaaaagtagaaatcaagcaaatacccttcagtgtggaaattattgaatatgttatggaattatttgggcatcccagaatgaattattatttagtctagttagagctgtgtctactgtcctgaaagaatggtgatgatatctttcaaaaatcaaaacaagtttcaattaacatattccatttttaaaataaaaaagataaaattaatcttatgggattacataaccatgaaggaggaatggagagatatatactaggttatcagtatttgttaccttggattttcaaaggagaatgaaagaggaacaaataatgtatcaagtttcacaaaaagtgaaaaggtggaatataaatattactgcaaatatataaccattgaatatgtatatggacaaggacgataagataatatagaaaactgaatatgttggttttattatgaggtggttggattgaagatatttttgtctccaaatactgttgttttaatatgttgtgttttacaaagaaacatgggctgagcagacagggaagccctgataagcatagtacctgccatgtggccattcaataaatgatagttattgattattattattagagttgtagtacagtagtgcctaccttaatatatttagattgatgcccagcagcattgagttaacccgcattttaaggacaagtgttatagctattatatactaatggtaaacttgagtctgtaactagcactgttgaaggaggacaacagagtaatatgatgtgtattggcctggggatggaagggtggtgcttaaggcacagcagattttcactccagccaggtttccttaggacctctccaatgaacaggatacctcccttcctgttctttctaccctcccaccccgttttttgctttttcagtttcagcccaaaggggaaggaagtatgatgactgactccccatcagtccctgaggtgaactgggattttgggagagtgtggcagctgcaaatttggcttcctggagataggatttttgccctcaatctggagaaagttcctgaggctacagctgttcaagcttgtgaagtaggaactttgatcccttttttcaaaagttttgtataattagcatccaacttgttagacagtatgtggctcattacaagattgccacaaattcatgctgggccgtgtctaagaacagggcaaagggagcctttggaaagtgttatacagttgaccctcaaacaatgtgagggttaggggcgctgagcccaacacattgaaaaatctaagtagaacttttcactcccccaaaacgtaactactaataggctactgttgacagaagccatactgataacataaagagtgattagcgtatactttgcattgttatatgtaatatatactgtattcttgcaataaagtaagttagagaaaatacgatgttactaagaaaatcataaggaagagaaaaatatatttactattaattaagtggaagtggatcatcatataggtcttcattctcattatcttcacgttaagtaggctgaggaggtggagggagaggaggggttggtcttgctgccaatctaaatgctgggcccagccaatgggtataagttttaagtgtgcacatattggtgaacccttacagatcacggcactgtctgttcgagtgtctattttgaaatgtccctatccgtaatataagttgcaaaggagtttgtgggcccactgaattctaccaccctgatcattgtgaagcccattcagctttgtgaagagcttatcttggtactaccttagccaaggtatgataactcagacataatgtcttttctttcatggttccttttttagtgatcatagattcagttctgtaataattagagatttatgtgtcctattagtaattgcatcattctttaaagacagtgtcaaccttgctatacagtgtgattgaagccttgacataacttgggggtttgttggcattttgaaatcccaggccccacttcaaaactgttgaatcagaatctgcattgtaagaagatccccaaaagatctgcatgcacaagccttgaaagagaagagaagccatctaacattcctcacctaagatttgaagaatttcccacttatgcaagagtaggggtgtgatttctcaggcaggatatctaacagaaaacaacacttatgaagtgtttcctgtaggagctaagcaggtggccagaaaatggcaggctacaaaggagaagaatgactaggaacctgagcaaggagaaagtctcaaagacaaggaagtggctggcagtgtcagggactaccaggcagctgaaaaagctaggtgtgaacactatttcttggagttttcagcaagtaagaggttcatgatgatgcctcaaagaatttacagtggaaccagagccaagaagtcttattgtggtgagttgggaattagggaaagtgttatacagttgaccctcaaacagtgtgagggttcggggcgctgagccctaacctcaagtaagaggttcatgatgatgcaatcaaagaatttacactggaaccagagccaagaagtctttttttttttttttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccagctaatttttgtatttttagtagagacggggtttcaccgtgttagccaggatggtctcgatctcctgacctcgtgatccgcccgtctcggcctcccaaagtgctgggattacaggcgtgagccaccgcgcccggcagccaagaagtcttatggtggtgagttgagaagtagggaggtggaaataaggaatggagatgaagacatgaaaggaatttgagaaatgaggcaatagctagagaagaatataggaatacacagatccagcaacccagcaagggaagggctagattctgatttcatgagcaaattgcctactaattaaattcacaatatcagaggaaactgttggactcacttactgaataatagctgaaaagtatctttgctttatagagagatcactgtagatgaaagtcatcttccagtggtgagatattcttcagtgtcatctcttcatttttatttctaatttttcttaatttgaattatttcttctgataatgggaatgatgtggtaattttgtctctcctgtaaattattttaaagatttgtacgaactcctttggcaggcttgagtgtgttgtgacagcttggcttagatatgcattgaatgtcattgaattcaaactccttaccaacatagttagatagcccataggcattctacttgaccctttcaaggagatctggagatgcaattgtaggggaaaaaagaagaaaagaattcaagaagcaacaaagtgaaagataatttggcttgcagaagagaggtctttctatcacagtaataataatgccaattatatgtccatatatatatatacgcacacatatatatagtatatatatatacacatataactcagacataattctttcatagttctttcttttgtgcacagattcacttctgttataattacatacttatgtgacctatttgttagtaattgcttcagtttcttaaaagagcatcaccttgctgtgcaaagtgtgattgaagcctcaacatctcttgggagtttttttagaattttgaaatcccaggccccacttcagaactgttgaatcagaatccgccattgtaagacaatccccaagggatctgcacgcacgttgcagcttgagaagcactgcagtatcacacatatacacacatattcaacaccaaagagagagaaagaggtcataagctctcaggtggagactagttccatgtatatatgcatagagagaagaacaaactctaccttccagcaacgtaaaattctactcaatcatgtattcaccaaaaaagaaaaggctttctccatataatgtgtattattcatatattggcactcttcagagctcttcattccaccctaatgttatctttcttagataattcacatgacactttgttatcttccaataatttctgtcattgttataagcgaaattattcaggctttatctaagagagtaaatcaaacagtatgcctctctcattccaattctgcaatattttcattctagaatgtctaaaggagccttgaaagagaggagaagtcacctaaggccagctagaggggatatatagcagggaatggtggcaactccactcctcgtagcccagtggggttttttttttttccaatctgtatttgtatgtgagtatcacgtctatgccgattttatgtgtacatatgtaactcaaatctgttcattgtgctagttagaatcttatttccccctcttctactacactctaccctttctctttcccctcctttggcaaccaagacactgagttattaataagcagattggagcaaacattttgatgcactattgtttgatagatttgttggttcattcaataagcattaattgagcacttgctaagtgttaaacaatgtactaattgctagatttaaggatgaaaatgataaaacccttggcctctagagcctagagtgtagttggggagacaaatgggcaaattagtcacacgacaacatattccttgttaaaacagacagttgtgcataagtctgtatacccagactggagatgactctgtttccaatgttgccctgggaaacctcatgatcagtttaataatgatgtttggggtgagaggatactgagacagtttgcttctagcatagtaattacccatagaagtttggggtctttattcaaaagagtttacaggccacatgagccactgtcttgccttttataggatcacatctaagttccgtgtcatataatggccttggccttcttggctttctctgtgctctttgcctgccaataccctaattattgaagtactgtctcccgcagctcctcaaccatgagctgttcccgatcctcccagcagctatgtttctcctttcttcaaacctctttagctttttatttgtactttatttgtactaaattgtatttagagctttggagaacattcttcatagttgtaattagactgtaaagtcctgagaatgtatttttcatcttcgtagccccctgcagtatctagcagaatgcctttaaacaaatgggcagtaaataaatcccaacaaacttaaattaaatttctccaaattgcatatttaattttatagtggcatttactgataacatacattgaaataaaggccagagcataatcctctctgtttctgaatattatttatttaaatattaactttctaatccaattaggtctttcaatgacactttagatctaaatttatttttgcattgttttaaatgtcatcaaatgattcatctcttgtgttttttaatatttttggaacgaacgtgtgaaaatgagcaagtgtcatcagaatatgatgcttgggtttttttaattcaacatttctttgatcatatatttaaagactttttctcaattcctttctggatgtggcctcacaaatcatttcagaagtcaatccatttcaagatttttttttttttttttgcttttttcacttcacaggaagtcaagttcattctttaaaatgtagcaaatgattaagcaaattcaacgaatgatcttcatcaactccgaggtgtttttcccccttgaaaaatttaagttactattatttttttttctttttttttttttttgatacagagtctcactctgttacccaggctagagtgcagtggtgtgatctcggctcactgcaagctccacctcctgggttcacgccattctcctgcctcagcctcccgagcagctggtaccacaggcgcctgccaccatgtctggctaattttgtgcatttttagtagagatggggtttctccttgttagccaggatggtctcgatctcctgacctcgtgatccacccacctcggcctcccaaagtgctgggattacaggcgtgagccactgcgcccggccaattattattattttttttaaacttcacctatcataaatcttttaaaatttcacctatgataaacttcctctgtcatctggggaattacttaaatgcaatgatggccttcaagtatactaccaggcagcctatccaaatcatgaaacagaaaggctcatagaccaaattaaaatacttgaatcacagagtttattaaaatcacagtgagaagcaaacgggaaagatatgtgctaagttaacacgcttagaatagagtgtaagcagactgtgaagattagagtacttgaattctgcagtacacaacattatatgtcttgtctgtctctgtattgcatcagccttcccaattatggtgtgcttacaaggaccaaagttgacttcccaacaagggagtccaaaatgggtggtgcctgattcagtggcatgtggtttatcagagacacagagacaagaatgcatggccacagctgtaacttgccaaaatagcctgatgactagccatgtaattctcaggcagaagacttacggtgctggaataggtatcacctatggatgcctgaattaagaccttgtgaacattaagtgctcatgtgtatttatttgatcttgaatatttagtgcctcttgtatatttggtctcatgtgtatttagcatattatgaatatttagtacccaggtgcctcatgaatattgggtatcttttggtccttctatccctcactatctatgtttagtacacacatgctctgcttgctaactacttatcttctaattaacacattccaagagccaattatgtgtatctctttccactgagttcttcattcaatgacatcaagttagttgcttgaaatcagctattgtgagagcacttacaccacagaaattggcaaatgctacaattagcgccactgccctcccctagagccagttatttgacatttactagcattccactacttacatggcccttcatgctctcactccgtgtgaccactcaagccttatccctctttactgaactctacaatcaaataaaatatctttgtttcttgcttctggccctccatcaaatggctccctctcctaggaacaatctgtctctcctctatcacctttgtttagctagttaataatcccttttcagacagcacctcataaatagattcctgaacatcccaaaccggatctcctgcaccttcaatgtgctacttcagtacatttgtcttaccctttgccatatggtatttcaattgcccatgaatttgtattcctgtttagatcttaagctttgtgaggtctttttgtacttttttgtacttccgtatacctaccacataataaatatttaatgaaagcattaatgaataagtaagtgaatggagtgagtgaatgagtattcaattatgattcatttgtatcaaagtgataacatatacttacagggaaaaggccagagggggaaaaaataaaaaataataatatattttatgtatgaccttgtgtggggaaaggaacatagggccactgcctggcctgcttcttttatgcaaatcctaatgtaaaatatgatcaacgcctggctgggcagaaatacaaaaacccagtactagtgattctcccaaccagataccagctagtacagatcatagccagatttaactactgtgaagtggttaggttagaggtgacctataaggaaatgacgctaatgatcattagcatcatcttggaagcttaaaaaaatgccccagctgtaccccaagccaatgatatcagacttttgtggggaacccagatatcattgtttttaatctttaatgattccaatttagccaaagttgagtctcaacaaaccaagttcttcttactctcatattctcttcttctcgcatagataagaattaacagccagctcttctacatgtttcttagacacatatattgtttcagtggtaattcgttaacagtgcatatgtcagcaaagcatgactgaaaaaaatatctgctcccacacattctgatcccatcttgacactgcatagctgttggcgaaggcaatttcaacaatgaagaagtgggagaaatgactacattttatgtaaatatgtattcattgaaaatcaaaaggacatatgtaatgatattgtttaagattctaaatgaaggacaatacttaagagtcctctgtagtcaaatttctcagcagtaaaaaaacattgtcttttctttacaactattaaccatatggctgtgaaaatgttattctacaagcctttaagatttgaaatctgactttatgttaatacacagaatttaccacacaatcctgtatgatttctaagtagatttaaagagtagctattgctcaccttttcaacataatggtaatgatggtgcaatgtcaattacatgatactctcatgggcgtgattatatgattgttaacacactgaagtgcttatatagacatagatactgatttttatatgtacatatttaaaacaaacaaggacttaaaatggcctgtaaaagtctttctagtcagtctttctggttttggacagagaacaaataatcccttacagctgttaggttggtgcaaaagtaattgtggtctttgccattgcttttaatggtaaaaaaaacgcaattacttttgcaccaacctaatagttatctacttccatctttaacgggccctacccaagactgcatggtatataagtaagaaatgtaaatgaaaatctcaaatgctagatctgcccaggaggggaccactaatgagagaggaaatgttaacgtcccatatgaactaagctcagcttagcatttacccttcctgctattccgctagagcagtgcttctcaaaagttgacctgtaatggaatcttctgaatgcctttttaaaacgtagctggctgggccccatccccagagtttctgtgtcagttggtctgggatggggcctgagaatttgcatctctaacaagttctcaggggatgttgccggcccttgaatcacaacttaaaaacctctgctctgaagaaagggaaagctctctctgctggatttccccaagcctttttcagattttcaggagacttctgtgcggtagcttgcttccttctttccatactactactactaccactactactactacaaatagcaacctctagcatattttcagtactaaatacccagcactatatatacatcacaaaagtcccttgaggaaggtggtattatcatctccattctgcggataaggaaatagataagaaatttgctgaagatcgcagagccaaatgagactcaaacccatgtaacccatgtctgtttgactttaaagcccggaatcttaatttgttccagacaagctcattatgtgctctgatcttcaccactgaaatgttctgaatatgaggctgagggcagcagtgaggttggaaggagcagcccagaggagcaggcactgtgctggtagaatagtagtatggtggggcctgcactccctaataaaagaaggggacaatgactatttcctccttctccaaggtcgtgctgcctcccatttctctgtctgcctggtaagaagcagctctgggccatgtgtggtggctcacacttgtaatcccagtgctttgggaggctgaggcgggaggatctcttgagcccaggaaattaagaccaaccctagcaatctagtgggacttcatctctaataaaaataaaaaacttagctgggtgtggtggcacacacctataatcccaactactcaggaggctgaggtgggaggattgcttgagcttgggaagtcgaagctgcagtgagccgtggtctcaccactgcactccagcttgggcagcagggtgagaccctgtctccagaaaaacaaaaagcagcagctctgaaaagaggatctagcagtttctatatgcaggagagcatttgcgcaattgttcctggggttgaatctgagaaactcacagtgcacattcagatactatttacaatcttctaggaatagtataaatattgtggccagggcaccttcatattgtgaaacacaaaaagacttcagaccttagattatgtgtcgaaagttaggcaccaatgatttttttttccatttgttcttaagtggcaaatctttacattaacatttttggtacttgtctttagggaaatttcttctctgttctgaatgtatatattgtaattcctcatttacaattttgcctgcaaatgcaagtgagtacagatcatccagttatgaaaatgctctgagatttgagtctagctgtttcagctttaagagccctgacctagactttgaaactgacatggttttatatgtatgtggttggaattaaacccaaagcacatcttttaaaactctgaggaacttctgtgccacagctttcgctcagttggtgagattttactttgaaatttaagggatgagtctagtttatatgcaaagaaatgtagggagctttgcaaacccaatcaaatcctttgtgaacagtgtgtgcatctgtttattttgctgtcattttgagtccatgatcctgtatactgttttgtgggcacatattgagggtaatatcaaataccatgtagaacagatgctgcaggtatcctttccatgtcctcttagctttggggtggtagatgggcacatggaccaagcccaaagtgacagggtattaacaggagcaagactcaaccaataagggagagtagatgggtacaaatctcagctttctctcccctcactgggataattttgagatatattccaaagatcctcagagcatccccaacagcattgagccccagttccccagattagtaatctactcaataaatacctcttttttttttttttttcccgagatggagtctcactctgcaccctggctggagtgcagtggcacaatctcagctcactgcaacctccacctcccgagttcaagtgattctcctgcctcagcctcttgagtagctgggactacaggcatgcgccaccacacccaactaatttttgtatttttagtagagatggggtttcaccatttggccaggctggtctagaactcctgatctcaagtgatccgcccgccttggcctcccaaagtcctgggattacaggcatgagccaccacgcccagcccaataaagaactctggattgtttcttccttttcctctcctcctttcctgttccctacagtgtttcctaggatcacctcagtctgctgtatgggaaacccagactgagtcaccataacagacagaggcattgttactttaggactttagtggatatagttacatgggagagagagactgtgtatgtatatataacctttataatattaaaccatgctatactcaaattatttactggccaagatttccaatataaattggaaataaattggatataaatcaagaacagttaaaattggaaatagttaaaatacaaataaaatagctaaaattgggcaaaatacctgacccaatgctttaatatccgattgcataattaaacgagtaaagaggaaaggaaattattagcaactctatatttaaatgcaactgacatccaaggaagtcatgaagaaaactctttgtgttgataaactgaaggcctcttctagcagacttctgtgtttattgttctgttgctgactattttattccaaacaaatgaacttgcttgtcattataccccacccttccctagtacagggcccccattctttgaaacagtaactcattcagttccaaggagaatatgaaaagggagggtaatatataaaagaactgaaatgaaaagtggcctaagtgtggcacatttccattgtggattccatggcaatggagaattgatggcagagcatggtgagagatgtgaagcatcaattggctgtatctccagggaattcctgaagttcagttgccaccctggagggtggcaaatgctctctctcaccttccttgagttattgcttagatgactcaaaacaaaaaactgatgagctataaatgggctgtattatttgtttttacctgctgagtagttcagatatttcaaaataatctcaaacttaacctatggtgtggtttctgtgttaaacaaaataccgtaacttttagttgaaaatactgtgtaagcccacacaatctcttgttcacagataatcttgttgtcaaacattcatgatgacaaaaactcataaacgattcttttaaatatcaagaataacttatgctgtaagtcataatttcataagcatgaatttatgaatgtgttttgtgtttgcaattttcatttaggttgtcttaaaatcatgcgttttagcttaacttaggagaaatatatcttttgtgacaacataggatattcagagaaacgtgaaaactaggtgatgtgttttatgaaagaaggcataaagtatatcaagcataagaactttgaattctatttgtgttttttgtggctttagaaaagattgttctgggaatagagaattccatttgggaaacctagcacatacacagtagcagagttaaaatactgacttggagggttcatttgaagaattctatagaatttttgcatgttgggaataggtttatattcttaaacattgcactcagggtttctattcaaagcaaaaataactttgcatagaccttggccattctttcacattctaaagtaatccatttttttttttcagggtagttgttctcagtcctgattttctgataattcagatcatctttaatttacaccaaaaacttttagaagagtcagataataatttaacataaaatgtaaatgactgaaatatacattttttaaaggagcagatatggaggggtccaatgtacttaactatttgctctctttgtctccttgcattcacgggaatgtttctatgtagttttctaatttcacacaatttcaataatccataccctcctcatttttatgggccttcatgatactaaaaatgttaccagaaattattttgtgttagtctctttgtttagcacattcatacataagttttaacatttaactggcatatttttaaagtaatacatgtttttttttttaaaaaaatcagttatgtttgtgtgtgtgcatattttcttttgtggccaaatgttgcacgccctagtccttctatttaaacaatgagtttacataacaaatgttacatgataaacatgaagacatttagtttgaaaaaaaatgattttctagtttactcatttaaaaaaagctgaagtaaccgggaagaggagtggcagaacatattagtctttttcataatgccatcattaaacaaagatacttaatttccaggcctggtgcagtggcgcagcctgtaatcccagtactttgggaggctgaggagggcagatcacttgaggtcaggagttcgagaccagctttgccaatatggtgaaaccctgtctcaaaaaaaaaaaaaaaagaaaaagaaaaagctacataatttccaaaatgacttcagtgggacctgaggtgagggaataaaggctctggagtaatttcactctctattcctctcctaattttttttctgttcctttataacaacattttcactacttttgagcttgggagttgaggaatcatgaccagaagaaaaggaaagacgggaaagatgttcaagggtgaggatgcttaagaatgacctggcaagcttatgaaaatgcagttgtctggatcccaccacagagattctgatttagcaggtctgtggcaaggcctgcgattctgcattgctaaccagctcccaggtgatgacactcatgctggcaacctatgaaccattgagtggcactgttccagggggcagggcaatgagaaattgaagtcaaaagccccaagacctggtgctacgaaaatactctggttccttccctctcaactgatttacttgtcggtgtgattttgcaaaaatccctgaacttcttaaatcccagttacctcacctgaaaagtatgagtgttgctccagatctggaggctttcagaccatgcaaatcgaattcaaaccatgcaaaccattcaagtcattctagaaagttctgcaaggtgcctcagaggccaaagggagagatgggaagagggattgaatgggctctttccaaggttccctaacccacttgaatactttcatcttttatctctttcatatattccacttttgagtatggtttcatttagaaaataggattttataccaacagatttaaagaaaaactccaagtctgaaaatgactcatttatttaaaactgtatagaacaaagacatttagtgcacaattccaaaaattctctgatccttccacagcatgcccagtatgctgcaagagtgccagcaaacacatgcttactgctcacaaatgtgaaatttaaccccatgcactaggaggtccctagtgtggggtggttttagctaaccagactaagagagtacagggcaacatcgagcctttctctgcggtcatgtctgattcattaaaaatccagctttccccgaagatatattaattaccttctgtttcagaatttgtttttagagcctaattcttaattatatctccagccattgtgtgatttgaccattttggaactaaaaagttatcctatgaaattccacctccaactattgccacactgttagtttgtctatttcatacaccatgccaatcttagcgtggtgctagcatttcattataaccagctttcatttttaataagaccatgtgtatatgaaattgtagacttcagtctttgtatgaattgaaagctattaatcttcccagggttaggttatgttaaacagattgtaatgttcttctttttattatgttatttaaatccccttcatttcatactgcaccaatacatttctactatcttggaataaattaattccagttacgtgatggaaaattttagtgtaaaaatataacctgcagtataattttttctgtcagaataccaactagaactggtatgtttcattctaattggaaatttgagttatcgctttgatttttaacagtgggaaaggaaaatgaagattgatatctttcaatagccgttcattcattcttcattccttcattcattcacgtattaagaatagtctatgtgctaagaacagaaagagtgttagagatatgaagattaataagaccagatccctgcctgcaggcatttcctattctatgtcatagatagggggctattctgtttagaggtaaagcatgacccacattgcctctgacaagaagcataatgtctgtagcagctaactgctggagacaggaggctagagggctgccctggtaattggtattcaagtcttcaagaaaggaaaccagctattccaaaatcagtgggcaagaggaagttgtaaagttaagtgaaatgactaaaatatgaataactaaaggttggaatctggtagaaggagaggagagcatcggtcagcaccttagtttgggaaggtggtgtggccatagtaggctttatttagaaagaagcaattcttaggtaccagctaggtttcagttccttaaggggagaaaactggcaaaatataggcaggtttccagggtgcaaagccacgttctagcttcagctcaggcaaggccctggggtatgaatcaccaccagagtagcccagccaaaatgactaagggatctaagctggttgctaatgaaagaggttgcagctcaaggcagctctgctgacgcccactggatactgggattacattgatttaacacatggaaaccacttaatatggtatgtggcacaacacaattaagtactcataaatatttgcagataatgctgctgccattgctgtttttgtcgttagaagactcgggaaaatcatctaatacaggaatccatctgttggcggggcttgggcttctaatatttgactggttgatttttgtcgacccaatcttaacaatattatacacagccattacttcaggaaaggcagttgtaaagaatggtataaatttcctgtaacttgactgccacattctagctgagtcacctctatatacctcagtttctttgtatccgcagtgaagattaatgacctcatagggttgttattagaatgaagtgaattactacactggacttatttaggacagtaactcgcacatagtgagtgctcaaggaaatctcagaccctgcctgctagtggagggtccagctcctgatacatttgggggcaggtttaaggagttcattgatttagagctgtaagggctgatctttcaccctgcatgtcttcagcaactgtggctggtaaagtccagagcagtcaaaggctgacaaatccttgttagaaatcacaaatgcccattctcacaacttctgtggtgttttccatcctttccctagaatactttctttttaaggcaaaggaaagaataatcactgcagatagcacacagtatttttttgcaacatattttcaaaaattatgatgagaaaagtgtatcattcctgtgaagaaacagcataaggaaaatgatttgagaaagaaacatggttcttaaactgaaacaagtgtcagaaggaatcccagaaggcagaaggaaatatagtaatcatgatgaagtctagagctcacaccggttaacagaatggcagcagcgatattcatctcacgcctcttccatgctgtccctgagtgagcttctgctgaattgcctggctggtgaggattggtttcagcagcagaaggaatgggctgccagctgaaggctctggttctgatcctgggtagggtcagagaaagcaagatgtgaccatcacttttgaccttggtcttgaatttgattccatggaacaacgatattttacaaacccagttgaaggtttatccctttttctattcaacacagggagagtccttagagccccaggaagacttagccctttttcattctaagagtaaaccacatctaggtttccagagatgaaaagaccaggctctgatcttccttctggaagcccttgcctattcaacaagcatgagtattaaatgctattgccttggaatcataattcagttttcacagtttgggctatgtcagaaccattcttgtcaaccccctgttttctgagaacccgaaacctgcttgtttagaattttagaatctacttgactcttacaggggagaaaagatctcttttctcacccatcgctaggttcatggctgaggcacctataatgaaggacaaatcaacaacataaaagcatgcgaatttatttaatataagtttcacatgacacaggagccttcagaaatgacccaaagaatcagggaaaagtgtgtatttttatgctctgatttgaggaaaagtagatgtccagtatgactggacaaaggggaatggtaataaactggggtgaccacagcaaggcctgtttctgcagaacctcctgtgtccctgtgttttcagaggtaaaaattttcctttccttccagtatagtaagggcacctctggtatgatagtctcatgacctgcttcaggggagaagggggaaggggaaggtgagagtgaccatcctgcttctgctgtcttctcaaataccaagctgccatattgtggattttggagtagcgtaacttgaatccttttttttttttttttttgagacggagtctcaccctgtaacccaggctggagtgcaatggcacaatctcggctcactacaacctccacctcccaagttcaagtgattctcctgcctcagcctcccgagtaactgggattacaggcacatgccaccatgcctggcaaattttttgtatctttagtagagatggggtttcaccatgttagccggactggtcttgaactcctgacctcgtggtccgcccacttcggcctcccaaagtgctgagccaccgcacccagccgcatagcttgaatcttatcaataccttaaccaaatgactctgacagttttcctcttcttatctaaattcttgagggtcacccacacttcccaatgtcttttgaaacttgacctcttttctgctgaattgaggaagatacctgatttctttaacctcaccaaattcctacttcttactgttgttcattgctggctgaaaatttactttggcgagttcaccaagaacatacttatcggttcactgtttatatttgcactcaagataacacttgaggccctgctactcaaagaatttagtgacaactttcttcatcactctcatatcttatctgtcatcaagtctttttttcctcgtaaaaatgcttttagctctttaagtatgtttcatatctataatagctaagataggctaacagctataatatattaaacatccaccaaatggactattaaaatgacttaaacaaaatagaaatgtatttctttctcatgtaaacagtctaaggtgaattcatgttagttggtgttggatgtgtgtgtgggaagggaggggtgacacccacataattattcaagaatacaggccaggccaggtgcagtggctcacacctgtaatcccagcactttgggaggccaaggtgggcggatcacctgaggtcaggagctcgagaccatcctggccaacatgatgaaaccccatctctactaaaaatacaaaaaatagctaggagtggtggtgggcacctgtaatcccagctacttgggaggctgaagcaggagaatcacttgaagccgggaggcggaggttgcagtgagacaagatcatgccactgcactccagcctggcgacagagcaagactctatctaaaaaaaataaaataaaataaaaataaaaaataaaaaataaattaaaaaaaaaacaggccagcaagggtcttccatctgcaatagccaattgccgaggttgccctcctgaagatattcagccagcccaaaggggaatgagctagaggactgcacacggaggcgtcccatgtcctttgactcaaccttctactggctagaactctgccctgtggccacatgtaacagcagaggggctggaaaatgaagtctagctagatacctaaaaagaagcagagaaaggtttcaagagcatttagcaaccatatccaccttattcatgccctgccctctattcgcagtggccccgcagcactgctcaactagcttgctgcattggcctcttatctcttatctattgccttagatccatctaaatgctctgctactcttatgcctggaatatgttttcaagatgtgactaatcctctcacagcttgaaggataaaaggtcaaactgctctggtgaatgcatgatgcctggtcacctctgtagccccatcttccctgacactttcacagacagtattccctttactccaacctgtgggagtattttctaattcacaataatagcaggaaatacaatgtggaccagacacagttctgagcagtatattaactcatgcatttcttacgataactttataaggttgacagtagtagtatccctatttcacagagaaggaaagagatacagataagtaatttacatatgatctcacagatagtaagtggtacagcttgagtgcatatgactcaaagggtagaggttctagattcttaatcactgtattgtactacttctcccaatgttatcgtacatgccattccgtcttcctggaatacccttcgtctttcttcatctaacttccactcaaactttaaggatcaatttaagcatgccttattttaggtagccatggttgacatcagcctaatttaattgctactcatctatgtccccatagcgtcctttgcattcctctatatctctctgctatagcagtaaatgtaccaccattccgtaaaatccttaagggaatgtttagttttatgttcccaatgccagcacaatgtccagaacagtgttgtcccatagaaatgagagccacctatgtaatcttaagtattctagtagccacgttctttaaaagtagaagtgaaactaatattttattgaccctgatatatccaacatattattatttcaatatgtaatcaataaaaagtattaataaaatttgctttttccattctaagtctttgaaatctggcatgtgtctttcaattgcatcccatctcaatttggacaccgtattttcattgaaaatatttggtctcacctgcacacgtatgtttattgcggcactatttacagtagcaaagacttggaaccaacccaaatgtccatcaatgatagaccggattaagaaaatgtggcacatatatatcatggaatactatgcagccataaagaggatgagttcaagtcctttgtagggacgtggatgaagctggaaaccatcattctgagcaaactatcacaaggacagaaaaccaaacaccacatgttcttactcacaggcgggaattgagcaatgagaacacttggacacagggtggggaacatcacacaccagggcctgtcgtggggtggggggaggggggagggatagcgttaggagatatacctaatgtaaatgacgagttaatgggtgcagcacaccaacatggcacatgtatacatatgtaacaaacccgcacgttgtgcacatgtgccctagaacttaaagtataataaaaaaaaaagaaaatatttggtctctatttacatttcataaactttatagttgaaaaaagaagattcacattcctaagttgttccaaacatacacaaaagtttttcaataactgaaccaagagtcaatttttaaatttatatttaaatttaataaaatggaataaaaatttgttaaacttcagtctctccgtctcactagcctgatttcaattgctcggtagctacctacagccagtggctcctgtgttagacagagcagcacagccctagaacacagtagatcctaaatcgatgtttattgaagaaattaatcaatgacagtgtagaaaatttgcagtgattatgtcagaatcaatagttctccacccattttctcccacactctcaaaagggccaagttttatatcaccaaatgatattcctcttacttctttctgagcagaaacagttttggaaattaagatctttttcaaattttccagactcggcattttagcagcgtttctatttgtaccaacaatgcctttctacctattttccttgcttcttaataagttaactttgtgcgaaggtcattttgtaggtcagtgtaatattgtgcattaagggcttctaagttttctggtattataagaactccttggtttccttctacttttcagaatggaaaatcctcagagcaattttcatctaaaagtgctgcatttaggttgtttcacaattccccaaccctgagtcaaatataggttggtgtatgagcagcagtgtctcttggctaatcaagagcgtctccttttgctacgctcagtgttagagaaatggagaaagtcagctgggtttagagattaggtgagagactcaggcatatcctttgataagtcataaatcatttcctgtttagaaaagcacatgtttagacacccataaaatctccaaatgaagggtgttttacttttccttcaaaatctcactgggaaaaggtacttctgactttccaagtgaataaaaataatgactcctgattaccatgtatgtttaaactgatttgcaaagcaagtgaaaaagagtctagtgagtagtgataagcatcttttagacatcagaagatgtactgatttaaaggtccgtatcattttataactagtatctattgagattcaaatggttattactctgtgtgaatctgtcttttctaattgtttttacttattttagaatatcgatttgtgaatattaaattcctaagttttccagcaatccagtgtttgttttggatatccagcctggatgcagaatagctgcagaaagttatcacaaattgatctctatattctgtttccgagtggcaattgtcaaaaatttggggtcatcggctacccctcccacccctaagaagttccttgtacttcctctttcaaaacactcacatcattgttcagtgcctcacttctctactaaaatgtaaccaaccacaaagatagggactatgtctttcctgtttactggtggattctcagtatctagcaccatgaccaatgttaatagacgttgaatcaattccagttgttacctcttcacactgggacaaaagtccttgcaagtattctgctgccatttgtatagattcaagccaaatatgtctcaaaacgatattacagatgatctcttcgttgttcctctgacaatttctttcccccctgcattgcttaacttgattgacaatgacccctactacttataacatgtgccttttaggtagtgcacttggcactacattttatgtgatagttttatgatgctaaagactatttgctgtgatgatgctgtgttctcacatggcatatccagatttatttatgctggtgaccaaaggcaggtagttaaccttgaaaataggttaaaatttgaaaggcagcaaatcttagggctagaatttataatttatctttaaggaatcttgaaaccaggtgtgaaggaagggacgtaggctagaagtacagaaacctgggttctgctccagcactgatgttaagagcaagttgcattgcttttctggaccttaattttctcttctggaaaatgaatagattaactggaacaaggaaggaaaatacgtgaatggcttccgtttctgtctcgtttacccctgaaagacatggctagtcagtcagctctgtatcagagcacttctcaaggcaatgctccaggtagctaccactcactaatgagagttagcacataggtaaaacctctttgtcatctctaggctacttcatgtttaagatactctccagctttaaaattctaataactctattagactgaaatttaagaatacgagaataatcatccctcaccatgaagagagagtctgaggaaaaaataatgagaacgaataacccttctcttttactacaattcaggactgccatgaagagccgtccagattgtgaaacatacaactcatgatgtgaatggtacttctttgtttttctcggtgtacaacttgcacagctgttcatggccctctgcttccacaaattcatttctaaatagctgtacctcagttctttgacttctagtatgtctaatttaatacacatttctagatttacgatatataagaaatatctccatgaaggaaaaatgtaatagcccatgcttttcattataatagaattttatgaaacaatgtcttttaaaaacagaaacatatgtactactacttcgcaggacattagcccttgtatataaatcaataatacaaaaaattcaaattaccaaggattagaaaagactgctgtgggatatcttctggtgcaagcatacagttatttatccatttctttcatgaatatttattgatgttccaaacattaggctagacactagagacacatcaataaataaaggaaataggtttgatctctatcttctttgatctgtagtttagtgggggaggaaggaaattaaacaagtaactactacaggttgaacatccctgatccaaaaacctgaaatccaaatgttccaaattccaaaactgtttgaatgctgacatgacatcacaaatggaaaactccacttctgacctcatgtgacaagtcacagtgaaaatgcaggcacaccacatagagtttattcagcatccccaagggaagaaagatcctctcagcccccgttagctgtgatatatcttttccacccacacccagattccatcatacaagcaaacccacaaaaggtacgaaaaatggcacatgtgcgggctagacgcgacaacggcaggtaccctacaatgtccagcatggggccaaaacctacgtgcattaatcactgtgtttgctggtatattctctggtggtgtcaagatattgttgaaaatgccctaaaggcctgcatgatatccatagggtaatgcaaatattccaaaacctgaaatttgaaatactttcagtcgcaagtattttggatatgagatattcaacctatagatggtaagggtattactatgatagtgctacgggtgtacatcaaggtaattgaccctggcttggcaggatgcagaaggctttcccaaggaagccttacctcagctgagacctgaagagaagcaggagttagacaggtcaagttggggatttggaggaggtggagtcccagcagatggaatactatgcataaaggcctggaagtgagaaagtcatgtcatgttatttcaagggactagaggaagcttagcaaactggaggcaagaagatagcttcagcacactattgaaattgtccaggtgagtaatgatgatagtgtaactaagttgtgatacctaggtatgtgagctgaacctatggagaaatgttctaggctagagaatctttaattggatatttaattatcagtatatacgtaattaaaaccttgcaagggtttgaaatggttcagagtaaagttcgtagatgagaagagggcctaggagtgaacccaggaaaatggcaaagtttcaggggtaaataaagaaaaataagctttcagtggagacagggaaatttgcagttcagtagataggagacagactaggttcgtgtgatgtcacagaatccaagggaagagaggttttcaagaaaaagtaacatttagaggtgtcaaatactacaaaagcatcatgaaagataagaccaaaatatatcctattaatttagcaacaaggaaggtattgacaacctttatgcaagtgatttcagtgttgattatggagaactcagtaattacttggtggtaactaaagaaccaagattgcagtacgttcaggcatgattgagaattgagaaagtgggggagcaagtgtaaaacaattattttaagacttttggctgcgatgggaagagagaaagggccatagtagcagaagatggatgtaggggcaggaagaacacactcttaaaagggtagtgacttacacatgtttaaatggcaatgagaagaagatggtagagagggagaggttgaggatgcaggagaaattagagataatcaatagcacaggtacttgagaaggcagaaagatgaaatttagaaattagcttcagataggaaggaaagtacagcttctattacaacatcaggggagaagggaaggaggatgggcatagctactggtagttttgtaagtttggtgaaaggttaagtaggattgttgtattggatttattttttattgaagtggaagctgcagctaaatgcccagtgatgaggaaggtgttggagtctgagatttaaggtgagtggcaatttgaaatagctgctctaggatcctatttaacagagaaaatgttgagtacacaatcagtgagcagttttaagtccactctattctgtttgcagtttcaagtacctttcattgcttctaagtttatgaaaactggttcacaatcttcttgtgcttcttatttctacctcttttccttctgttttctcacctccccagtttaaacagtcccgaattttttacaattaaatatacagcaactgccatgaaatctactgataaaagatactgcaaaatcagtttgggattgggttcattagcttacttattattatcaatcctaggccactaagcaaccttgcataaaatgcataaaatgaggagattctagtggaggatagttttcaattatctcattaatttcaggccatgtgactagtccaaatagatattataggccaagaagagcctatcttgagattttaactcccaggataggttttctacctgatcaaaagaatctaataactattcaatctcttcttaaatggtttggttttctgtgcaaacagttttacccttttagctgattttctaggtgttaaattaagaaaattctctcagatacttgttcatcatgtactaggatccctgatgtgttcagagttgtccaactttcaaagggctttgcattcagagtacctaatctaaaccctgatatcattcttttataacagaaaaccccggattagactgggacagtgtctgtcatgttcatcactgcatctccctcagtatttgtagaatgaatgaagggacaatggcaaactatagtcctaccatcacacttttggtagtgaggagaactgctgtaacttggaagattggagggggaaaaggtggctaaaacaatcatacagtaaactgggctgctatcaagagaaaccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatattcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgattttagtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagtttttaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggagttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaaatattgattattgccacaatttcagagcctgttattggtctattcagagattcaacttcttcctggtttagtcttgggagagtgtatgtgtcgaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctccttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaactcgacctttctctctggctgcccttaacattttttccttcatttcaacttggtgaatctgacaattatgtgtcttggagttgctcttctcgaggagtatctttgtggcgttctctgtatttcctgaatctgaacgttggcctgccttactagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattcgttattctagttatacattcttctaaatttttttcaaagtttttcaaaagcaatggcaacaaaagccaaaattgacaaatgggatctaattaaactcaagagcttctgcacagcaaaagaaactaccatcagagtgaacaggcaacctacaacatgggagaaaatttccgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcattaaaaagtcaggaaacaacaggtgctggagaggatgtggagaaataggaacactcttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatccaccatggaatactatgcagccataaaaaatgatgagttcatgtccgttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacgttagtgggtgcagcgcaccagcatggcacatgtatacatatgtaactaacctgcacaatgtgcacatgtaccctaaaacttagagtataataaaaaaaaaaaaaaaattaaaaaaaaaaaaaaaaaaaaaagagaaaccagtgctctattatctaggtatataccaaggttacccactgcttgactctcattattagccttctttgatgttctctggtacttgatgtctttcataactaatcaatgtattaatgtatccaatcatttactcgataactttattgaaagcaaaagcagttgcataccagctatcaagctggaagtgggagatacagccgcagacaaggcagatatggtcccagcccttaggagctcccagagtagcaggaggtttccccttccagtgtcttctctctgcttttcttcaaaaggaaaaggctgatgtgtataatataccatatctctttgaagttctctgattatggattttaggtttaaaccagttcttcatccatgactttataaattgaaaatccaggattttgctgtgttgttgtgttcttgttttgttttgatgtccctgttttctctagatacagttagaaatgtctaggaagaaatttttggttagtatgggagccccacaaagccatttttttaaacataaaatctgtattacatatcaggtatgaaatacagggggaatgaatcatttctccgtaaaggaaaatttaaagtaaatttcaggaaagtgaattctttcccgtttgcattaccgacagatgcagaaactttaatcgtcatttgctaagagggatatggcagataatacacaatagatgtcgtagcaacattcactcgcattctttttttttttttttaaagaaatctttctttcaagaagctattctaggatctttctcatgacagtgtcctagttcttatctttgctacacacaggctcacaaagtgttttctttgaagggcattttgttattggccctcttttcatttttcttttccgtagcaaacagaaccgaaggtgtttactccccacggtgagagggcacctgggtgcacaaacagtggtgtgaaccactggcctttctctgctttccgttccctgaatgtaagaaacaggtgcagtgatcaattcactgcgtgcagtgaaccccaggcagaaagagaacgtcgtgtcacagaccttttgttacttggagagaatgagcgggaagaaaggctgcctctgctgctactgagacccttttgcccattttattgactgctataggttcatctatcctaatttgtctccggctgtcccagtttatccctgttattcttgtgttactttactttactatattttattttattttattttatttattttagagacagagtcttgctctgtcacccaggctggagtggagtggcatgatcatagctcactgcagcctcaaactcctgagctcaagcaatcctcctccttcagcctactgagtagccaggattatagctgtgcaccactatgcccacctaattttttttttttttgaaatggagtctcgctctgtcacccaagctgcagtgcagtggtgcgatctcggctcactgcaacctccacctcccgggttcaagcgattctcctgcctcagcctcctgagtagctgggattacaggtgcccaccaccatgccctgctaatttttgtatttttagtagagacagggtttcgccatgttggccaggctgttctcaaactcctttaactgtttttttatttttatttttaatttttaaaacatattgtagagataagagtcatgctacattgcccaggctgatctcaaactcctggcttcaagcaatactcctacctcggcctcccaaagcacctggattacaggcatgagccagtgtgcctgaccctgtgtgattattattagcatcctggacactctcaaaagtgttcaggtttggacaatgaactataggatcaccctaattacatgagattaagagtagagaccttgaccaccagaaatggtcaatactcaccatatattttcttcctgatgttagaacctggtacttttgggaaatgaaattgtacatgagatatatgcagaatgggcgaagggagcgaaaagatttaaaaaattaagctcgatttattgagcgcctcgagtgcgctcagtgctgttccaagtgctgacagcagagaggtaagttctgttctccagtgttcacctcacacgtgcaagccaggtttgaaaacacactgtctttccttagtatccctccacccctccatgtgactatacgtatgtatcaagtttgtgatatttcacttctgggcttcttttcatttggaaatttaatgtcagtgtatcatgttttaattaataggacatcatgttatgaaactgttgaatcgaatattttccctaggcatcaaattacttgtcagtggaaatttgacatctagatatgagggacaaaagagatgagaaaaataatagtaaagtgttcctaaaggatgctggtatactgtttaggtattttaatgcactgttacaacctaaagtgtcttgtaaagtatgttctttagaaataaaataaataaaacaagacatctctccataggtacaaatccacttgccttcctcaattcctatccttctgtgatgggaaatctctgctgtgacaaagaaccatgttaagaaaaccataaagttgtattgtttgtagatttttttaatgactaaaggaagatattgcaagtagtagaaacaaatagaggaggtggccctgaaggtcaatataacggagttcactgcagaaaagagaaactactctaggtacgttagacacatatcaaagttttggaaaggctaaagtagcaggttttagacttggcttcgaggacagatttctaaaactatatagaactgatccaataagaaactaccatctccggggtaccactgaagcaatgatttcaagaacatactttgtaaataggaactaggaaccaggaggttgaaatctagacgctaccacttttgaagctgctgttagcaactgcccttctccagccaggaagctggagaaagaactttggaactctgatgtaggaaatctcatgtttctttgactaagctcgccaacagaaatagccaaaaggggcagaaaggtgacctatgcctcacttccactttccagatctctcacaagtatacacatttggcaaaacgttgccagatttagcaaataaaaataatgcatgcaacatacttaacactaaataaaaaaagattgtgtagaaaatttaaatttaactgggtgccttgtattttatctgacaaccctaacttattatatcctaattcataatcagaacactagctgcatggaagtctggcaaatacagtttttaatttccaacctgtccaactggaaggatggtaagtagatttaggtgagccagttcacagtattaaccaaagtagattgcctaccaagaatagctaaagcctttctgcccccagacgcttatgctaccatctgaatatttttactttgcattcttatattcttggaaatcctatcaatctgtgattcagattggtttggtttaactcagcttccccttttttttggagacagggtcataccctgtcacccaggctggagtgcagtggcacaatcatggctcactgcaacttcgacatccctgggctcaggtgatcctccctcccacctcagcctcccaagtggctgggactacaggcacgtgccaccacaccccgctactttttgtattttctgtagaaacagagtttcgccacattgcctaagctggtctcagattcctgggctgaagtgatccacccaccttggcctgacaacgtgctggaattacagatgtgagccaccatgcccagcccctctttttaaaatataaaaatctcccagaatgtgaaagttgtcagtctatactttgggaataagattttcaacagatagaagagaatgaggattaaaacataaggaagtttgggagtagaaaatatgggcaccagaaggtggaaggagagagcagatgcccatttatatatctcctttgttgggtgttggacaaatccaggtcttaaaataggaagtatttcttttccgtacttcttgaatctttcatatcccaaaagatgcatatttcccaaatcatataacccaaagtcatgctatcaaaatgatataaatcatccatggtataggttaaatagctatatatgtatatgctggtctgagacatgtatatgactattgtgtccatggaaatttgagtttggggttctggaccatttatttgcaagtgatttttggttagagaactctttgtaagttggggattgcttttacttattttatgagtaaagatgtcaaaaggatgactgctaaatttgcactgtgttaattcactatttagtgagaagaaatattagactagctatgaaaagtaaaactgcctctccaaaaagtcaaagctgatgaaaaacagtcatacaagcacaatgccgctcttcggaaacatggaaacactttttccttcccaattttccctcagattttctcttccgcatttaaaacacttgggtggttcaagtttctaggctaccactgattgtaacagcaaacagtagcaactggaagcagtgggatgttgggagaagtaatagaggtagctgctacccaagttatcctggaggattttccatggcaatgaaatcaggtagtagaagcttggctaactgagtgtaagcaaacagttctactgagaatggtgttgtcttttcaatccgtttatctgtgatggtgatagtgtgaaacaggggaattttatccaaggtttaaggaaggttatttggttaaaagaggatattgttacagtgaagtcaaactttccattaactttttgctgtaacaacagattgaacgtagcatttcaccgtcaacgagtaaagtgaaatttacagattaacttatgtgcctcttttaaaatatatcagatttctaaattgcttttatttcagaggtatgggaggttcactttctctttgaaagtgtacattatttttctagtgtcttacatctgcctacaaagatgttattttacttgaaagcacagtaactatttgatgagaatttgtcagcatcagtaaattaaagaccctcaaatgatttctactaattatagtttaattccgtacatttaatgatattttaaaacacatgagttatttcataactcccaacatcacaaggataaattttattctacaaacaaaatattgtgctaaatgaaatagttcatttaggcaaagaaaggagcacagaaaattagtggaactctctgctgtaagtaacgtagacattacatggcatattgagtctccatgaatattgtcatgttatgttttaaaaaggtgatcgaacatatggcatttaaaagttccaagtcctcttttaaatgcttcagaatctattatttaatgatcatcttggatctcaaaactgatcttttgaaagattttattcgccccatgtgttaatatgatttccctgtcatatgatatgattatctatcaatacttaaaaccagcagccaagtaaaaaatcagttcatatcatttaatgaatactatgagtcaggatctgggtaggcaagctattttcgggtttgagtagttccaaagcttaaaaatcttatattgattttacagtgaagaagaaatagtcttagctactttggaggtttcaaacattgactactcaaggagtatttccttgctttctcaggcaccaggcagtttttcaggagcaagcattcatccattcagggaattgtaacctgtagtttccacttttctagcaatcacacttaaaaccatgagagtaggccataggacataaggagctcagcttctcagggcaagcacatcctttcagctttcacctgtccgtttgttagtgttcacttccgtgctcaaggagtttcttgttgcctctgagttctaagagacagaacgaagggagaagggtgcagaagtctaacgcatgttcatggacttatctctccaataaagagcttgttttatcttcttttatttatttattttttctaatgaagccattagcctcaaacaaagccatggaatcttatcagagtgaaaccggggtcattccataggctggctgagtgagagctccatggcacgatgatgtatggtcactgcacaacaacgcctttgccacaacacatgtgccttttaattacactttaaatctcatttgaagagatgttatcattatggaaattgctctgtaaatgtgcccaggatgagacccaataaaagtttgctgagaagaattgaagacagaggagatgaatcagcagctaaaacattaccatcagacagaattttcttggctgtaggcaaaacagcccatgcaataacagaaaatcttcattgactcagaggcgtattttccctagattattatggggcactcctgcctgtagcactatcacttctttgataagctgaaggaagcgttctgctctccagctcagcgggcctttttctccccaacctcagagccatcatttgaatttatagttgccaaaatgaataatacagtattgcccttgtgttcctgacttcatgcatgcatgcagagcggggttaaggttctttaaatgaaagattgccttctattcatgcaataaagaacacctctgcttcctttccagggtcatttaaaaataactataccgctgggctatgggaaagcacataagaaagattcttagggtaaagtcaaaatgctcttttctctacaacaggcattgtctcatatctttgtgtagcacagctgatttgaagttttcttttaagcacattcttaattatcttttcctttgatcttgaactgtttccctgggctaccagacagagagcctagagccctacctccgctttccccgaggtgcaaactgctccgtccttccacaggcaggcccctggctgaatgcacccttttctccatggttacccacccacctctctgttatttgttacttcccaagtgaatggcaggttaaaatgggaaaaggtcaggttatctgaatgtggttagagtgaaatgaatttcctcattgcacccaagaactgtcctttgacaggtctccttccccaaatcgggtcattttgtacgtaggctcactgggagtaattctaagacaactaaataagtaaaatcacattttggtgccattttccaatgtattcttcttcttgggggttctcctttaaaatggtactggaaggatacgttgtcttcattaatccattgtatgtcccgggggtggaggtggaggtggcagtagcagaagcccgtgaagtaataggtcgtattttgtgtttataaatatttctgcaggtttttgaggagaagatccatcattcttataaaggcattcatgacctccagaagattaagggctgttatgctagaacagtgtttcattcttaaaatggggtctctggactagcagtatcggcatcacttgggaacttctaagaaatgcaaattcttgagttctaccccagacatacagaatcatgatctctcagagtggagcccagcagcctgtgttttaatgagccctctgggtgattctcaagcccactcaagtttgagaaccactgtactaagggaactactgatgcatgatgcaagttcacgctcacaggcacgtgtgaatgacacaaagaacacagacgcctgagagagcaagaaagacaacatagactgtctgactccctgctgggcccttctttaccgcccctatttcaggctaccatgcccatgagtggatgacacgtaccccccgacaaaggtcaacaccactctcccttccacaccctatcactaagtgacaggctaagcctatgttaaactgctcacatctccttggaaattcaacactttaataataggtagcattatcacccccatcttcttctctaagccagaaacccaacttgcctccctatatgttatccttgcattcagtcagtctctaagttgtattcatgatctctcaaaaatatctccctttttctcatcctgtgtctattacctcagtttagatctccatattctcttgcctctaatgttcttgcctctaatgtaccttttcactgccaccaagatgatgttaccaaaaaatcttaaacagattagacatcttcacaggataaagtccaaacccttagcttgatacacaagccccttcacaatccaggccctccttcctgtgcagctatatatatatatatatatatatagagagagagagagagagagagagagagagagagagagaaattttgatcttaccactctgtctctcttcccgccatgggtcttcccctcttccctccggagttacttagctctgatgtgtattcttatctcgtcttatcttcaacttcattcatgtttttcccactgcttcaaatttcactctcccacttctcccctggccagctgctactcatccctcaagaccctgatcaaatatcatcacttgtatgatggcatctgcaaatcttggggggcaaggctaattgttctttgttcccacagggctgtgttccagtttaacatgatcacatgttattttggttcatttatttgcttaagactttttcagaaggctatgggctctttaaaatagagaacttacatcttgtagttttaagagtatttttagtaaaagtttagagtgacccccatctttctgccagcccacaaaaggaaaacatcaaaaagtgaatgtgtaaaaggaagagaactctgacaaaaccaggcagaaaggtttttcagcaagtctttttattttctgttcaggataacattaataattatccacgttggtttctcattctcctgttggtgaatatttttctgctaaatttaaaaccgtatcacaaactcaagcagagatttacaacatttcaacagcttttctacccctgccttagaagggtggatcaaaaacatttgtccatggtaaagcactatggacatgacttagttaacaattctctgtttgggtcaccatgaggcttcttcgtttatactcagggtcagcgacaatgctgatatgcagctacaatttctcatttcttactcagggtgttatgaagcagatttccactgttctttaatcgttattaaaatgtagtccaggtgcagtggctcacgcctataatcccagcactttgggaagctgaggcaggtgggtcacataaggttaggagttcgacaccagcctggccaacatggtgaaaccctgtctctactaaaaataaaaaaactggccgggcatggtggcaggtgcctgtaatcccagctactcaggaggctgaggcaggagaatcgcttgaacccaggagggggacagaggttgcagtgagccgagatcacaccattgcactccagcctgggcgacaagagcaaaactctgtctcaaaaaaaaaaaaaagtcattctcatgtaaaaattcttgtaaaataatctgtaaagtcatcctcttatctgttctagttcttcataagacttatataacatgtcatatgggcatggaaaggcctaagccttcccaaaccttgctcttttggggatgattttccaaatgtacttgttctcagttgaaaagagcattgcggccgggcgcggtggctcaacgcctgtaatcccagcactttgggaggctgaggtgggcagatcacgaggtcaggagatcgagaccatcctggctaacatggtgacaccccgtatctacttaaaatacaaaaaattagccgggcgtggtggcgggcgcctgtagtcccagctacttgggaggctgaggcaggagaatggcgtgaacccgggaggtggagcttgcagtgagccgagatcgcgccactgcactccagcctgggcaacagagcaagactccgtctcaaaaaaaaagaagaagaaaagaacattgcatcatggcacaaggacacaaaaaataccctggacctgcttcagtgagatggtctaagggtctctagcatcttctgaactgaactgaatgctttgggaagaattaatagatacacgatgtatattagttcgtttcacactgctataaagaacttccctgagactggggtaatttatttaaagaaaaagaggtttagttgactcacagttctgtgtggctggggaggcctcaggaaacttataatcatggtggaaagcaaaggggaaggaagcaccttcacaaggcagcaggagagagagagaaagagtgaatgggaagagccccttataaaaccatcaaatctcatgagaactcactcactatcacatgggaaaacagcatgggggaagccacccccatgatccaatcacctcccaccaggttcccccggattacagttctagatgagatttgggtgaggacacaaagccaaaccatatcacaatggaaagctcatgaatgggttctaagaatgaggaaatgtaccttagcattttgcctacttttcctttatgacatttttttcccggcaaatatgccaaatattacctacctttacatcagtgtccacatgcatatcccctgtcttcctccttttcctcatacattaacaaaagagtaactttgttttctccccatcactgttcaccctattgtataagagaagaaaagcaaaataggatgaaagaactatctaggcacacacacaaaagtcacactctccagaagaaagaatttgctctacttggtagtagacagaaattaactcactgaagatcaccagagaatcagatccaattatatcagcaggactttagtttacatcatggtactagaaccttctttaacattcaaaacttatgaatacctagaaatagttttaaggttaatatctctatgctgtgggctaaagagtacccacaaatgaatacagttgtgtctgatgagtgtctgtgattattttggaaattgtcctgctatttaaaatgaaaaaaatagaaatgtcttagattttcctatcattaacctattgtaaacaattacatcagtgtagggttgttttgtggttgcgtgggagtattttgaggtttttagggggtaaagtgggggatagaatgaagttgttgtttgcatttacaaccctaataattaaaacaagccagagggaattacctacatggctgttgtgatttctagtgtatgatcaaaaataattatggcactttgccatatgttcttgctttcttcttagatatgtgttattgggaaaagatgagacttgacatcaactaattgcttttttctaatatacaaccttgaaccacagtgattctctggaggacaaaaaatagcttagtgacaaagagattccagaaataagagcttttcgagcttttaactctctatgtaatatagacaaattgcacagattaatataaccaaatatgtattggtccatgggaagagagttacctatttgaagaataggagtgtattgtgttcatttagaaccattcagaaacatcaatgatattagttctgagttgactaaggataaatttttaaaagcaatacctaattggaaaattattcagttgttgaccattcctatcagtgctctgaaactaaatatctcacagatgccttaatgagttattataattatgttgctgtgatacatgtagcccaagtcagaagtcacttgctttgtatttaatggatggggaagacactggagcttggagggaagagaataaaaataacctagtttcaggaagatctatgctctaaccctgcttctgccacataacaacaactctatgatttgtataagttactttacctctcaaactcgtggtttcctcgataggggataaagaaggcctatttcatagagttggtgtaaaggatttataagggctgtaagtattagttcctgccctgtttcatccccctaccctacccccacccctcatcatggctctgcaaaaacaaatatgtctcagagttggaaagacccatctggtctttctcagataagggtagttttcttcaaacagactgattcctgcacataaaatataatataaaaaaccaaaagtaccttcaacattgtagacttttcatatgtggttgtctctgtgacttaaatgtacaatctagggtttgcatgttaaggtctttcaagattactgttggcactgatctgaaagatgtctcatgcaggaaatgctacccaattatgagcactgaggctgtatagcaatatcagaaataatattgcagcacagtattttctatggattttagatgcagtattaaaaaaagaaaactcagcctgtctttaagactcgttttctctttcaacaccagaattaaaaggcatgccattcttttttaaagtttatgtgcagagccaaatgaatatcaacattagttctccactgggtccacggcttctttttaaaaatatctgaagcagtgttactctacccactttttctcaggaaattgtgtcctttagaactggcacccatatagtttaggaatgcttgatagggtatattttaggtgggagtcacctgtgcctatatggagctttgatgtcaatgcccttgtcatttggtgtcaatggttttgtcattctaatttatttggccccaaggtgtgtgtgtgtgtgtgtgtgtgtgtgtgtgtgtgtgtgtgtgtgtttgaaacacagcatatgtatttttttcttactccttgagaaatagaactttaaataacatttctatctttaaaatgtacttgtgaatagttatcactttcctgaattctaccttccaaaggtaggacaagagaaggatggaattaaatcacacatgcagctatttttataacttatgagcactcaatgatggtagcatccctcttctttaccttctctctgattctgaagccactgctgttttggttcctgtatggctgggactgcctgtccactagacttcctgccttcactctgaccctgctacatttaccctgaacaccatcctcccaataatcattaccagatgctattttcacaatgttacacctttacacaagaagctacagtggaatattatccttacagaatcagataaaaatctccaggcggcattctaagctctcattggctacactgtaccctttgaacctgaacttcctgagaactacctcttagctcctgcctgtagctctggctcccatcttcatgcagtaggtattcgttttcttttgaacggcctcatatcttctctgctagcaggattggagtcatggcagaaagtgagagggggactagaaggatgcaacattaatgaaacctcacaataggttaggcattgggttaggtacttggttgatctactcacatcatctcatctaatctttgccaaaaccttaaaaggtaggtattatcggccctacttatagacatacaataggtacttaatgcacatttttgtgatgaataaatattcgggaatttttgcattgtgactggatgagaagaaactaggaaaaacaagacgtagatgagaaagatacctctcatcttacttccaacctaggagatcttaaatgaactcatcagttttaaaaggtaatcttaagaatggagtcagagggtcacacaaggagagaaagcatcacgtattaccagagttcgggattgcttaaggcggtttgacagtttcctccgggggtaatccaccctaggccaggcatttttaaagattagattttgaaatgaagctttgcacttgggaatatactgaggcaagaaagcatatcccttctccctgctgagagagcatatcccttctctctgctgttgcagtgcttaagtgtgagaattttcgaatgagatatgaaagcaaagacaacaaaccctgcaggataatagtctctgaggactttaataacagccgtttttaaagcaaagcctgtggactcctaaatccatagctgctcgtttaagatgcaacgcaatgcagtggacctgaaaacatactccttatctacctagagcaaccaggctccaagccaaacagcagtcctcaaattaactcttgtttctcttgggacgacaactctgctgcttttaaaggtgttgcgtggccacatatagaataagaagggaaaaaacagtcacaccctcttgtgagtctgtatccaactgcattttctgatctggttaggaacctccggtggttagattagaatcctgataaggccaagactgtgggtccaatttcttcctatggattcttctcgaaaaacttgttaggaaagatccacttcgggtttttttttttttttttttgcgcttgttttaattcccaatccataatagactgatacttttgtaacatgcaataaaaatgaattattttaaaaattacaaataccagacatacaaaatttaagccgatgctttttatttttagattgctgtacacgtttctaaagatttgctttcaatttctgttcttatgtcttcataatagaatatctgtttctgtgtgtgtatacgtatgagtgtatgcaagtgtgctccaaaagctctactatttagagctcatgtttaatgagtcatgttggataaccagtctaagggagttctactttcatataattgtttttgttttatttttatttaaatcattaacaccttttcaaaacaactgtatcaaataacagtcatttggtcatttgaagcatttacatacactgctttcttcttaaacagattttactgaatgtaaatctgctttccctggctaattcagcatcatcatcctgagcattaactattttgcttcgctataaaacgaggtgatgccttcaagggctactgatgcatggagagctgttagtttccacactgtgtgaccctggtcaattatgcatgcccatggctccttttacacctttctgattctctgtaaggtgtcacttcttcctactctcaatttagccacttaggataatttctttactattttgaattgtatgttcctgaccttctaagttcttagaaatcagaccactttttttcccatcaagctaatttaaattagataaaaattatcagtaaggaggaactaatggccttataattattcatatactaactgctttcagaaaagcttagagataatctgtctataataaaattcttaaggagatttggtcacttattgttattctttctacaccattgtgtttgtttccttacttctcagctatattaaaatggggaagttttcatttgctgagtcctattttagagaccaataattccatttacataggaaaggaaatatgtggatacgattattcatgatgttctagaatagtatcacaaccatctgcttaatggttaataaaatggttaataataaaaagaagggtacagcactaattcttgacatctcccttctttatttttcttctagtaaaacatccataacttttcctattcttccccagttgtattattacttatgaacaccatggatcattctactttttgaatgaaatagtacaaatttaatattcgataatcttgtctttgtacttttctttctaaacttttattctcggtggcttcctaaaggaagactttattctacttggtttaagcagttggtctgcattctacctatttctctcaactctcattgtccattccaatcaggttgtgcaattcattgtccctgctcataaaccaaattcatttcacctttactccattcccatgctattctttttacctggaatattttcttttgttccaatttcccaatcgtatacatccctcaaggctcaagccaagtcctgtaacttcatgaaatctatttctaacatctgatttccacatggattatcttgtaatagtaagccctgcatttgctattatttattaaagatctcttgtgttctagacgctattcaaagtattttacaaaaattccatgtaatattcaaaaaattcagcaggtatgtattattatttcatgtttagtgaaaccaaagtaatgaaagagttttcatcattatgtggctaataagggaaagagaagagaagggtcaaacctatgtctatttaactgcactttgccatgagttttctctggaagctgagaaaggagattcacaacaagagtagatgagactcagataagaaggaagtgtggaatttgaaaaagcccttcagaaaacaggatctcccctactcctaaaactgctatactgtgaacatattgcttgtctcataactgaacttttttggtactctcagctgaaatttgctctataattgtacagaactttaggccaaatgtttcttttatggggacacacattatttgtttcgtttgcacccattttctcaattactttgtgttttctcttgttgtattggatgcatctctatccactgctacaaatctgtttaatagtctttatattaataagaccatgaaattgctctttgtgtgctgacatagttatcctttattttctaatggcagtgctagatttgctaaaatttaggtagtagcattattaataggaaaaactaccaccaacaactaaacttgaaaggtaatatagcctagtggctaagagcacaatccctgaagtctgactgacgaggttctaaatcttgctgcatttattagctgtgtgaacctgggcatttttagttaaccttacagtagtttcattatcttatatggaaaatgaagataatagtagcccctaccctagagggttgttgagaggagaaaatgagctcatgtatatacagtgctttggacagcacctgatgtacagtaaggttcatgtatgttgttgttcttgctgctgctgctgctgctatggtttttgttatgtaacaactaccttttcccctttgttcattcgttattgcttttcctaaagactacaatcacaaaaaagaagaaaaaaattagagagcatacagtgaatgcagtaatgaaggcttgaatgatcttttctagttaagtcagaagtgaaataaaactatccaaaaatttctatgaaaattatcctttgtccagattggctacccactgagaactccacttgattctccatatcaatcttttgctcttttgtgctacctgagtctgaggtgtagtctttaaatgatgagtttattggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtatatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatgcaacttacaagggatgtgaaggacctcttcaaggagaactacaaaccactgctcaaggaaataaaagaggacacaaacaaatggaagaacattccatgctcatgggtaggaagaatcaatattgtgaaaatggccatactgcccaaggtgatttacagattcaatgccatccccatcaagctaccaatgcctttcttcacagaattggaaaaaactactttaaagttcatatggaaccaaaaaagagcccacatcgccaagtcaatcctgagccaaaagaacaaagctggaggcatcacactagctgacttcaaactatactacaaggctacagtaaccaaaacaacatggtactggtaccaaaacagagatatagatcagtggaacagaacagagccctcagaaataatgccgcatatctacaactatctgatctttaacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatgtacaagaaaaaaacaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcatttaaaagtcaggaaacaacaggtgctggagaggatgtggagaaataggaacacttctacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacagtgatagactggattaagaaaatgtggcacatatacaccatggaatactatgcagccataaaaaaaggatgagttcacatcctttgtagggacatggatgaaattggaaatcattattctcagtaaactatcacaagaacagaacaccaaacaccgcatattctcactcataggtgggaattgaacaatgagaacacatggacacaggaaggggaacatcacactctggggactgttgtggggtggggggaggggggagggatagcattgggagatatacctaatgctagatgatgagttagtgggtgcagcgcaccagcatggcacatgtatacatatgtaactaacctgcacgttgtgcacatgtaccctaaaatttaaagtataataataataataaataaataaataaataaataaaaaatgatgagtttagacaaatatcattatggtagtattatattatgttatgttatattatattatattatattatgtataatgtatattccttgcagcctgccctgcattcccaatctatgactcatgctgccttattgatactgaaaaatctccactacagcatgccagcttttgaaagagagccttgggttctttcccaatacttaccttccttttagggcaacctatctgagtcctgtagcttgaaagatttcctaccagcctgccatcccaaaggaacatggatgaactatgtttatgctgatgtgtcaagtcatttcttggtatggttcatagtagtccacatggctcttgtagacaaagagatgaattactgatggcagaatttctgttctggcaacagggaaatttgcagaaaggagaccttttcagtgtgaacattttttgctcacaggtggtccaggatgcccaatgctaaatgagaagtgaaaagagcaatcagggccaggtgtggtggctcacgcctgtaatccaagcactttgggaggccaaggtgggcggatcacgaggtcaggagatcgagaccatcctggctaacatggtgaaaccctgtttctactaaaaatacaaaaaaaattagccaggcgtggtggcgggcgcctatagtcccagctacttgggaggctgaggcaggagaatggcgtgaacctgggaggcggagcttgcagtgagccaagatcgcgccactgtgctccagcctgggtgacagagcgagactctgtctcaaaaaaaaaaaaaaaaaaagagcagtcagaattcaatttttcattcagaacaaatcaatccacgtgggtaaacattttatcaaactcaagaatgctgtctttcagggtgcttttccctcaacagtcacttatttcctcttgcaagtagtatcttcgttcaggttcagtgactactgtgtattatatccaatgcttctggcaagtgggttggtggaggcagcccaagatcttctagaatcaagagaattggatccatttcccagttctaacacttatcagctatatggcttttaggcaagtcagttaaacatccgagtctcagtgctctcatctgcaaaacagaaaatgtgatgtacttcacagagccagggggaggaataactaaggtggtacatttgtacgtgctttgtaacctgtaaagccctttactgtacacgtgtcatttacagctctgtatcaccatcatgacctagaaaagcagtactgacagaagacttatcttcttgccaatgctaagataactttagccatttctgcatttctaaaggaaggagtctttatcccagtatctatgaagacttggcaggaattgccgtcaatatttagttggtaatataaacgaattaaacaaaaatgcacactaggttttaggaaaattaaagacagaactatcatttgtactcctcttacatttcccaaagtgctaaaactagacaataaatcagtcctcaataaatgcttgtttatcaattttatattcatttatttgttgataatacaacaaagatgtttatatgcagtataatatatatggcaaagatgaaaagtagcaaattcatgaatcaacatcctatttatgcttgagaagacaaagaaagtgttggtgacttcatggtatacataaccttaaggagctcgtgattgagcctgggtctctgctatcaatgtaggatataaatttcaaatgtactatcctttatatgtatgttaatgtagtaaacatagaaaactgatgctactagtgagaatacttttacttgaacaactaaaagtttgtctttaatcccctaagtgcatacacaaaaggaaagtactgtacaaatcaagtacaacagaagaagtaaagtaaaagacaagtgaaggaattatctggaacttagatctggttggctttttctcctgaagtacttagataaattaactcacttttctcttttgctgaagaagtgcaaattaggcaggcatgttattccacgtaggcaaaaggaaaaaagaaagaaaaacataaaatggctatatatttgaccaaacttcgttctgcaagaatcccaatactaaccttctaccatataaactactttcaaaatcaggctatatccttccagtacaaacctggtttgtactactcagagatactactcagaaatactttcagtatttcccttctttcaacttctgatgtgattctatccatattcccctgcctgtctcccagtcaaagagaatgggacacaactctctttagagtccatcagtgatgctttagctgccaaaaatagtgacaatagacattcattgtctgtctaccttacttgttcaacattcagaattctgcatcttaagaggctgtggctgaaaacttgagccagttcttcagaatttctaacatgttatttctgccactttttctcccttactttagcagagtaatttaattcaatttgagagagagagagaaaaaaaaaacttttctagttacacagatcaatccaattgtttggagcttcagaatgaatttttaaacttgttgaacagaagcatacaaatctctaagagcaagtcagataatatacaaagcctccattcattgtgtaggcagaaaggaatgctggtacccggcagctctctgaggaatgttcccttggctttgactattctgctgggaacaaggaaggaaacacatatataaaatgaatttataatgtctctggcttgtaatggcagaatgataagaaaagttggctgtttaatataaactgtcagttgcatattccaggcctcctctctttgaggttcctcccacatccacacgcctggctactgtttagtgcggagtacaaagtggccgtttattattattgactggtgaggcctgtgctccaaaattcattctgtcaacagaatgtaagcaaagttggcattttaaagcagggctctttcagtttctgggttttctcaggattgctatgcaacaggatcagtgctgtagtgcccggttcaagctgaaaatgttacacaggaagacataccatgtaaaggtcagattcttctactataataattttcttgatctgtgtgtatacaagtgaagttgaatgcataacctcttatcataactcttaccaaggtcctatgtactttccacctgtcaagcctaaaaatgtgtattaaatgggaaatcaaaactaataaatgtatgatgctgtactatatgtatgatgctataataccaaggtgaacttaatttgtgttgtcaagaagattttctctcccatgacagactcccaggaatgtgctggtgctgtgggccaagtgcaatcttgtttattagtctctccacgcttttatggtcagagttaactctacagattactacgtaaatagaaaatatgacttgatccatatagtaatgaaattattggcactggggtacactttatcatagaattttattgcctatcacttccataaaataatacattttgtccatagactagaagatataacttgtgaactttataaagttataaatacattactttccaactcataatggcaaggaataaatctattacaactaataagatgcccattttaaatctacataataacaggagaaggcaatacgccaagaaaagggatttgagatgtatcttcttgttagtttagcctgattgaaatgtcttttgaactaataattatttatattttgcaattctccaaattcacattcatcgcttgtttcttttgtttggtaattctgcacatattcttcttcctgctgtcctgtaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtaggaaaagatgtggagcaaaaaggccacaaatgaattaaaatggccaaattttcctcattgtcttagcacaagtaactggtatctcacatgtctacgtaaatcatccaatttcagaatgattcactgtattttgaataaatgaatcatttatttgcttggtatggagatgatacttgaggattcagattagattaaagtggtaatgttttataaacataggagacatgcatattaagacatcagagtgaatttaaatgaggagtgcagctattctagtttcataaatttctctcttggcatatcacagggttatacaaaaagtgataaaaaattaacggatatgtattatggaattatttttggcattagtctaaatgcataccagaggacagtctttaaaaccctttataacacattacaattatataatataaaacctgtaacacattataattaacagtttagaggagatagctcctacagttaaagagagactatagcaacttcctgtcttttgcttcctctcagattttgttaaaacacatcctctgtaaactaagcttttagttgtagtatactcacatactttatattttgcccccttctatgtgccagctttctttggagaagttagttaatggatgcatcatagcatctttgtaaaaagggcagagggaagttcttgttataccagttttgcaatagttccgtggaggaacaaaaggatagagatagtaagtaaaacgcccattgtaacttaaatgatctagcaagggcggggaatgaaagccaggcttcctgctttctaagcagttgcctttcttaattcatttctctttattaaaaatattttgtgctttcttctgtgtctagagaaaaagtgataatgaagggaggtagaagatgaccaaatggacttaataatagttatgggagtatacactaaatgacgggagtagttactacctctaggtagaaagattacagaagggagattttttttcttctttatagttcttctaacttgtccaaaattttaacatatatacttctataaggaggaaaatctgcatttttagtaattcagaagcactattgtaaatgtctgcatcaagtatgaaataatgatagcaactaatatttacatgatgtacctacataccacgcaatgccataagcactttccattcattgaccggtttaatgctctcagcaaccctaagaggtagattttattattgaattctttttacatttgaagaaagtgaggcacagagaggctaaataatttccttagggtcacttagcaagtggaagatacaagatgaaaacagggagtctgggtgggccaggcgtagtggctcacgcctgtaatcccagcactttgggaggccgaggcaggtggatcacgaggtcaagagatcgagaccatcctggccaacatggtgaaatcccgtctctaccaaaaatacaaaaattagctgggcatggtggcacgcgcctgtagtcccagctactcaggaggctgaggcaggagaatcgcttgaacccgggaggtggaggttgcagtgagccgagatcgcaccacttcactccagcctaggggacagagtgagactctgtctcaaaagaaaaaagaaaaaagtaaaagaaaaagaaatcagggagtctgacttcagagtctgaacttttaaccaccatatgataccgtagcatataaagaaagaaggaaacttctacaaagaaatgcatactaattgaaaggatgaaatagagagtagattttttctaggagtagaaaaggatttgtttttatgagaagtagattgctaggagtagaacaggtttatttttatgtataaggttttgttttgttttgtttttcacaagtttgcaccctggcttcccagacattgttccttatctccctattttgtatatgaattttgtgtcaacttggtggtggtacactgggagcaacaatggcaatagcattttcaaagatagggaggctctattagctttctacagcttaaactcttaagagaggtcagtatgtgtgatgacgtaggccactttgataaccttcgtcattaaaaaagaatgaaaatgtgagatggaaaaaatattggcaggtcaagttaagttattcttttctgcacaaaagaaaaagaaagatgctataattgttccgagtatcacttagtgccttttctctgcctcatgtgaacttgataaaataaaaggagaattgaaagtggcaaatagcatgtcagccaaaatatggactcttcattctcagcagtttcccatgtcagctaccgcagtttgattcttgctgtcattaatcaggtagaaaacagttagcttatctaaggtgctgccaattctagaatttaaatattcagatcaatggttttggcttttatataggcctatgtaataatacaggatatgttataagcactcataaaaagcaaagaagtaattctccacatcaaagcaatttagcttatttcctgacacttgattgaaattagggtattgatcaatctacagcaaatggcagggttcaattgagagaagtacagtataggcagtaattagggatgattatgaaatagaatagaataacactggaagagttagatatagaaccattagtggcactgataaacctgcattatgaatcttgtcacttcttccatgggggttattttaaaatgaaaagttgccacaattaaaaaatagtttcaatgatatactggaaaaataggcctgtgtttgcccaagttataacatattataaaaaattacagttggcccattgtttggtgagcgattctgaaactgctcttatatttcaaaaaaataaaaccattaatgtgtccatttttaaagaaacaaaattgaatttaaatccaaatgatttcgaagtttccctttgtattccattggctcataagagatatccttgtgcttccaaatacaagtccatattgtatcgttttccttccatttatttttcttctgccatacatcttttctcttcctgtgattaagattcttatttaagtcatcatgttatgccatattgatacatttgcaagaatactctaccttggacgctgtttatatcatattactcttttgttcaaagcttcaatcttgtaggtctccatatctccctcattcatttatttgttcattcaacaaatatttaatgaatgcctactatgtactaggcactcttctgggcacggaggatgcaaccatgaataaaacataccaaaaaaaatcactgctctaatgaagttatatttaatcattagaatctagtagaaccttctctctctgccaactgtgcctaataagtccttgctaactccttcccttctcttttctttttctgcctccagttcctttctcaccaagcatcattctgttactccccaacatagattctctgagccaagagaatcaataaattctattttctaaccccattcctactctccaacaatttcctcactctcccatatgagtatgtacccttgctggttctcacacttgcaacattctctttcctcttattctccaaattttgattcatattccataacaaatcttttcttttctggctgtttcctcactaggtcttcccaatactattctaatttacacttgataacatgtttcttcaagtgttcaagagttgctttatagggctatgcttactgcctccagctaacttatatgaatacaaaaatttcaaactcgaaatatgtgagtatggtagagtagaaagacatgggccagcagctgggcaacccagtttcccttctgttctattctgtcactaactgtcttagcatataatcttgatcaagtcacttaactgcttcagacttcaattttctccttcactgaaatgaagagtttgaccagaaatatggacagtctcttccagttctcttgcaatcgtacaattttattcttttagttctgcaatcacactttatgaacctggaaaattgtttaatttttctaccttggttttcttaattaaaatagaactgattgatttaaaaggcattatataaagtaattaagatgtctttgagagaaaagaaatttaattgaaattgtataatcctatctcataatttaattcaagaaaagtatatgctatcattccacatgcattattacatcacatgttggccaagaggtataaggaagaaaagtaagtagtcagtgataatttaagttccatcaaacaaaacgaaaacattaactgctttaagtgggagaaaaagagaaaattatttacttaaatgtacacacacatgcatacacacacagttactgatgacgttatccaatattaagatggtaattagtcaaagaaagtgtttttcattctaaaattccatatccacaatccttgcatttttaattttagaatattaataacttgagaagtggtcaagtcaattgttttacataagaaatatatatgaagatttcaatttagtctactactagattatttttccagatcattgtatatactattaactatgaaaatcacataatatgttatcaacataatttcagcagaatttacattatgtgagatttttatatttggcagaaaaatttgtaaatgttatataaaatgttcacatttatacaattgtgaacattaagaggcaaggacactgacattatatagtctgtagaagccataaatctattggggagtgcttgctattagaggttagaatagttagtgtctttgtataatggagaacaaaagaagggcaaaaagaggtggggtctacctttgagagaaaactgcaacttggacattgaatatctctgaccttctttctctctcttttagaatgttaattatgtttggatgttggagttcaagacctgtctagaaaaaaaaaatgttgacttctctttgggattctctctatttaaagagatagctcccattttaattctgtggttctttaattttttttgtttctgaagtacaaattcaaattattcatctgttgatgacaccctggagatttttctcagtgttctcttgtagtagtttcatggtttgaggtcttacatttaagtctttaatctactttgatttgatttttgtatatggtgagagataggggtctagattcattctgcatatggatatccagtttttccgcaccatttgttgaagagactgtcttttccccactgtatgttcttggcacctttgtcaaaaatgagttaactgtaggtgtgtggattcgtttttgggttctctagtcttttccatgggtctttgtgtctgtttttatggcagtattgtggttctttattatttctgcattcctcccttttctttctgcatgtttaagtgctattttattacatgagggtactaaagatttatagggatatatcattagttttataaaggaagtcaaagtgaaaaatgaattcaatataacacatttcactttaagaatgcatgcctttcagagtaaagttttattaaggatttcaaactaggcattaaccaaatcacagttgaaatatctgtgtctagagaaataacaatcactttatcagcccctataattcttagtgtcctgacactgaggagttccttaaagaccaagcaatatactccagcacatctaaaggctctgcgttttacctaaaccttacaaattgtggaaattatcagctttttagagattagcacttgccttgttaaacggtagtaacccctaagctcttgtcttcactaataaagattaatagacatagatagaagctaagcatgcccctttgaaccacctcttttattttccgttgagtgggtaggagtaagcagaatatatttgacaattagcaatgttaaaagacaaactttagacaaattccgttttgcagagtttatttgagcaaaaaacaattcatgaatcagacagtactcagaattagaagttcagaaagctccacccagcaaggtgggcaggcagtatttatagatagaaaaaggaagtgacatacagaaacagcttgactggttacagcttagaatttgccttacttgggcatagtgtaaataggcatttgccttatatggacatgagctgatcagtttacagcctgtgattagctgaaacttgactgctgggattggctgaggctcagctatttgttacaagaatgtactcttaagttgcatattgcttacatgccaagctgggttgcagtttgctatgtacagagtcagctttaggcccaatttaatttaatttaacagcaacaagcctttttgttcagagatcaaaaacatttggttaaaaccactaaggtttaaggattttctcatctaacaaaggtttgtaatttctatttcccatatctaaataggacagctcaagttatgtttttcagcagctgttttatacctttgcaatcttgatttctacatatgcaaaacaagaaggttgaactataatctctcaggttccttccaaccccaacagcctatgtatgatataaccagaaaaaaaagtcattacaaatacaaagaaacattttcaggaggagatattccacatgcaaacataggttaatcatttcaaaatatctggtatatacactcatgaaaataaaaatagggcaactgcttccgataaatgtattagaaatgtgacttgaaaacatttcacgggcttaacatggtcaaagaaaatgttttgagctcacaatgttccttacatttagatcttcaaaatcaagtcactgacaaatgccacctttgccctgtggagaccaagaagtaatgtttggggcatatcagaaatgctttaataaatgctttatcaaagaatggttctggagcttacctgtggaattgtgaaggttcttgttgaaagcagagattgttgatagaattatagaaagtctggaggtggcacctagcaatctcaattttaaacaagctactcaaatgtttcttatacacactatagtttgagacccagagctttaggttgaatacatttgtatatgctgttttaattcattctctggctgcctttcacctcttcagttcttactcagtgttctctgtcctttgtaagtttttcgcttcagtttttgtcctcctatcacatttttcctttcactcttgagctttaggagaggaaaaaaatgaagcaatttgatatgtagttaggatgatcaaacattctgaaattttatctaactccacagcttagaaaaaaattaaaggaagtccccttacccagatatgtgagagcttttcgtcttttgaggttccaggtccgtcttctgctgctgtattagctctcttgactgtcctctgtccctggcttctaacaacttccctatttcatgctattaagtttctcttagatcctttagaactgaattcccggctgggtgtggtagcttacgcctctactcccaacactttgggaggctgaggcaggtggatcacctgaggtcaagagttcaagaccagcctggccagcatggcgaaaccccatctctactaaaaataccaaaaattagctgggtgtggtggtgggcgcctgtaatcccagccacttgggaggctgatgcaggagaattgcttgaacccgggaggtggaggtgcagtgagccaagatcgtgccattgcactccagcctgggtgatagatcaagactctgtctcaccaaaaaaaaaaaaaaaaaagaactgaattccctaggtctcagttattttgctctctcttaggggacctaaaggggttcattgacccactaataatgagtcagcaccatttaacctagaactggaattttagcacttccttacataaacaaagccgcagcttgaggtcttaacataggcagcctgcccttcactatatcctcctctagacctctctgccacaaggatattttgtttcctctaccaggcagacagaggccaaacattagtcatcgttatattctctcttcccttcctctctccctactccccaatgtatcctagagacttaggggcagtcaataaatatttatttaatcagtgtcttttctaccatttgctgcttttccatgtctgagccctacctctctccacctacttttcaatatgtcctgcttgacagcctcttttcactctcaaagggaccaagctgtgaattccagacaccccaaggaattcgtttaaccattacacattacatgctattaaacagctaaaatcttgcatggggaattgtcgcttaggcttatcatggaaaagtggtaactgaaaggatggtacagaaacataaaagaactgacctctaattgtatgcaatctgcatgcactattatattcaattcatgacatttatggtatttcacgattcagttcttgggaaataatacccttagagtctggaacaatttaatttatcttatttgatggaaatgccttcatttttcctggacatattgtttatactgcaattatagaaagaaaatcttgacaatttggaaaagtagaaagattaagaaataaatcacctgtaaatctacctctgagggataacctggttgtcattacaaaattttttcctagtcaagcatgtgcatacaaatacatacacatacacaaatgttttagaaaaattcaaaaaatgtatttgttttgtaacctgttttctcatttagtaactgggatgatgaccttttccatatccataaatatttggctatgtcatcatattgaaccttgcaaaggattttactgtatgaatgcaccattatatatgtaataattcccttttaaattaagagctatttaattaaattcatatataaatttcattaatttctaaatttaaagcatatacaagtttcattacatttgaaaacaatcagtaggttggggttttgcatttctcaagcaattccctcatattgaatatttaagttgtttctgttttgttttatcaatcataaatgatgctatatataacatttttccacctatatctttgtatctttttccaatttctttgttagtataatttccttgaatttaagcctgtgggtcattgtctttgcacattttaaagacttttatgtattgtcaaattatccttcagaaagtttggaacaatttaatttcagtagataagtattctttggtgattctgtttgactaaggccaaaaggagaattgtatttgtaatgtcaagctaagttaccaaatggctaagggaaatgttgctccacctggttgctttgctttacatttcaatctttgcagcgttaaagtctttattatatttatgttataggtagcgttattatgaattaattagtaattgctgataatagctgagtgattgagcataatttctaatttacctgaagataaagctttgctaacactgcgtttcctctttgttttctggatgatgatttattttattaatttagcttctcatcttcaagtgaaatgtggattttatagcacagatcattcatttgtgtattcttaaatggcttctaaggattaacgtgttctaaatacagttgacggtaaagcactcagtctcctgcctaaattattcatgttcgggggaagctttcagataaatgtctgattttactcttccatgtgagttgttgtcttagtactttttacacaaaggaaacaaagcagaaaatgttgaaacttggtgaagacaaatcccaggtgcacacaaataaagaagggtagggggaaaggagacgcatttgggaagaggagcagaaaggaacagacgccagatggaagaactcaatggaaaaggctgcctagggtgtagaaatggaaaagtcaaaatgtggggagagacctttccatttctcaaggcaaaaagaattccagtactagcatgagtcacatgaaaacgaagtgtttttcattagtcactgcatccaattttttctaccagaaatattaagaattgttgactacaacagtatggaaaagcaatagattccagtgtgtatttcatgccaaaagtctcagcattctgcatgtggaaataaacatatggctaaacactgccttttctcaaaattgccatcaaactatcctctgttttgtggctctcaaaagtaagtagccagatttttattcaagactgctttgtagttcacaataggtttattgtactttttcaatggaattgttagaatcatcaattacacttctagatattctgacatggtacgctgctgttctttttcaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggtaggacatttttaagcctcgtgccttgcacatgttaagcacatagtaatccagtgactattttaaaattaattttgtttgaaattaagttgaatagaaatcttttttactcttctcacccaagggtcaattataaataatctaagccattacactgtaaatgtcaaacacatttgtgttaataataccctttaagaaatcgtccatctcttttggctatataaaaaaaagcttttcatgatgaaaaatattgaacatatacaaaagtagacagaatgctataataaaactcgtactcatcaagacatcaacaattatcaaatcacgtcagatcttatttattctatagctcttcccagattgttttaaaacaaatatcaggcgtgtgttattttattgttaatatttcaaaaggttaaaagataggattcactcttttaaggtaatcaccttgctactataatgcttttgaaatatcaataatttcatcatatcaaatatccagtccatattcaaatttccatttttctcatacatattatgcattttttaaactttttctggttttggtttaaataaaaattgaaatcagacccacaccttactttggttagttggtctttttattactttttgtttggaagtaattacagattcacagtaagtttctaaaatagaatagtttccctgtatctttcaccctgtttcttttcatcattatatgtcatgcaactgtagtacaattcttattgtcatttcaacatgcaatcaatagaaaaaatgtacatttacagcacatctcaattcaggctcattacattccaagtactcagtagccagatgttgccagtagctaccgattgaacagtgcagttctatagtttgattgtatttgggtttggctttttttggcaagactgcttcacaggtgttcgtgtattcttccatcatcaggaggtggtatataatgccttgttttctctttttgtgtgatgtttaatagctgttcacgatcagtggctaggggttgcagtgtgataattgcctatctctaccattccttcttcatttattcactggggtaggtctatgaaaaaaatgttttgcacttgtctcctattttggtactcagtatacctttcataccgaacaagcaaaatacgtttcaattttaccaatttttataataacaacttgttcactagcatcctccaacgatgaccaattatttctttgtttgtttgttttatttttatttacatttctatcttctctactaagctctgagtgaaaaaggcagagattttgtcttgttcacctccaagaccctagagtctagtaaagtgtctggtgtagagtggatactgataagtgttttggaaatgagaataaaagatacaagaacagaaatgaatagcaaaccaaacaaattactaccaaataataaaaacttgataaaatggtaccacttttgtatgttgagcatgtaaaggaaagatctctgtggagatacagccaaaggtggcatcttgaggaaaggtcaagggtttatattattctggagaagaggatataggaaattataaaaagggaagagaacatgaaagaagacccagggatctttgcaaaaaaaaaaaaaaatgccagggaaactgccagtttctcctttagccatttgccttcatatatttctgaatattaaattagcttttgtggtagggtgaaatgtaatggtgctatgtgttttaaatgttctgactttgaataaacagccaaaacactctggtgtacatatagaaaagcactcattgagaaggatgggccttttttaaaaaatgcattatgcgatatagtgaaatgagacagaatttctacaaaagatgaattttatgctagttccagaaaccaaagaaaatgaatcactggacatgtgcactaggagtcaggagactgagattctagtcatatttcttcataagatggattctgattgctattttgttcttcaactgtaatatgaggaaattggtccaaataattgctgtggtttcttccagccagtattttgttataaatactgcttcactattcctggttattagttttggttgcttgttaagagtggtaaaatgtctgtacttaacgcagtccttactcaggaatctcatgacaaagaacatgacttggggagatggtgatgctagagttatgagtgatactcaccagaatgaagttaatccgtccccacttggttagtgtgcttgctcagatagctacctgttaacctttcgtgaatttcacaggacttccagcccattgattactctgtgttttatacattagttcctctgcccttccatatttacctccttccaaatacaacttagattcaatcatctaaattttaataacttgttttcaaaagtctgaaaccctttgcttctttatctttttgttgctgcaatctacaaaactccaaaactctagctaaatattccgagactctaactaaatattttctcataccagacaacaatgtagttgtctggtacagtaccttttccggatgaccagccttcagccttccactaccaagacatcactgggtcaatttttttttttttttttttttgagactgggtcttgctctgtcaccaggctggagttgcaatggcacaatcttggctcactgcaacctccgcctcctggttcaagcaattctcccgcctcagcctcccgagtagctgggactacaggcacgcgccaccatgcccacctaatgtttgtatttttagtagagacagggtttcaccgtgttggccagatggtctcgatctcttgacctcgtgatctgcctgtcttggcctcccaaagtgctgggattacaggcgtgagccaccgcacctggccaatttaccttcaaaattgtttttgactgtctactattgttatcatcataattataaaagaccatttctcctaacctttctgcatctactcttgccaccctacaatgcaatctctacatttcagtcagaataatctgtgtaaaaaacataaatccaattatatcagtccttatcttaacactatagtagtcttctcagtgctcttggaaaaagaccaaaatcctcaacaagggtgacaaggcactatctggcttgtctggcctcagcctcctctttcctagatgctcttcccttgctgtttggatgccagccatactgcctccatttactttttccaattctgcgtgtccctcttatgtggggctttaaatatgttggtcctctgtctcaaacccttttacctatacccacccactcataatatcctggttatcatctaataatcctttacatcttggctcggacattgtgcaaacttttccctgttgtctacatttgaccagatctttctttacacacttctaaaattgtctacttttctataacatagcgttgtttgtcatcacgtacatgtgttactatttgataaatatcgactactcttgctaaaccatgtccttcaagaagatttttgggagggggaaagctgtcatttttctactcagcacattccaaagtgcctagtatacagtagacactggttagataaaggaaggctattgagaccaagagcagggaaagaaagaatagagtggtattcccttcttatttacaggagttttctgtttatttctaattaagcatctttttgtaaagtgtgtagagctactttgatgcacaggtttttttttattattatactttacattctgggatacatgtgcagaaagtgcaggtttgttacataggtatacatgtgccatggtggtttgccacacccatcaacccgtcatctacattaggtatttctcctaatgctatccctcccctagccccccaccccctgacaggccccagtgtgtgatgttcccctccctgtgtccatatgttttcattgtttatctcccacttatgagtgagaccatgcagtgtttggttttcggttcctctgttagtttgctgagaatgatggtttccagcttcatccatgtccctgcaaaggacatgatctcatccttttttatggcttcacagtattccatggtgtacatgtgccacattttcttaatccagtatatcattgatgggcatttgggttggttccacgcctttgctattgtgaatggtgcttcaataaacatacgacatacagcttttacttgtagtttggcgcaatgctttttcaagcttctcttggtatctttaagaaaaattcttgacacaaaacactctccttcctcaaacaacatcatcgctcctgagtgctgatgagagaacagtttagtagcctgtttgactcaaagttttgtcacatgtatgtggtagccctttcatatatggactgtctagttagtgatgctcttgaagcctatgggcaaaagaacaatggaaaatccttgaaactggatctgcgtatcagatctcctgaactcagttagaaaaagagaaaaagaacagaatcagtacaaaattccatcaagatctaatagttgacagatcttatatttgtggacttttgttttactttgccatgtttccagaattgtacattgtattgctctttatgggtttcttgatttaattgttgtttgtatagaatccttggtatcaagatgggtcactgtaattgtaaacttattccgcaagtatttagagtgccacttttttaaaaagtcatctgcttactctctattctaaattattaatatcctttgctgatgctttttatggggatacaaatcccattaaaatgtcaatagttgaaactaaaatcaaatgttgttcattttcactttcattttctataaatcaggatgtttacaaaacaggtaatttgtgtttttctttgtataccatttcagattagtgataatattttgtagcaaaatattacatatcttgtactcttttcttgtagagaaaatatacagtcaatatcaattgctgtcatggagagatatatggttcttctgtaggtaaaattccaagatactccacagacatatttggggaccatagtctcactcctcaaagcaattttcacacccatgggagtagatctgtgctccccaaaccagctgggcagcataacaactgcaactgaatggctctcaagactaattaataaaataatgctccagatgcggtgaagtgttataaataattaaagctcaaatatgccttagcaaatataaactgaccaatttttatgtcttttgaatacattatcctggcttttacagttcctcattacttgcctcactagactgactcgttttcaattagtgggtgttattctggtccagatatattttaaaaactgacttcctttgttttacttgagcagtcactaaagtgatatttattacttgtctacttctgtgattaacctagagagagttttaaaggagcaaatcatagtggggaatttctaaggagaactgcaataaaacatcagcttattcaactcccttcctcctaccccaaatccaaatggagattagatcttgattgtaacaacagtgtaggtaatgactttttgtttgcctttttactaatgaaattgtttgtcactaggttttcatctttcaattaaaaaaatctctataatcccttccctagagatcattaaggataccttcaaagcttcccgagattttctggttaagatttagatggaagtaatcaatacatacattattaaaagagtggacagaaagccattattgcttggatgctgttgacaaatgaaaaggcttgaataaagtagtttacttgttcatttgtcaggtcatatattatgcatgttcgatttcttcagaagtcaccacaaagtgagagacaggctgagaaattcaataaaattatcctgaaatcatgttgtagattatacatttatttaggctcattctgttatcagtgctggcctgcttacgtgggatacattttagtatgtatgttagcttgacgagttttctgtgttttctttttacagaaagagaaaatatctttggatgtcatttgtgaatgttaagatttaagtcagctctgtgttaagaaaaatgcgttgttccctatcacctctgaaaaacaaccaaaagttgcgatagagtgattcattcttttttcttttctttttatttattttttctttaatttttttttgagatggagtctcgcctgcagcccaggctggagtgcagcggtgcgatctcggctcaccgcaagctccacctcctgggttcacgccattctccttctcctgcctcagctgggactacaggcacccaccaccacacctggctaatgttttgtatttttagtagagacggggtttcaccgtgttagccaggatggtctcgatctcctgacctcgtgatccacccgcctcagcctcccaaagtgctgggattacaggcgtgagccaccgcgcccggccagagtgattcattctaacattcaatgacctggcctcttagagtttctaaaccacttgactgttagttatatctactctaaggtgtctttttagccgcgttggaggaaatagacgtctttttgatctattcttcatcatttttgtataagtttgatatcctatgcagtcatatttagggatgctgaatagaaatgacttaaaaattatttttagaactgcatttctaggcatttgagtcttctgaaaactaagtctaagtcttctgaaaactagctttatcatcaaaactgaagaactgagtcatctaggaattgctgctttgctttaatgactgtaacaagatgagatgtgaataatttacaaactgacttctctaccagtcttctctctcactttgtcaaaatattttgatgtcctgacaaatactctttaaaacagtatctgcatagtgttttgccttgacaaagcacttttacacacattattcatttaattacaaatgatccccttgatttttttctgtgctcttccttttgtcccccaaaaacattattttaggaaaaattataccataactcagattcctagaatttattggttctttcaagaactttttttatgaagagcctactctatgttaagcatatgttagggaacaaaatgagtctctgcccctatggatgtttagattttagtgacagaaatacatagtaaacccataaattaatatatgaaattatgttgggtagtaagtgctatgaagagaaaataaacaaagcatgaatagagaaagattgaggagtactggcctatgtgaggaggttattttggggtaaagacttgtgtgaggccgggtgcagtggctcatgcctgtaatcccagcactttgggtggctgaaacaggcagatccctggacgtcaagagttcgaaaccagcctggccaacatagtgaaactacgtttctaccaaaaactagctgggcgtggtgacacgtgcctgtagtcccagctacccaggaggctgaggtaccagaatcgcttgaacttgggaggcggaggttgaagtgaaccaagattgtgccactgcactctagcctgggtggcagagtgagaccctgtctcaaaaaaacaaacaaacaaaacctgtgtgagtgagtaaaccatgcaaaaaccttgaatgaagaggattctaggcagaagaagcaccaaattcaaaagcccaatggtaagaacaggttttgagtgttgtagaaatagcaagatgagctgtgtatctcaagggaaataagatcagtagacagtgataggttctagaaagagggaaaggccagataatgaatggtcttgcaggccatagtttggaggtggattttattctgtgagtaaagagacatcactggaagtaaggaaacatcactggaaggctctcagcagggatgatgtgatctgatttatgtgtttagaagttgactcttgctgctatggagaattgactataaaaagagcgaaactgaagacacagaaaaggagggtggtggagtcatctcagaaggaaatgattacttggactagagtggaaatgataggtatggtgaataattatttgatcgaagatatatttggagggtagaattgatagaacttaagatagatagaatgtggagtttgagaggaagcaaagagtcaaggaaaattctgaggtcaatggcttgaacaaataaaataatgatgttgccatctgagaaagacttgggaatgatcacgtttgagtgtatgtgcttagaatgaaccagggttccatttttggattatgttgatagacagacacaaagggtatgattcagatattatttaccacttatacttgacaatctcaaattttggctcagtatcttgagaacatacacaaattaatttgtcacagggttttctaataatccattcatttctactaacatttcagaagtaatttccaaatcttaaagtttaggcttaatgacctaagacctaattccctaaatggccacgggaactagattgagttttcaccagtgatctctcaaggtcagctcagaacttaacaacattattgtcagtaggaagtaacttccccagtgattgttggaagcagcccagccttagaattaagagtcaaacagctgttcaagatgctgtgtgcgcagtaaactattcctccatagtatcacagacctgcaagcaggctggactattctagcccgtgcccttgatctcagagaatacaatctttgttttcaaagacttccagaaaaataaatctcaacacagagtttgttaaacacattttccccttatacactcaaaaatgttttttcattgactataattagatttttaaaaaaaaaacataatttcaggcctgaaatatgttcatttacttttcaattttacatcaaatttattcaatctcatttataaattaatattgttgttcatgttgttgactatctgaaacaatgaatggatgtatctgatacttcaatcccttatcttcacttttattcagaagtggagtgaaaataaggcggagctttttgtcatcttatttagatgattatttagtcaaactcatagaagcagagagtagaaaaatggttgccatacattgtaagggcgagttgttgctcaatggatataaagtttcagttatgcaagatgaaaaagttctagaggtctgctgcataacattgtgcctatagttaacaataccgatttgtgcacttaaaaatgtgttaaccgaggtccggagatcaagaccatcctggctaacacggtgaaaccccatctctactaaaaatacaaaaaaagaaaaaattagccgggcatggtagcaggcacctgtagtcccagctactcgggaggctgaggcaggagaatggcgtgaacctgggagacggagcttgcagtgagccgagatcgcgcaccactgcactccagcctgagtgacagagcgagactccgtctcaaaaaaaaaaaaaaatgtgttaacagggtaaagttcatattaagtgttcttatctcaataagaaaagatgattatggccttttctttatagcccagatacccatgttcataacttctgtaatactagctgtctcaaatgactattaagggaaacctctctttctgttgtttgctccattgcctctttcttcaaatttttttcttccatgaacccctatgaatttgctttagattactgggggcaatattcttgccaccctgccatgtacatcctggattgcttgcccttttccaagacctcgcttttaagttaactgagcattgcttgtcccgaagtgagcatttggtaaaatattcttatgtgtttgagactcaataaatatggtggctctttaaataaagaaggtccttttggtgacagaatatattcagcaactttcttgtcagacatagaaacaatacaggagacataaaaaataaggtagaaataacacaggaacaagaatgatgacgtaggatggcaaaactagtaaatacagatcaagttacagatatgactgttaacatcttgttctatgcctgctcggtatccatttgttgaatgaacagaactgttggatcatcctacatttcagagcctgtctagtgtcctctcatctcctacctaatcctgcagactacagaaaaagccccaagcagcagttcaaaccatggaacttctgagtgtttggacatgaaaatctcctttaagaaatcactaggttgaagaaggcaatgctaatgggaccacttcttgaggaaattccacccagtaactcagcagtgacactcagctttggatctggaacatgagtagacctagaataagatctgtccatttttcccaatttacagcattaattttttcacttatgattcatgagtccaggctttcccctgcaagcctgttttgcatctaaatcaacttggccttcatataacacactctagtgttctaactgggtgttctgtatcttagtcaacaatgtttactgagcatttactatatgccaagctatggctatggtttttaagcatcgataataacgatgcttagcagagactctcaaactgccaccatagagcaggcctgtggccgattaatgatcttaacaaattgattatagtatatgagaactggatgttagaacttagataaggttttagcaaatgcccacattttacaaatgaggacacagaggagcaggaagagtttatcaccttttctggatcactgcagccaggttctggcccagcccaggcttgaagcccaaggcttctgccactcagaacagtgctcttttcaccacttcagcctgcctcccaggatgattctaggaagttctgcttacaaatatgggtagtatttctagtcattccatcagattttattctgaaaaacacaaatttaccatttcaatatgaatacaggtaaaattcagcgccaggcaagctgtacatgattgaaagacatctgtgttttgaaaagcacgggcttttactcacatccatagtaatatgatcctaaatccactgtccccaggagaaagcaagatagcttttctccctgtcatgtcattacctatgcccagagttctcctcttgttcctctcatgaagcaaatcaatatctcacctttcatcccctccatacgtggttctgagctacttctatttatggcattatttagatatttttataatataagcaggaagcaagagggacagaaaaaaataatcagtggccaggtgtggtggctcacacttgtaatcccagcactttgcgaggccgaggcaaacggatcacctgaggtcaggagtttgagaccagcttgcccaacatagtgaaaccccgtctctactaaaaatacaaaaaattagcagggtgtggtggcgcgtgcctgtagtcccatctactcaggaggctgaggcaggagaatcacttgaacccaggaggcagaggttgcagtaagccgagatcgtgccactgcactccagactgggtgacagagcgagactccgtctcaaaaataaataaataaataaataaaaataataataatcaataacttggttcttctctattactttcaggaattttttaagtttctgatttcttccatggccattaggattttccacttatgtggcttccaaattattctaagtcagggagattttatgttttgttatcactcactttcagcttcactttagaattgcaagatttagattcaaagtgtgtaattaactgatggccttaggtaaaccctaacttatctgtatctcaatttgcatggatgaaacattcataatataaaagtatacaccacaaatatacctactcaaccaaactattggctccttaatgacaaagattaagtctctatatctttcctaactttgtacctaataggttcaaaataaatattttttgaatgaacaaattagtgagtcaacaatcagtcacccggttggccagtacctatggtgttttaagtgcaatctaccagataattcaaccttcataataaatagatttatcttgagattatcattgctataatagtgtagtagcatacttcatataagtttattttgtgaaccttaagaagctcaaggacaaacatctgtgtagtattcctaacattttctaaattgcatattttattttcatagaggtgctctacgtctttagtattgcttctaattctctcatatcactattttggacccttgggtctggctgtcttggaaaggtgaaaagaaaggtatggggaagaggatgtgttttaacaaagataattttatctgttcaagggattcaggaagtaattatcttaacatctgaatgctaacatctgaatattgtaaatacgtattctgtatgtacatgggagaaaatatctatatctgataccttttctatcatcacataaaggaactgacttctctggtttaaaatattaaccaaaatttatatgacaaaatcagtatatatgagtatatattttctcaaacctctttcaaacaggcctttttgggagacaagacacttatcaaaatcaaggctcttgacattaaatattcttgtttgtctttttttaaaaaaaagtcttcatttttctttcttttaaaatgcaataaattatactacaacatgcagtttatggtgagttattagatactgaaaaattggctttccattattttaatgcagattctacattgctttttttttactacataaagccatttgttttaagctccatgctacaaagaccacagatgttcattgcctagaacagtgtctgatacatagtagttgcttgaagtttgttaagtgactaaattaaagaggatcttacatataaccatgtttaaaattacatattgttatttatagtttttcccacatgataagaattattgccattttctttaacctctgacctccttgaaccaactatttctctctttttgtgggagttttatccttttgtatttaatctgaatcttttgaaattctaaagatacaatcacttaaccctctcttccatccactttcttttcttaatttcaggcaacaatgtgaaaataatggtgcttatgtctttgtaataacagaactttctttgtcttttctttggcctcattttaatcttcaatgactcatatttaagaaatgaactgtgcagctgtggtggatctaagtccttggcaacaactcgatgggcaaacacgtggtctctcacaatggatgctccttagctttgaattatttactgtccagttttaacaatggaattatatcatcaaatagtgccttggactttttaagtttttagtgccttaagtttttaagtttgatgagacctttaagatccatttccggccgggcgtggtggctcacgcctgtaatcccagcactttgggaggccaaggcgggcagatcacgaggttgggagatggagaccatcctggctaacacggtgaaaccccgtctctactaaaaatacaaaaaattagctgggcgtggtggcgggcgcctgtagtcccagctactcgggaggctgaggcaggagaatggcatgaacctgggaggtggagcttgcagtgagccgagattgcgccactgcactccagcctgggcgacagagcgagactccatctcaaaaaaaaaaaaaaaaaaaaaaaagatccatttccttattttacagaccttgttccaacaattatctccaccttctgtcaaggtcgtaacatatatctagggtgaccaactttcctcgttttcctgagactgtccaattttcctgaaactattctggttttaacatcgaaagtctctcatcctgaaaaactcaatgctggacaaaccaagatggttggttaccctactgctagcttccgtctttcactctaggttcaaatcattcctatgctaaaaagaacttcttatccctttgtcttgttatcctctctgtcctcctgtcgtgtcttcctcttttccttctcagaaaaagaaaattgaacatttgattttcacttgaaatacctactccttcttccactcactcctcagctatgcctacttctgaggcttctgccctccactgaaattgctctcagcacatctagtgaacactctgcaatgctgatcttactttacttctgtgtttcattggactcacttggtcaccctcttcctctcaaaattctcactctctccttgaaatttctacactcctcatttcccctaatctctccacctatttgttccttttctatctctcaagagatcctgttcctctgtttgcccattaaactttgatatgtaggcactcaacgtatattagctgaatgagaaaataactcctaagtattttttttctcctcaaacctcagaatttattatttccttgtggaaggaatgttagctttccaagctgagcatatcacagtcccttactctgtcccccatgcacagaacaccccccccacacacacacacacacaccatcatgttgcatttttaatattactcttcaataattttatcctgaatgagcatgaggggttctgaatcagaggcagatttcatttaattaccttacagtaaatattgttgctgtgcccttcctttgcccaaagacttacccctagggcaacatgatgaacgctgatgaaacattttcctacttgagtggctgggtactccataagtgggagactaggaaaaatcattttttctgcttataaaggagaaggaggctgctatccatctctcattctgaaaggttctctgtggaaacataacaggcctgagtcctaattccagcttctgcagaaaccagctagccctatgtgtctcatgttttacaatctggaaatgtctccaaggtatgggcttcatattttttgaaatgtaaatacctagaaagatacccactccagtctttctaacaacatagagttcagcttaggaacctaccctgagctataaccgtttgaccctcttggatcagagaaatgaactagacaaattgctacagatctaatctccatggtgtgggaagtttctcaggaggctagagctttctgtaggtgaactgagacatccaggaaagtttatttcctcatacttagttgaattgcacccagcgtttgctcatctactcaacctagacactaagtgtcattcttgtttctttttctctcttctctccagcatctattcagtcaccaaattttcacacttcagatttttagacatttccctatcctatccctgtcatttttcctggtaccattgccctgagtcaaatcctcataatcttgcactgaattcttacaattgcctcattatctctctgattccatttctgttcttctcaaatacatactctgtatttatatcaggaagatctatttgaagcacacatattcctgtgccactcccttggttaaaaccgttcaaaggttcctgattaccttcaaggcaacacctaagcctcttagtggaccatatgtgatcatagagaggcagagcttcaaattctggtttaaaaatctaatgtatttccagatagcaatagtgtctttttcatctttggacatgccctctccttgttctttatgctctagaaacactggcctgcttgagattccgatacataccatactgcactatgtcctatgactctgcacttgcattttcctcttcttggaatgttctctagcatactcttccttgaataagtcatgttcatgcttttgaattctatgtgattactagcttctcctggaagcttttcccgattttcttccccatattgcgcaagtctatagcactgtctacattgtattgaaattatttacgtgtctgactcttctattatatgttaaatattcctaaatagaaagggctgttttgcattcaactttgtatttccagtttcaggtacaaccactgacacatggtagttcaatagagggagccattattatttttataattagtaatgtcagtattaattgcctcccttcaggtccaaacagagaaactaggcaaaatgataatttacttgaatttgggaaacttaattgtatgaaaaaaaacacaagaatacaacaactgaacacacacacacacacacacacacacacacacacacacacacaaacatggagatttcaagtgaaatatcaggagaatcagctttatatgtaagcagagtaaataactcacgtatctagcatgattttagggtacagaaatatcccattattcagaaagtacttccctatctgtaggctgaatcctaatattctacttacagaactccagtattttggttcaaacgccttccctttctctattgaattgtaaatagctgtggatgatgaatcattttgcaaagtatcagactcaggattcttttgaatggtgaacaccgctaagattttattaataaatgtgtcatacaatacagctctggaacacttctgtaacataatggcatatctgaaattcaaggaagaatactgctaatttgtttttccccagtgaaagaacagggcttaaattcagcaggcaacattgctaaaagacagagttgaaaaaagttacaaaaattaagccctagatcagggcaaatattactgttattgttaaacagttatattagcatttatgtagcatgcacttaatacttttattaataccctcacttctgagatcaaagaatctgggtcaataactctcttcaatggtgtcagagtatccgttaggttattctaggctcacggtatacctcacgatccttttagcactcgattatgtgtgaacttactgttttcactctgcttctagtgttaattttctcccttctttggatctagaaactttttgaaggcagaaactattcattttgtttttctcttgatcccctggataaaggaagattacagattaaagattaattctagatctgttcatttatagaaactagtgtccgcaattcctacatccataatagctcaaaacatttctactattctcaaagaggtcacaatggatgatgtaatgactatttttcaaaagtattgagacttttctcttagcttacctattttataccttgtcagacattttgacagaattaactggtgattgtcagttggattcattgtatactttaatatagcctaaggtcctgcaaatggcccttaaggcttcccattatgttctggatatccactatttggggtatgtttaagtcctcattagccatgctagagttttgcaatatataccttgaaactttagctgtagatttgaagtatggctgtcaggttacataaacaaagcactcttatctcaatgagagggcattaactatccagaatgctccccccatctccccagaatagctttacaaacacagcgctttcctcattaacagatagacccatatagcctttaaaaaaaatcattttataaccatcagtgtataaataaaagagatagaaattgacctgggagtttcataaacaagttctgagcacccaggattaattttgagaagaatgccacaagccaaataagcacttcttttcatctcatttcacaggccttcaagagggaattgaaaactaaagaacctgtaatcatgagtactcttgagactgtacgaatatttctgacagagcagcctttggaaggactagagaaactctaccaggagcccagaggtaattgaatgtggaactataataacatattgatagaaggatcagtggtgacggagcagcccatccattcttgctgccagggtctggatagctctcatattttcttggttaaatagaatcaattcaaattaaacatagatgctgaaaaaaaaataaggactcataaactaccatgcataaatcagtttgtgcattcataaataaacatcaaaagagattagcaatcagttattggaacatttagaaaataataaacaaagggagttatctgtgaggaggaattctattgttgcaaagactacaagttaattttccatttaagagcctgcctgaagtaaattagagcttgtggtatgcatcctaacgtttttctcctcaatagcttaagtgaatcttaaattgtcggattgatataaggtagaaactcaggaagatatactttagatgttctgggctgtatcaaaatttatgccaaagtataaaaaagccgttaatcagtaggttaccctcttgttcaactgtactctttctttcttccagtatgacctttttgacaatgtttaaaaaaaaagaatgtggcctaaaaccttgtcatattgccaatttagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggtaccgtctacttctttgcttcagggccctttgagagactcaaaagagcttctaatctgaacttgagtgcagtgttatcttcccacaaagttaaagctagagaaatcagtccgtctttcacaaattcagtcttcattcacatggtattttctccaagagaagacagtgatctaattatttgtctgtcttcagttatatgaaatgaaatattaaaacagttacagggcaagaaatcactttgactttgatattaagtgattgtactaaagtctgatgtgtgtgtgtgtgtgtgtgtgtgtgtgtgtgtgtattggtgtattgcttgtgttacttagtatcagaatacagaaaaataaaacacttaatcaaaagccaggagtctaggtgttggcccttttgctaaccaaattacatgacttgggtaagttatggtttggtgaaataaggctgttaatgtgttgcccttcccttggaaggcaacatttgtaatacagtttcaagtttcattggcccactgcagaaatgagggaaaatcattatatatttggaagaccactgtctataagaccaaagttaaattcccttgtggcacaaagatggcaaatatattctgtagaaaaaaatacatatttaggagtatcattttgaaatcagcaactactcatctattgtcaaaatcacaaaaatcctcctagattaaaattcaaaagaagttaaattccctcatgcactcagcatgtttgccagcatctcagcatcctcattctagaagttgtcctcttccttggctttcatggaactgttccatccatgttcttcttcctatatttttctagattcttctcctagccacccctcaaatactgttgtgcccaagtttctaaccttagcctaattctcttttgattgtttaaaccctccctgtttgagatggcctggatggtgatgtatctacatctctagtccgcatctctcttctgatctctgaatccatgtggcattacgatcacaaatgcaactattctgaaaccaagttcatttgttctcctgttttccatttccctacttctgtcccctcttatctgaccttttttttcctgtttcctatttcagttaatgaatcatcatccaacaaattttccaggctagaaactttaggttcatccttaaacccttctgcattttcactgatggcacatgatggctcatgttacctcagaatagctcttttgtgttttctctcctcttttaaccaatgtcctttttaatccccagcatcttttacttagatgataacagtatacatctttaaatcccattcacccctctgtgtgcctggcatatctcagatactgcattttaaacatttggtgaattaatggatggatgaatggtttctttgctgatgttcctgcattacccagcttcttccaattccaatccaaactccttgcgggagaatacttgcctagagaatgaaatccaatgaataaggagattacgtggcccttttcttcctagccttgacttaccttctcagccatagctcctattctccagaccatttaatacactctgcccatatgatatatatatatatgtgatggcatatttgggaaaaaggggtgatatgggcagagtgtattgaatgtgtgtgtctgtaaagtatgtgtgtgtgtgtgtgtatatatatatatatatatatatacacacacacacatacatagttagatatatacatagtatatatacatatatacatagatatacacatatatatacacatagatatagatatagatatatctgcctttgcaaatgctgttctctctgtctggatccccctacgttgtctacttggcgaattctcccttcagccctcaaggaccagccaaaatgttacctatctttgttgtctttcctgagtgtctacaaccccccaactcccaccaagcagaagaaactgcttacagttggtactctcatagatcaccaagcatgctaaattgtcacacttaaatttcacatatattgtagcaacttgcttatgcatttttttttctcccagagaaagtgaagttgctaagagcaaggatcatgctgtacatctttgggctgctagcccagggccagcaacatatgaggaatctcattaggtaccttcatttattcactcaacaactgtttatgagtcattatataatgtgctggacaggtagttataaaagaaacagacttgatcattgccttcatgaagcctatggtctaatgttgaattgcatagctcttcattaaaatagtaggtaaaatttttaaaaagaaaagattaaaaatttgactctaatacttgtaaaatcccttctaccccaatgttttatgaccccatgtctaacatttaaagtaagggttaaccttgctgtgtactggaaaactaagggttttgaaatgtattacctagtattttaaaagcattaaatatgttgattttattcaaaaatatagggactaattttttgacagacttctccaaaaatgagaaataagttaggaaaatgtcccagtggaactaaattagttaatatgtcaattaaattgctcaatagataggctgtagagcagacataagggattcatttttagccatacttgtcacacaggtgcatttgtaagatactgagtatggatggagaagagaatgtgtacagcataatttaataattaaaaataactaaaagcataacagttcaagtatcagctggccttcacccaaccctatttgcggtattccttttagtttccctgtcttatctgttcttggtcttaagacaaacttcattttccataccctgattggtaaaactctcattctgatcccaatgatagcaaaacatataaacattaaacatacctttcgaaaaattatatttataacccagcacatctatctttctcagacatatatacacttaagttatggtacttatctgaatttttatgtactggtaatagtagatgtgattgggcttttgaatctgtgttgtattttatgcgtgtttcaaactatgaattacatgaattcatatatatttatctcccttcggtagctcttctttaattttgcagtggaaataaatcatttttctccactgcatcttattgacactgggtttgaaactctgaagctttgggggtagtagtttacaaagaatgagttttattaactaaaatttatttcagaaaaaaagtagaagtgtacttgaaaccactcttcccatttttccactcagcaatttaagccctcagaggattcatgctgtagggaacttttctaataaaccatggtttctctttttttattttattttattttattttattttattttattttattttttttttgcgacagtctcgctctgtcacccaggctggagtgcagtggtgctatctcggctcactgcaacctccacctcctgggctcaagcagttctccgcctcagcctcccaaatagctgggactacaggcgcccaccaccatgcccagctatttttttttttttgtattttttagtagagatggggtttcaccatgttggccaggctagtctcgaacttctgacctcaggtgatccactcaccttggcctcccaaagtggattacagcactgataactaggcagctagctagaagaacattttatatatccatatcagttcattttccttacccctagacactctatcatagtaccccccctccattctgatcttatgtgttaaataacttgttattcaagaaactaagtaatatgtgtttctgtgagatttagcattctgtaattgtattagcaaatgtggcttttggatttaaagaatgggtgaaacaacaatgactaagtccctggcctttatggaaatggcattattgctagctgatcatctgcgggtggtgaacatggtaaattaataaatggaaacacaatattaatattgactatattgctcactaagagaatctcagccttccaaacatagcttccataggaaaaaacagtagaatcaaatttaagttttaaatgcttctttacttttaaaattcatgatttatactgcttatcaaatattttaagggcaagatcatgacttttcactttactgaaaatagcaccagtgcttatttgactagacaaatattctaccttccttgtaatggggaataggaataactttttgaattactaggtgttccacatagatctgtaagtggaatatataaaggctttaataaagtagaataacttttaaacctgtagtctggatacaagatttttgttcttcaggacaatcccaaggtgaaaaggtttgtggattgttgttttctttttttttttttttttgagacagagtctcactctgtcaccaggctggagtgcagtggtgagatctcggctcgctgaacctcctgggttcaagcaattctcctgcctcagcctcctgagtagctgggactacaggcgcgcaccaccacgcccagctgatttttgtaattttagtagagacggggtttcaccatgttggccaggatggtcttgatctcttgatctcgtgatccgcccaccttggcctcccaaagtgctgggattacaggcgtgagccaccgctcccggccagattgctgttttttaatgttttgtttttgttttaataaaccatggtttctctttttttaatttttttttttttgagacagtctcactctgtcacccaggctggagtgcagtggtgctgtctcggctcactgcaacctccgcctcctgggttcaagcaattctctgcctcagcctcctgagtagctgggattacagacatgtgccaccacgcctggctaattttttttttttttttggattttttagtagagatggggtttcaccacgttggccaggctggtctcgaacttctgacctcaggtgatccgttcaccttggcctcccaaagtgctgggattacaggcgtgagccactgcgcccagactataaaccatagtttctctgtaccaaaagtggtatgtccttcttgagccaggaatatttcactgttcttagtttacctgttgactctgaacacagtttttcatacactgtaaataactctcccaggctgccatcttggaatatgcaaatctgtcgcatctatgtagttatgcatatcgcatttttgtcaaacttttaacttgcatttcttactgtgaaaagtcagggcagggattctatgagttttttctttaaagttcctacaatgaaatgttttgattaaaccttttttggcattcaaattgagattgatttaatgatgtgtgtagtaggctagaaattatgatgaagtgacgatgccatccttatttatcttcagcattcacatctaaagttttaagaagaaaactggcaaatccacctttttaggcttaccatcctcagtccctgtggctttgggtttttttgagaaatttgtcaaagaaacgctatgttagaatttgacattgaggaagccaagcatatttcctctgaatagataatgtgaaatgtgatataatgtattagaatttcatcttcactttggcaagcaagatacttgcaaccatgttcatgcaactatcttcccttattgcttttctcttcttaaccttggttctaaagttttcttcttattgtattaattttgttatgcttcccatttatatgagtcaagtcaaccttacttgatttcttatatatgagttatgtaaggaaaacttatcttttcttatagaattaggggatgaatgagcagatagaaccaacatgaacagggcgatcctaaaaatcattcaaaacatgtaagctctcccaactctgaataaacttgtgatatcttcataatgaataaggtatactgcctatagtaggaagaggaaaatttattaatgttttgtgcattgttaaagaactacaaatgaattgccgtgtggaggctttcattgttgttgttgtaaaaatgctatgtgtattaagtaagcctttgatggagaagaaaaaacaaagaaaaaatatttaatccttcataaatctgggttaaatatgaagctaattcctgttatttggagtaaccagggttttatctagtttacaaagcatgcaattgcaatgtttaaaagcatatgatttggcctttaatatctgaaaatatgtctatcaaaggccatattatagcgagtgtcactccatactttataagtacggtatatttttaatagaatgtttatgtactggtgataagagatgttactgggtttctaaaccagtactgtattaaggattttatgctattgtaagattatggattatgtgaattcatatatattgatttactttcagtagcttttcaatagaatatctagggtttaatacagcttagaaactaaagcaggaattattcatctttaaaatcctgaccaaagaagtggctggcaagatggctgaataggaacagctcaggtgcgcagcccctagtgagatcaacacagaaggtgggtgatttctgcatttccaactgcagtacccggctcatctcactgggactggttagacagtgggtgcagcccacagagggcgcagaagcacggtgggatgtcgcctcaccccggaagcacaaggggtcagggaattccctcccctagccaacagaagccgtgagggactgtgccctgaggaacggagcattccagcccagacactatgcttttcccacagcctccgcaacatgcagaccaggagattccctcgggtgcctacgccaccagggccctgggtttcaagcacaaaattgggcagctgtttgggcagacaccgagctagctgcaggcgtttttttcatatcccagcgtcacctggaacaccagcgagatagaaccattcactcccctggaaaggggactgaagtcagggagccaagtggtctagctcagtggatcccacccccaacggagcccagccagctaagatccactggcttgaaattctcgctgccagcacagcagtctgaagtggacctgggatactcaagcttagtgtggggaggggcacctgccattactgaagcttgagtaggcagttttcccctcacagtgtaaacaaagccgtcaagaagttctaactgggcggagctcaccgcagctcggcaaagccactgtagccagattgcctctctagattccttctctctgggcagggcatctctgaaagaaaggcagcagccccagtcaggggcttatagataaaactcccatctccctgggacagagcaccacggggaaggggcagctgtgggtgcagcatcagcagacttaaacgttcctgcctgctggctctgaagagagcagcagatctcccagcacagcactcgagctctgctaagggacagactgccttctcaagtggggtcctgacccccgtgcctcctgactgggagacacctcccagcaggggttgacagacaccctcatacaggagagctctggctggcatctggcaggtgcccctctgggatgaagcttccagaggaaggaacagacagcaatctttgctgttctgcagcttctgctggtgatactcaggcaaacagggtctggagtggacctccagcaaattccagcagacctgcagcagagggttcctgactgctagcatcaacatcaacaaaaaggacgtccacacaaaaaccccatctgaaggtcaccaacatcaaagaccaaaggtagataaatccacgaagatgaggaaaaaccagcacaaaaagcctgaaaattccaaaaaccggaacgcctcttctcctccaaatgatcacaactcctctccagcaagggaacaaaactggatggagaatgagtttgacgaattgacggaagtaggcttcagaaggtgggtaataacaaactcttacgagctaaaggagcgtgttctaacccaatgcaaggaagctaagaaccttaaaaaaaaggttagaggaattgctaactagaataaccagtttagagaggaacataaatgacctgaaggagctgagaaacacagcacgagaactttgtgaagcatacacaagtatcaatagccaaatcgaccaagcaaaagaaaggatatcagagactgaagatcaacttaatgaaataaagcatgaagagaagattactgaaaaaagaatgaaaaggaacaaacaaagccttcaagaaatatgggacgatgtgaaaagaccaaacctacatttgattggtgtacctgaaagtgatggggagaatggaaccaagttggaaaacactcttcaggttattatccaggagaacttccccaacctagcaagacaggccaacattcaaattcaggaaatatggagaacaccacaaagatactccttgagaagagcaacccaagacacataataatcggattcaccaaggttgaaatgaaggaaaaaatgttaagggcagccagagagaaaggtcaggctaccccaaaggaaagcccatcagactaacagcggatcatttggcagaaaccctacaagccagaagagagtgggggccaatattcaacattcttaaagaaaagaattttcaacccagaatttcatatccagccaaactaagcttcataagcaaagtagaaataaaatcctttacagacaagcaaatgctgagagattttgtcaccaccaggcctgccttacaagagcttctaatgaaggaagcactaaatatggaaaggaaaaactggtaccagccatggtaaaaacataacaaattgtaaagaccatcacactatgaagaaactgcatcaactaacgggcaaagtaaccagctagcatcataatgacaggatcaaattcacacataacaatattaaccttaaatgtaaacaggctaaatgccccaattaaaagacacagactggcaaattggataaagactcaagacccatcagtgtgctgtattcagaagacccacctcatgtgcagagacacacataggctcaaaataaagggatcgatgaatatttaccaagcagcaaatggaaagaaaaaaaaagcaggggttgcaatcctagtctcagacaaaacagactttaaaccaataaagatcaaaaaggacaaaaaaaatggtattacataatggtaaagtgatcaatgcaacaagaagagctaactatcctaaatatatatgcacccaatataggagcacccggattcataaagtaagttcttagagacctacaaagagacatagatgcccatacaataatagtgggagattttaacaccccactgtcaatattagacggatcaacgaaacagaaaattaacaaggatattcaggacttaaactcagctctggaccaagtggacttaatagacatctacagaactccccaccccaaatcaacagaatatacattattctcagcaccacatcacacttattataaaattgaccacataattggaagtaaaacactcctcagcaaatgcaaaaaaacagaaatcataagagtctctcagaccacagtacaatcaaattagaactcaggattaagaaactcactcaaaaccacacaactacatggaaactgagcaacctgctcctgaatgactgctggataaataaggaaattaaggcagaaatgaataagttctttcaaaccaatgagaataaatacacaacggaccagaatctctgggacacagctaaagcagtatttagagggaaatttacagcattaaaatccccacaggagaaagcaggaaatatctaaaattgacaccttaacatcacaattaaaagaagtagagaagcaagagcaaacaaattccaaagctagcagaagagaagaaataactacgatcagagcagaactgaaggagatagagacatgagaaatccttcaaaaaatcaatgaagccaggggctggttttttgaaaagattaacaaaatagatagactgctagccagactaataaagaagaaaagagagaagaatcagacagacacaagaaaaaatgataaaggggatattagctctcatcccacagaaatacaaactaccatcagagaatactataaacacctctacgcaaataaactagaaaatctagaagaaattgattaatttctggacacatacaccctcccaagactaaaccaggaagaaatcgaatccctgaatagaccaataacgagttctgaaattgaggcagtaattaatagcctaccaaccaaaaaaagcccaggaacagatggattcacagctgaattctaccagaggtacaaagaggagctggtaccattccttctgaaactattctaaacaataggaaaagagggactcctccctaactctttttatgaggccagcatcatcctgataccaaaacctggcagagacacaacagacaaagaaaatttcaggccaatatccctgatgaacatcaatgcgaaaatcctcaataaaatactggcaaaccgaatccagcagcacatgaaaaagcttatccagcatgatcaagttggcttcatccctgggatgccaggctggttcaacatacagaaatcaataaacataatccatcacttaaacagaaccaatgacaaaaaccacatgattatctcaatagaagcggaaaaggccttcaataaaattcaacaccccttcatgctaaaaactctcaataaattaggtactgatggaacgtatctcaaaataataagagctacttatgacaaacccacagccattatcatactgaatgggcaaaagctggaagcactccctttaaaaaccggcacaagacaaggatgccctctcccaccactcgtattcaacataatattggaagttttggccaggacaatcaggcaagggaaagaaataaagggtattcaaataggaagagaggaagtcagattgtctctgtttgcagctgacatgattgtatatttagaaaaccccatcgtctcaacccaaaatcttcttaagctgataagcaacttcagcaaagtctcaggatacaaaatcaatgtggaaaaatagtaagcattcctatacgccaataatagacaaagagagtgccaaatcatgagtgaattcccattcacaattgcttcaaagagaataaaatacctaggaatacaacttagaagggatgtgaaagacctcttcaaggagaactacaaaccactgctcaaggaaatgagagaggacaccacaaacaaatggaagaacattccatgctcatggataggaagaatcaatatcgtgaaaatggccatactgtccaaagtaatttatagattcaatgcagtctccatcaagctaccattgactttcttcacataattagaaaaactactttaaatttcatatggaaccaaaaaagagcccacatagccaagtcaatcctaagcaaaaagaacaaagctggaggcatcatgctacctgacttcaaactatactacaaggcttcagtaaccaaaacagtatggtattggtaccaaaacagatatatagaccaatggaacagaggcctcagaaataatgccacacatctacaaccatctgatctttgacaaacctgacaaaaacaagcaatggagaaaggattccctattcagtaaatggtgctgggtaaaccggctagccatctacagaaaactgaaactggaccccttccttacaccttatacaaaaattaactcaagacttaaacataaaacctaaaaccataaaaaccctagaagaaaacctaggcaataccattcaggatataggcatgggcaaagacttcacgactaaaacaccaaaagcaatggcaacaaaagccaaaattgacaaatggaatctaattaaactaaagagcttctgcacagcaaaagaaactatcatcagagtgaacaagcaacctacagaatgggagaaaatgtttgccatctattcatctgacaaagggctgatatccagaatctacaaggaacttaaacaaatttacaagaaaaaacctaatcaaaaattgggcaaaggatatgaacagacacttctcaaagtaagacatttatgcggccaacaaacatgaaaaaaagctcatcatcactggtgattagagaaatgcaaatcaaaacacaccagttacaatggcgatcattaaaaagtcaggaaacatcaggtgctggggaagatgtggagaaataggtgtgcttttacactgttggtgggagtgtaaattagttcaaccattgtggaagacagtgtggcaattcctcaaggatctagaaccagaagtaccatttgatccagcaatcccattactggttatatacccaaaggattataaatcattctactataaagacacatgcacatgtatgtttgttgcagcactgttcacaatagcaaagacttggaaccaacccaaatgctcatcaatgatagactggataaagaaaacgtggcacagatacaccatggaatactatgcagccataagaaaggatgagttcatgtccttggcagggacatggatgaagctggaagccatcaatctcagcaaactaacacaggaacagaaaaccaggcaccgcatgttctcactcgtaagtgggagttgaacaacgagagcccatggacacagggacgggaacatcacacaccggggcctgtcgaggggtgggaggttaggggagggatagcagtaagagaaatacctaatgtagatgacaggttgatgggtgcagcaaaccaccatggcatgtgtatacctatgtaacaaacctgcacgttctgcacatgtatcccagaacttaaagtataataataataaaaaaaaaatcctgaccaaattatttattcaatgtgaaattaattgtaagttagtgttgccaggagagcttattacttagttaccatgtattccctctcatctcctgctttgtttataaagctaaaagcaaattacttaggacagcaatgtcaaatcactttctttccccaaagcatctgattttagatagcgctgtgtgtgttttaaaagcccctacctcgacttaggcaaacagaaccttcgtttaccatgctattcccatcccgcctttgaaacttctgaaaaggcagagcggagtaattgtttcagacatctgcttagcatactttgaagtgcatataagttctttttcagtttcatttgaaccccagctgtcttcaccgaagtctataatcaatctgaattaagttgtcctacttctcctaataagtctcttattaagttctgcatcagcctcttagggagacttaaaagctaattcatgtagaattgccattttctactaattcacttgtcagctctccaaattccaacaaaaacaattgcaaagactattaatttggctcttcataaacaacttatgtaagtgtagtatacattggaaccaaacaaacgatttaaaacagtgggtgggaggaaatgagttgatggcattcaaaacgcttccttttttgactgttatgaaatgccttccacatcgaaagcataaagccatttatttaataagggaaacatccttctgcttttactttcatagatgagataatgactgaatgaactttgcttaaagacaggaaaaggctttagaacagttggaaaaggaacatgttctttttgtcattgaacttattttaatttggacttctttgtgttattttgatggactgtgataaaagaaggagctagaattggttattattgttattggattaaatcagagttgtacagctactcttctggtcatgggatatttaggagaacacgggtaatcaaaatgttcagctaatgagttcatctgattctactcaagaagtgtttaatcagataataaaaatttctccaaataataccatccttcctactatttgaaaacaaccatatcaacatctgatcctataatatgccaatcctgtttgctaggattttctgaaagctttgtttgtggtgggtaataactagaaatactattcctcaagagtctcgggtaataaaagattattcaaaaaacttaagtaatatactctcagtattagaggatatacaaatgcactcattcattaattcatgatatgattgaaacctatacccagagaagtctgatctcattatagagtgtgaacatttaatttatttcaaaaacaaaaattatattgagagttgtatagatggcatcttagttttcctgggaatattattatttagcaccaagctgagggagcaagaatttgtattagcttgtgtatacatgtgcatgtaccacattaactagaaacagtgctaaaatgtgagttatttatttaactgaaattccatatttcctaagaaaatggaatcacacagccaatatatatttttaattattttttgacatctaccaaagttgtgacaagaataaagttcacaattctgttactctcctaccgttcagtaaaacaggaaatgctttaagatcaaataacccaaggagttcgcttcttcctgtcatgcttgacaattacaattttcaaaatttaacagttagcattgacaccagtattatgccttacacaacctgaaattaactaagttaagtaatggcattgaataatttttcttggtaaatcagttttctgggtattatgggaacagttgtgtctgtgatactaatgtctctctcattttaatggggcctaagaaagaactttttcataataagattttttcatgttaaaataatatttttagttatagtttacacttactgcaggtttttctatttaaaagcatcttccgagagcagtgattcttaaacttatttacttcagttatcttaacagcatagaagacatagcctgacatctcccgcttccacttacctatctcctttttccatgagcatgaaatttctttgatgttcttgttttattttttaaatctcacatcaattttatggtattttccataatggattcatcatgttttaatatgaagatgctttttcttcaaattctgaagtaaggaatctttcagcacattcacctatggacatgaaagcgtaagttgagaatcacagtataaaggattgcccagtttttgcaggctttatctttttccatcaacttctgtcttttatgtacacagacaaaaagagcagacccttgctatttcaaatttatcttttgcaggttcatctgattattgtgatccaaagttccatgactagcagctcttaattttgaacatgtattatttcaagcttttgtgcatagtcacttaactaatgagttaaatggcattttaagtcaggttccatgaacgcagaccctgagaacaggggtctaggtgcctgtgatttatagagggtctgctctcaggagaagcctgtattggagttagggaaacaatacaggagaagaaagagcccagcaagtatgccatttcaggtgaaacctcacattgtgtctgatccagagagagagcaagccctcgagcagaaacctcgctgtggagttgtactctttattttattttatttttttgagatggagtttcgctcttgttgcccaggctggagtgcaatctcagctcactgcaacctccgcctcccaggttcaagtgattctcctgcctcagcctcctgagtagctgggattacaggcatgcaccgccacgcctggctaatttttgtgtttttagtagagatggggtttcaccatgttagtcaggctggtcttgaactcctgacctcaggtgatctgcccacctcagcctcccaaagtgctgggattacaggcgtaagccacaacaccgagccggagttgtgcctttataccagtcattgtctgtgtcactgaagtgctggcaaatatttgtcgactagctctgaggtgggatgaatcctggtgtgtatcaaaaccagttttcgtggtgtaaatactccctctaccactgatctccagctaccgacataatgccactgagtatggaattgggaggagatgcacacaattggctcttgggctctgctgcagcacaccactggctgtggtccactcctgggatatgggttacttcctgggctagggggctcccataagcagaggtcacatgtggagaaggcaggtagctataagacattaatagtcaaccatcacagcagctgaaggatggatgcccaggttaggtaaagtgtcccctgcaactaataagtaaacctagtaatccactcactcttcatattcaacttggctttttttaatgctgttttgtttttgcatgtacagtaattctttataaataatgagaattttgtttctttatggaaaatccacctaccctccaccctaccatgaatagcttgatagctgttcatcagaattagtgatggaagagaagagttaatgaatgaaaaagtctaagaaagtgatcactattagtaagaaaatggcctcataagtgagtttggctttatagttatggaatctgtaaatgtctaggcattcagacatgtccagacatcattgagaatgtcaagaattttcagtggcaatggttctcacctcagcatacatcagaatcacctggagggcttgtagaaactcaggttggtgaaccccttccccagagttcctgattcaaaatgtctggggcaaggctaagaagtcccaacttgttcccaggtgttcatgatgctgctggttcagagatacattctgagaaccaatattccatagtaaagctactgtgtatgtacctgaagacatattttgtgtagtgttagcgtttcttcaattacaagtaataaatatatcatttattatttcttttatatttatcaatatccagaagatttagtttaaaaatgaatgcaggcacacagcctcttgttggattgattaatagtttagatatgggagcatcatagggagcattgtttcgcttaggaaccttgaaatgaataaatggcttcttttctaaatctcacttgtggaagactttgacggtggtttatttcattttttcctgttggtattttaatgacactggtacaattttggggttgcttcagatgaccaacagcataacttgccttcccagtattaatttttaacgttaaaaatatttagtcatggccggccgtggtggctcacgcctgtaatcccagcactttgggaggccgaggtgggtgggttgcatgagctcaggagtttaagaccagcctggacaacatagtgaaacctcgtttggacaaaaaatacaaaaattaaccaggtgtggtggcatgtgtctgtagtcccagctacccgaaaggctggggcaggaggactgtttgagcacaggaggttgaggctgcagtgtgccctgttcactccactgtactccaggctgagtgacaaagcaagaccttgtctcaaactatatatatatttagtcacataacttttcactttgtgtaaatattttttgcatttaccaataaaaacaattacatttaaaaattctccttacacttttctaccaaacatactgatgataaaatagtactttatagagtttctgaatctaggatattaaaaatagttgggatcagtcaacactttttaagtaaaatctacttgctagatatgaatagctaacagcttctccaggagtgcctacattttataacttactttgtccaccccttgaggctctgtgttcagggggagggtatatttttgtgtatagaaatagagatgaggtgaaatagagatgaaatagagatgatgtgggatcaactgggagaaagtagaaaagagtcttagctgaagtggttgaggaaggaggatttttcccaaaatggtgcaaaaaacaatgtattaaatatctgtgaaaaagttcatggttgtggtatagggtgagtggtatatgaaaagagaattatgggataaactaatggaaacagatgtcttaaaatttgcttttaactttaaacaagagacatgaaacttaaacttttcccttatcctagaatctgggagaggagaaggatgagaaaaaatgaaattttacattagaagcaatttgattaatgttcaatggaaaatggaaatagctatggtcaaacccactcaaatcaagtgtacattaaataattgagttaactgaattaggcagagtaagggcacattgattttcagtgttgttgaaaattggtccacatatcattgttatgctttttgtttgtaaacctcaatatttattaagtttccacagtgtgctcagccctgaaacgccaaattctcttaaccagaatgaggctggaggatctaacactaagacagatttctattttcttttaaggaattgatttttatggtaattttttttcttcataaagttaagaacctgccagtcctgtttcgaaacacacttatttttagaagtttggttttccgggattatgcatcattatagactcaaatgactcatttagaacttttccctatcaaatattcacattctatcatcatgatcttaacacggcataagcaagttagtgaacagagtgaagtcaatttattggcaatatatgccgaagtacaggaattaagtagaaacaaaagtgaatgagagtctttggcaatacattgatgtgttttttttagaaccaatgataaactactgctgagtttcctttcatttacttttttcctactcttaaaacattgtaacccattttgagatctatccattgttgtgaacctaaagcctattaggtcttattaaataatacccatttaactgacctgtgatttaagtttcttatctgcccccaagcaagcagactgtatgcaacggcattttacctgcttcaccttctgcttgccagttggtttttggtcttcacatgtttctagcagggatggggctaaagcaagggagagaatggtccattgttttagactttcacaaacccaatatactagaatctccacaaaggttatccaatatcagggtgacttttgtgcatccaataaagcataaggttaaaagaaatacaggctaaacaaatgagcataaattactccgttggcttatgctgtgaataaaatattacctttggaaccatctcaattttttttttgtataaaggttgaaggaagacatttgcaaagtcgtttctcctataaaactgcctagggtttggggttgattgttgtatgcaagaggggtcttggtgaaatctgacccactttgaatctaaaattactgaattattagtgaaaagattattttaaaaagagttttgaactctttttcctactgaaattgtattctcctttagataatcaatgcagcatcacccccacagatttttgagggcactaaatcatactcctattttgaaaaagaaaaaagtctattactattaaatatatctgttagttgaatatcaatcactttttctaaagggtagatttggccaatgagtgatttttttttttttttttttttggaaatcacatctgagaacgttgtttagacagcttgacacttagactcatttgtgtaagtagtaatttattcatcatttgcatgtacttaactggacattatcatgatagcagttgtcataacagactattacaggatatgaatttagatattaccttaagatgtgatcataaaaatcagaataatatcttgaaaatatcaattttatggtgagaaaaatgacaaactgaataaactcttgactcaagaagctagacttttcacaacctcatgtattcacagaagtaaaaataacaactaataatgtgtccagagggcccacattgctcagaaatgaatacataagactttcttttcagcctcagaatatgatgaaaagaagatgaaccattatgatgttgcatagattttaatgaagaaaattcgttttctgttcctttcgtttgactttaagtagttgaacatcctgcttttttattttgtttgcaagaaataagaccattttagaaaggctaaaaacattaattacatttaggaactacaataatctgaaagtaaaattggatattaaaggacgtttttgcaatcctttttagccctcttctgtgtattatttttatcactgctcttaaaaatttgtattaatctttggttcatttctgccttagtatttctaagttaataatatattgaatgaaaaatcaaatcagtaaaaatccattttgtttcagtagtgagtgccttccccctagaaccaaaactaaataaatgtgctccatataaagcaaaccaggtacagcatattgcacgggtaactcacaattctagattcctctattaatcattattcagacatgcagaggtagcttaatttgctttaataagtgaaaacagaatctctttgagactgctatctgcaatattatactttgtcctgcattttcttggtcaaaaattgtattttatagccatgatatattttggcttggaatttgcttctttataagcctagttattaatagtcatcatttaaatgaaatgatatccattagccttaagctgcatgattacagagacttggtctatcttacgctgtatttccagtgcctagaacattccctggcatataataggtacccaataatagtttttggaataaatgaataaacaaatttgtgcaaaagcatagggcaaaatgctatcttttagatagcgtgacccttaaaaattattttgcaaataatttgctccatttgccaccagcttatttctggccattgttacttcttgtctctgcatacaaacactctgtgtctcttctcctttccacaatgaccacaagttatactgatctacttgagattttccaggtgactatttcatgtccagaggaacatgcctcttctagtgttcccctctgtgaatgatttcagtcaccttatctactcaggaggtctctcttcccctccatcagcatctttctctgcaccttccaaacccctatgactcaacttctcataatatggattgcattttttttaatgacccattaaattgtgtacctctgctaatgattgtgagtgtgttgagacttccatttttccagtggatgataggtatataatatatatatatatacacacacacacacacacacacacacacacacacacacatatatgtgggcacagtatctagtggatataaagtaagtgttttcaagtgagtagtaattaaatctaagagttgccgagaaaatgccattcccgttttgtggacatcttcattctacattgtaaaggccacctcattcaagacccaccacaatcttgatcccagaaaacacccatgattcatcttttacagctgccctgtacttcatattttaagttattaaaggctatttgcttttcctcagacacacattaaactttcctacctcttaccctttgttcaagttctgaacacatatctttcttccccacactatgcttcctctttatcagtttcatgtacctactttccaatgtctagttcgaggagacgtttataaggctacatgatagaggttgcccctggggcgatgtgagaaatcagctccaaaaaggtagctacccggcaaaggatcttagtctgtgactctctcatggatgaacttattacctactgctttgcagagtctccctggactagcctgaataggaacttgtgtgactatatgtgaactaaaagaaggagaaatatgcctaaacttctcatccatctttgtaacagccctaaagtatgcatgttactatcccttttctacacaagtggaaaatatttgtaaatgaacttcgttacagtctaatatttgatgacttcttagttcatatcattatttaagtaacttttctttagtggaaaagcccaaaaattagggaggcagggagagagagagagagagagagagggatcatctgtaatctcagccccagcatctataatcccaatccctgcaagggcctctttgggcaaagaagaaaaaggcactgtgtttttgaagagatccccggtcctatgccaagcctaaccaatttggtagtagagcccaggctggatttcagttggtttgtagtcttctagtcttttcatatgtaaatatttttaatgcttttattcagtgttgttaaaatgccctccaaaagatgcactaacttgtgccaccaccaccaagcagaatatattttccttgaataggctacttcctctttttttcccactcactccatttttattttaaaaatccctggtagagaccaaaaactgaaatgttatattcttgcccaaagaatgagagatgcttcagaaattagcaaatgctccaatataaatcaagtgatagatataaataattcagatatgggataaggaaaatgggtagctttctcttatttaggaactctatgtcaggtttctgtgagaaactgtttacgaagcagtctgacaatagctattggtctgaagtattagtaattagtacagaagtgcctaattctcttgactgcttgttctttaataaaaatgtattgagggattatcatgtactatggcttggcatatactggtgaaaaacaataatgtaggattgccttaataaattttctggtcttgggaaggaacagacaatgaataaatgaataggcaaatatatatgtacttgcaaattgtgatcagggttcagaaggaaaatagggtgttgagagtcaaggaaaaaggagacactttacgtagggcaaccaactgggaataggctatctttaaaagtcacatctaactgagatcagaagtatatgaataagagccagctaggcataaagtggatatataaaactccaagcagagggaacagtgtatctgaaggttctaagtcaagagtaagcttgggccaggcacggtggctcatgcttgtaatcccaacactttgggaggccgaagtgggaggatcacttgagcccaggagtttgagaccagcctggaaaacatagagagatcccatctcgcaaaaaaaaaaaaaaaaaagaaaaagaaaaaactaacttaaaaatatatatatatcaatgccagtggtgtgtgcttgtagtcctggctaacttgggaggctgaagcaggaggatcgcttgagcccaggagtttgaggctgcagtgagctatgatcgcactgctgcactccagcctgggcgacagaaagaggccctgtctgaaaaataaaataaaaataaataaagaaataaaaagcttgatgagttctaggaactcaacattttctaacttcttattagaaatgccaaattctcaggcccaccttacacccactgaatcaaaagcactaagtgggactcagcagtctctgtgttaacaagccttccacatgacaatgagatgcacactattgtgtgagaatcactgccttagactgatgttttgagctatttaggggagggagagggcccattcagggacaatggtggttaacacatgtggctcagaccaagaaatgattgcaagcccaaaaacttgttaaatgtaaaacttcaggcgcagtggctcacgcctgtaatcccagcactttgggaggccgaggcgggtggatcatctgatgtcaggagttcaagaccagcctggccaacaaggtgaaacccagtctctagtaaaaatagaaaaattagccaggcatggtggtggtgtgcgcctgtaatcccagctacttgggaggttgaagcaggagaatcgcttgaacccacgaggcggaggttgcagtgagcccagatcgcaccattgcactccagccggggcgacaagagcaaaactctatctcaaaaaaaaagtaaaacttcatctgtctgaagtaacttctgaatttgaagataaacatcctcatggttgatattttaatggtttatggattattacttacttttaaggaagttaataggtttcattaactgccattttgcttcattttgtcacatataattaaaatttttcagacagaaaatattggtattttttctgtttccttagcaacctaaagcatgacctgcttaaatgacttatttgtgctcattaaaagcctttttgtgttaattgtgtatattttgtatttagcctctgtgaaacactcatgaactatctttttatttgttttaattgtgtcattggaaagcttgaagtattttgtggttttttttttttttttttttttttttgcttgttttttgtctataaaggggagataactggcagttgcagttaggattatagaaacattttcccaaggaaattaataaaatttgttcaagtttcttcttttacaaattgtacttatttttgattttttaaatagtggtaaaatacaaattacatgaagtttactatcttggctctatttaaatgtatacttccatggcattacatacatttacgttgttctgctgccatcaccaccatccatctccagaactcttctcatcttgcaaaactgaaactctatgtctattcaacgataatccccaccaggcatggtggctcacacctgtaatctcaacactttgggaggccaaggcaggcggatcacctgaggccaggagttcgagaccagcctggccaacatggtaaaaccccatctctactaaaaatacaaaaattagctgggcgtggtggtgcacacctgtaatcccagctacttgggaggctgaggcagcagaattgcttgaacctgggaggcggaggttgcagtgagctgagatcgagatcacaccactgcactccagcctgggcaacagagcgagactccatctcaaaaggaacaaaaaagaaaaaaccacagtaattccccattgcttcctgcccccagcccctggaaaccaccattctatttcctgtctataaatctgaatactcatttctatatcttctttggagaaatgtctattcaggttacttgctcattttttagtcaggtgatttgttttcttgctattgagttgtaggagttccttgtgtattttgaatactgaccccttaccgggtgtatggtttgcaaaatatcaattgctcctgctatgttcaacttgttcttaaaaataaaaacttttcctttgtggtcaatacttccctgttcctcatttccaaattttatacatgaaggaaatgtgagcacccagaaaagaaagaagatagacactgttaatatggccaagatataattcggcttttattataagaacattggagttacaagcttcatagaaagccatgtcctaaaagatgaagaattatgatcagtgcaaagagaaaatgttaaaaagaaaaagttatccttttatgtttgggtatatattctttttcgatattgtaaagagaaactagagttttttgttcttgtttttgagacagagttttgctcttgttgcccaggctggagtgcaatgttgcaatctcagctcactgcaacctccacctcccgggttcaagcaattctcctgcctcagcctccagagtggctgggattacaggtgtgcaccaccatgcccggctaatttttctgtttttagtagagacagggtttcactgtgttggccaggctcgtctgtaactcctgacctcaggtgatccacccacctcagcctcccaaagtgataggattacaggcgtgagccaccgcacctggttgagattgttttttataaaaagatgtggattctttatggaaaacacagagcagttaattgctatttttttaatgtcacaaatttggaagcgtgttgagtctgagaagaaaccatagttaaaatataattactgataatcgcttgggaaataaaagccctaaatttcttcatgcctacaaacttaatattgttttcccaagatcttttttttgactttaacctttcttaagtgtttctgattatgctaaatctaggccattagttctgagtctgtttcattatttatattgttattcagtttactcgtcaaaagtgatcatgcccaaatatgaaagtttacaagaattgccctgaaaactgaacggaaggagacaacgaaaagaaactgcataatattttgccttcaggctatcacaataaaaactgttgctggaaaaaaatgcaatcacatcccttttttttttttaaagtacgtttcaatggcataatttattgtcgagaatgtctctaccagaagcataagtgatactaaaggcagagggttgtattcgctcagtctgcaaagtatcccctttgtcttagctccacacagtccctcagaatttggcagaaatgagggactcaactttcgagaaagggtgacaatcccagttttgttggagagctatgaaatagccccatagtgttagtaatgaaaattcacttaagaagtctcctgcaggcccggcacggtggctcaggcctgtaatcccagcactttgggaggcctacgtgggtggatcacctgaggtcaagagttcaagaccagcctggccaacatggtgaaaccccatctcttctaaaaatacaaaattagccaggcgtggtggcgggcacctgtaatcccagctactcaggaggctgaggcaggagaatcacttgaacccaggaggtagaagttgcagtgagccgagatcgtgccattgtactccagcctgggcagcaagagtgaaactccaccttggaaaaaaaaaaaaaaaaggaaagaaaggaaggaaaggaaggaaggaaggaaggaaagaaaaaagagaaagaagtctcttgaaaaaaagaaaggaagaaagaaagaaagaaagaagtctcctgtataaaaaaaggaaagaaagaaaagaaggaaggaaggaagaaaagaaaagaaaagtctcctgaaaaaaaaaaaaaaacaaaatataagtgcttgacaactgaagttcaagggtaaaggctattgggaaagcagatgaagttaatctaagtaatggatgctgttggtgccccagtcagattcgttcactgggttggtgcacccattcctcagtgactctgagtattagctgctaaagcctcatggtttcacccctttccagagaacctccctcagccaaaaggaagccaccttgactggcatgtcccaccacaccttctctcttaaaaccaccaggggtacaaagggaaaacccctttgcctcatcatggcacctgctgttgtacaatttgtgatctgggaattcccatggggccagattgatgctggtctccagcccataccacatcccaacttaactttcttgccctgtcttcctgcttctctcactccctttttcttaagagcactcagactctgcttctcttaaacctggctgaaggcagtaggtatctgaaagaaaagctgtacctacattctgggcatcagagcagtcagggaaccaaccagaatgaaaagtcaaaaattacagataatgatggaagtctctgagcctgatacatttcatgaagggcttgcttacagctcaacttgtgtttctttttaattgtttcaacagcatttgagtagctcattccgcccaggtatttgagagattccagtaggcctctgatcctctggaaaaagcaagatacagtccttgactctcttggccccatgaggatgatatatctgctgagaaatgcaggagctgcaaaacatagctgggctgtacctgctgccaattcccgggtaattgcattctgtgagggcttccctgaaccacgaggaagagccccggaataagtactaaacaccagtatttataggacatgatttctaattgctcatccttgccttctcatgactagctcagcatgaagaatgctgggacttttctttcctagcacctcctctttttaggctgttttccaagagtcttggttaacaaacatttgtttgacaaggattcatggtagacagcaatgccattagtccctacttaagtaatatttgtaacataaatttctctgcacgtgtatgtagcccaagaataacacttcatttttggaacctagtaattttgaattcctagtaagtgagataggacgtctatgagttagcaggttaagattttaggaggaatatttaatatccctaagaagggaagtttttcaaacactgagtagcactatatatatttatatatatatagccagatttctatctatctatctatctatatatatatatatatatatatatatatatatatatcacaccatttataaataaactcataagtggcaaatccagtagagctaatctgagcatcccagagtctcccctctctgtcgcttgtttgtgcagctactcctgctgtggccttttatggattatcctggacttctacaactgacccctctactttctctccatctacaagcttcattttgctttgctttcctcctaatccagtttagattccacagtatattttttcaattacatcctggctaatatcgaaactcccttatccctaaatgtgtgagccacagtcatctgacgaaaccccaaacctggatcaactgttttccccatgcttacatgcaacactgttggagaaaatgagaaagtcaggcagattggttctgctaaaaaatgttgaacctcatcctcaagtgggccctcaacactgtttgccaacctcattacatctcttaggtcaactccctctcacagtctctattacgattaattcaaatgttcccacttacccttaattcatgttttcattcagtgactattcattgcacaccaggcactgcacgctatgccaggcactgcagactatgccaggtctgttgattcctacttcacagaggaaataaaacccctccaagcagaattccctcaatttactctttctagtctttccaactgaccttctgtgctttgcagtaggaatgttctcttaactgtcaagtcaaaattcctccctcaaaaataagattcccttgttaatagacaattcctttattttcttagaaaagtagtagatgactataattttaaatgtgtatttgaacaaatccttagctacataaagataagcaaagatatgacaggcaatttaattttatatgaagaaaaacttattatatcagacttacctatcattctaaatcagtacttttgtatctataatcagacaacatttaatgaactgaaaattctgcctgtgagaaactagtcataataaaattagacttggtttgctctttcatggagaacatattccagatgtttaagtgattcaaagaaaacccacaatataatggctttcttcaatgttttctcacttactgcttccaaactagaaaaaaaacctaatgcaatcctgatatcacttaaatagcacctcgtattgctcagcgttaactgtgctttttgacattttaggtgtagtgtttaataatttaaacacaaatttatgtgtgtcatattaaaagctctaatctgtgaaatatagccaaaccaatgtcacatctatttaaatagcaaagtacctgtgttcaccctttacagggtgaaggtcttgtgactctgtgtttaggcggccatacttcttgttatgtatgctgctgggcactgagagcccacagtggtgagccatccttgggtggtaaaagctgctaccaaaacctaaatcaaatgccaaagtgaagactgacatgagcattctcctgcctccttttcctttttatctttcctaccatctgttatctcctttcttccaccttcatgcgttgagtgccctcatgatgatttctagctgactgaagtcctttagtctgctcaaccccatctagagacttccccaaagtgaacctttgcccccagttatctgtttatcaactgacctcacaccagtcaaagcttccattgtcaaatattttaacagaaatttaggaattcagattaaactgaatatttggcattttttcttttttttttttttttttttttggagacagagtcttgctgggtcacccaggctggagtgagtgcagtggtgccatcttggctcactgcaacctccacctcccaggttcaagcgcttctcatgcctcagccccctgagtagctggtactacaggcatgtgccaccacgcccgaataatttttgtatctttagtagagacagggtttcaccatgttggccagtctggtctcgaactgctgacctcaagtgatccacccatccacccacctcagcctcccaaagtgctgggattacagtcttgagccaccccacctggtctgggttgttttcttcatctttagcagttgtcttgttcacaactacttcaacaatatttattttctttttctttttgaagcaactctccagagtatttggcctggtttttatagaaataataacttttttcttttctttttaaactaatatttttatgatttaggaaatctttctttattaaattacataatcacaacagttactggcaaagataggtttgagaacatacacacaactgacggttgtaacaagtcaactgatgggagcagaaggtccacacatactgacaggcacctcgaacattttattgaggctgtgagaggttcccatcactgctgtttcacaaagagaatgaagactttggctaatttggtgagtcttaagtggagattagttcagagaacttccactatcattgcttgaaagaagcaaaaaaaaaaaaaaaaaaaaaaaaaatcccaagatcttatggtaaagtttaaagaagaaaagtaaattttaaaaagaaaaaaaaagaggaaaagggagagcattgcaattaattatgagtaccaaaacttatttttgaatccccttcatcctccaaaacattgaagcaggattaatatgtgtgctcaggaatttgggagagaaaatgaaaatcaaaatattctaataagagacatttgaaaatgtacattgtgtcacctaaagggaactgaaatctagctatggcttaacgaggtaggataatcaacttaatggcttgagagtcttgcttgtaaagagagatgattagcacaaaggactcacctgtatcactgaaagatgctgcctgctggcttgccctctctgcagaggttcctgtttacagtttcccctcacatgatatttatttgtggctactagaaatgcacgttattatccagaagagaatgatttcattttgtaaccgttgtccttgtccaagtttcccccattgacatttaagaaatctgttttctaacctttctattatgcaaaacaaaattaatatggatcatttccttttagagataagtattcatatatatggatttaaaccacctttctccatgggcccttattctgatacttttaatccatgtatttattcataaggaaatggaacaatatttactatccacccctataaaactttctgaatttcacactgattccagtgacattccactaacacgaagttgaatacagatgaatacatcacatatgattttttttttgcatgtgtatggtcagaaggggctctcttttgtttgtttttattaatatataattcacatactttaaaattcactctttcaaagtgtacaattcagtggtgtttagtatattcacaagattgtgccaccatcaccattgtttaataccagaacattttcgttatcgtccaaaagaaaccccctgattgcttaacgtaatgtttttaatgaccactttttaaaactttaagttcaacagagtgattatcacaatgttttgtattatctaagaactacacaacagtgttatgctctatacagcaccacggtttactgatgaagtattcaggttgatttgagaggataatgtcgttcttattttgaatgttcatactggctccttttatttggagtgggaggaaatgcaaggcttataaatgaggtcagtgtaaccaatggttttatcaacatagtgaaccagacagagaaataacacctgcccagatcaagcaagtcaaaacaacacgtatagtcaagtggtgctgtccttgtacacagacattacattacacaaactgttctcctaagtgagggaatttgtcccttagaaattgcttattggaacatttggacatcatgcatcatgttaaagatccataaatgccatctcgatagggtagatatgaggcgtggtaatatcctccccatatctgcatagggttcttctgctcaacggattgctatgatgtattgcatcagagactcctgctctagtgcttcaaagacagctgagaagccccacgggagccttctgaagtcattgctacaagggctaaaataccaggagatcaggaagtcattctgaggacttgacaaaataccctactccctaaatgaaactgttatgatgtggttggtgcaaagtatgcatgcaatattttatgactgaatatatctttctattgtaaaaaataaggatccatttctggttgtgacatgagtagaatttagaatccagcagcaatatatttttcttgttactttgccaatccagaatttcttaggggaagcatataacataatagttaagaatatatattctagaggcaggcaaacctgcatataggtatcccaggttcctcaatttttacccatgagagcttggcaaggtttgtttgttttgaaaacaaacctctgcaagtttgttttctcatgtataaaattagaattctccaactactggcctcataggattgttgggtagaaataaaatcagtttatgtatgaatagagctcatcatggcattaggcacctaggaagtgctcaacaaatagtagttatcattattcccccattaacaaatatccattgttataatactaccacaagagactgtcttagtctgttccagctgctataatagaaatgccataaattggatagcttgtgaaacaacaaaaacttatttctcactgttctggaggttgagaagtccaagatcaaaataccagcagatttggtgtctggggaaggcccattcctcatacaaagcaccttctcactgcaccctcacatgctgaaaggagctagctagctctctgaggtctcttttataagggcgctaatcccaaaaatcacctccctaaaggccccatctcctaataccattgccttaggtgttttgatttcgtttcctttttattttttaggatttcaacataggaatttgaggggggacacaaacattcaaaccgtagcatagagcaaacattactggcactgcaccctaaagagaataagcccaggtatcagttcttcttgttttaaatattctcatcttccaatttgcttttgactattgcacacaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtaagcacattgtaaacattgttgtcctttgttacagtaaaataatatacagataaaatttgtaaagaacaatgaaagtacttttttcatgtaatgttcatggtaatatttgtgaggataggatattttatattagtttataattcccatctaaacattttcaaattattaatattaattttggaagcaactaagacttagtatatgtcttagtctgtttagtgttgctataaaagaatacttggggctgggtaattcataaagaacaggtgtttatttggctcagttctgcaggctgtacaagaagcatctgcttctggcgagggcgtcaggctgcttccactcatggcagaaggcaaaggggagctggtgtacaaagatcacacggcaagagaggaggagaaaaagagggaggggaggtgccagttctcatgaaaactgctagagcaaaacctcgctcactaccgtgagaatggcaccaaaccattcatgagggattcactcctacaacccagacaccttccactaggcctcaccaccaacacgggggatcagatttcaacacgcgagttagagggaacatccaaactctgtgtagcagtattcttacgataaacagaaaataatgctgaatcatgatggaagatgtgaattgccaccatgcagttcctttgtactcttactgcttggattctcaaaaacatctttccctttagaatcctaatttaaacaagagtcaatagtaagatgtgtccaaaagtcatttaaagaaagagcatcctatcacaaacttacatgtggaagtttttcgtaggtttgcgtaataaatacaggcaatgtaagtgtgctgctcaaggtcacacttactagccatgggacctggagcaaattacttaacctttctgagcctcagtctttcatcaaaaaaaaaaaaatgcgataataaaattctctgcaatatcagtttattattaggatgaataagtcaaaataaatggaaagtgctcgggagcgaacatgccaaatgataaacactctacaaattctagctcttgatgttgttattattattattattacagtacacaggttttggaatccaacatattagctgagtgaccttgaggccacttaatctctgtggttgtccatttactcatctctaacatggttactgtaacatcgaatgagttaattcatgcagagtaatggttgtagtggtggaagaggtgcgtctaccttctcagtgtgaaggacaccatgttataccccaaaaccctaaaattagtttaaccgtagaattagagaatcattttctctcctttccaattttctcctttccaacaggatgcagaaggtatgcctctgaggaaactgggtttaaaactatttggttttaactttttaataagaaaaatataataaaccaaatcactttcctattgtcagtccatttaggggtgtgattgagaggcctgttaaagaattgctagatctttaataaagataagttgcaaatcccagacctcttgagatctcacataatttaattcttgttgtgatggatagtcctgaaagatttgtattctagattgttataagtggcatcgactaaagcaaggcgatatagctaagtgattatatgcctttctctgtttgctccatagtagttgagtactattaaaattttatctgttccatccttagtatgtttttcatcttaagtataaataaggaaagtaataaatgtccaaagaaaaccaatggccacattagtcccatataagtgttctagaagtatattttataatttcttttagagagcagaatgccacgtttgctttcagaacgtggtaaaagatttgtgacagtggcaggtagatttccaaatgaggtcaaaggattatgactagtaagaaaagtttttttttttttaatcaatgctaagtgatccattctagttgcactatttatttgcatttaaggtatcaaaaacagtaaatagcttactatgtagccattctttacaatgagtaaaaacttggttataagtacaggaaaacacatgtaaggagatagtatgatatagcgaaaagagcattggattgactattaggaggtctaacttcaaacttaagctcagccattatttgaccgtgttattgtgagaaagccatttaacctctctcagctttaattctcctcatttttaaaatgcagaaatctattttgtctaaggtcacatacagttcaatcttatgattctgtctctagatatctgggggagatacacatttgacagaatttagtttaaaaccaatgaagttcctttctttattcataatacaaatgtggtttgttgaaattatatttctccttgtataactctaacttttaatctcttcttccctaaacccacatatacacagccttctcctattaaacagttcagtttgtggtgtctgctctatattgtagcaaatttcatgtttctatttttgaacatgaccttaaagatatgcttaaaaagtgtttttagcagaaagctgataaatccaaggttttggtttgcatataaccgagtcaagttagttccattcttttctttgatagtaattctgctacattataaatgtgaggccttgttcagaaagagaagaaagcaagaaatgaggttcacatcaagcaatttttttcccattactggaaaagcaattcatacatcctgttgagaatattttatatttagaacaatgtatgtgaggctaacgcattatccaagttctatggcgggaagcttgagcccaccaccattatgacatcatatttttttaaatagtaaatgtcaaaaaagacatatttctatgaaaataaagaatttagtcacaatgctatgtcaatctttaaatcgtgataaaaaccaagtacaagttcatctttgcctctgtccactaagacaaagaacaatcaaaaagtaaagaactctctgggcatggtggctcacgcctgtaatcccagcactttgggaggccgaggcaggcggatcacttgaggtcaggagtttgacaccagcctgaccagcatggtgaaacctcatctctactaaaaatacaaaacttacctgggtgtggtggtgcgtgcctgtaatcctagctactctggaggctgaggcaggagaattgcttgaaaccaggaggcagaggttgcagtgagctgagatcgtgccactgcactccagcctgggcgacagagccagactcggtctcaaaaataaaataaaataaaataaaaatagagaactggagtagtagaaaggcagatgtaaacctgagaaaagaagaagagtcttaaatttgggcaaaatagtataatagaaagattagagttacatactatcaggccgtgtctacttgatatcagaatatcctgggttctttgcattatccattcatttaattttcaaggaaagccatgctagttttttagctgtctgtaatatcagtcaaaatggtgaaaccagttaagggatgtgagcaccaacaatacagtcaaacccagtcacaatttacctatgtatagaatcataatgtatagagaattccaaactgactttgaatcttctaatagaaatgtaagagacattggtttgcctgtttgaaattttctgtgggaatgaagtcctattttcttcctcaaagtagacacattggtatgcatgttactatttgaccatttgactttttgtggtgtaggaaaccatcactccttgcagttagaaaaagtcctcatgtgcattctctcatctaagaatcacaaccttgtgattttgtattatgattatgattacctattatcattattcccttttacgtgtaaggaaaccgaggcttagaaacatgaagtaccacagtcacagtcacataacttgtatcagtcaagatctgagtcaggtttttcgaactgctattcccatgctctttttgtctcctcttctcaaaatcctattacgtttggacttaacaaagcaataatggctgggtgtggtggctcacgcctgtaatcccagtactttgggagggtgaggcgggtggatcacttgagatcaggagttcaagaccggcctggccaacacatagtgaaaccccatcactactaaaaatacaaaaattagctgggtgtggtggcgcacgcttgtagatcagctacttgggaagctgaggcaggagaatcgcttgaacccgggaggcggatgttgcagtaagctgagatcatgccactgcactccagcctgggcaacagagcaagacaccatttccaaaaaaaaaaaaaaaaagcaatactttaaaactattttggacaatacaggtgtaaaatacttcacttttttacatgtatcttcttttttgaaatgattcttaggtatattaacttttaaatcttccttttataaaccaatggattaatgaacccagttcagtgtaccccttagaaatcacacttgtttcaaatataaaattttaaagcattatattcctcattgcctttagaactcagcaattgtactaaaatcagccaaaagtgatttcagtgaatcagctcttaaagccaaactaatgctaatatttgaccaagtagaaacgaatatctaaaccaggtgagaaaaaagttaaaatgatgataaacctttctaattttgaaatagtacacacactgagtaatgcagtcaatctctttattcaccaagcgcaagtagtatataaaggaatattataccatttttctttactcatgagtaaacccacaaatagcacaaaagctgcaaaaacactttaacataaggagtatttgttttattgactgtaggaactcatggaatgcaaacacctttaaaatctgaataatatgaaggcatttccagctattagattctttacatatgtcaaagaacagtatcataaattatgtatgttttttaaaggtttcctaagcttcttccaaagtcatgtagacatcattacactccatctgtatacctctgtggtaacttgctgtcgcagggatctagagcctcatcttttgcaaacttcattccttctttcatccctttgttctttcattcagtcagcactgattgagcatctactgtgtacctagaagacattgtaatgatcctgtttggtccaaggacatactaaacaaaactccctttactgcttatgctatattaagtaaagctttaaagatgggttctcttttattacttccatgatggcccacccctctcatcctttctcagtgttaaaaaccagaaatatacatacttacatactatcataacactgatactacaaaagcagtacccattattatctctggtttacaaattattcaataatttcttactggaaacttggtctatatagtcatagtagtaagctttgtgagaggatgtgatgggatcatagttagctaaacaataggagtatttgtgtggcttcattttaaaaaaactaaccagtttttttccaacaagcaattcttatatcagaaccatttatattctttactttggtgagataggattttctaagcaggtcttttatctgtatctatgtatgtttgttcttaccatcattgagcacaggatttgatcctttaaatgtgttgacagattttgaacattttcctcatatctttcttttttgttttttaatgatcctgtactaatcattttgcattatggggtcacttctggacagagagcctagccatctgctcttacaaataatgtcggcctatcactaactggggataaggagaagacatctaccgatgtctttctagcatgtccttcttgactttttctttctttaagaagactaaaatgattcagcttgtggttctaccacagaactcaggagaaaatgataaatatgaggccattctccaaataaatatgttttcctacattagtggttctcaaattttaacaagcatcaaattcacctggaaggcttattaaaacacagataactgggctccacataccaagtttcaaatgattcagtgggtctggtgtggagcttgagaatctgcatctctaacaaactttcaagtgaggctaatgctgctgaatcatggaccacactttgataacccctgttctatgttaagtacttgtcaggtacagacaaatttaaaagttaaaaaaatatatatatgacttctgtaagacactgtgaagggtttagactctggggaaattaagtataatgccatcccaaaaactctgtgttggaggagtgttcaagtgctgcaggatcatggagaaccaagcacttaacttttctatgaggcagaaagaggaagataaagggaaacgtggaggatgaagggaaactgttaatagatccccagaaacacaatttgctgctatatggatttatatttactgtatttcaaatcacatggtctagaactgtgctgtccaatatgatagctacatatggccattgagcccttcaatgtagccagtcgaaagtgagatgtgtagtaagcgtaatatatacacatgtaatatgtatatgttatatatatgatatagatgtaatatgtatgttatatatatgatatatatgtaatatgtatatgttatatatatatatatatatcaggatgcaaagacttagtaccaaaaaaagaatgtaaaatatctcattatttttatattgattacatgttgaaatgatagtatttttatgtatttgcttgggtaaaatgtcataatgaatttcactcatttattatgattattcaaacttggttatttttcttgaaaatgaatgaagtgagcctgttgcttcggctacaacaatgggcagtgtttctgcaaaatttttacatgtgcctactagaacatttaaaattgtacatgtagcactcattatatttctgttggatagcattggcctaaaagttttcaaaatctagcatggataagaatcacctgcaaagcttgttaaaccaatccgcccccagaaatttagtatcgggtgaggcctgcaattctgcatttctatcatgctcccaggagatgctgtctatttgtaaccacatatagaaattcattcccaaactacagatgatagagttttacagagaggtgcaaaaatatatttttgcatcaagcattgtctgtagcttgaatacaaaattatgttgcccatataccactggtttttgtaagtaaagcagttgtgttacaaagcatacaagtttttatcagctaatagccttttctcaattagcagatactaagtagtacttttattatgtggcaattctccagtttttggaatgttattgagaaatacacagggttaaaacaaattagaaagcacctctcccaaaatactgcagtaagatgtaggaaaaactgctctaacatattctaaactataggttgctcttatgtaaatatttcaactataatatctagtctgatgtgcccactggccagagttttgtaaaagctaaaagtaaaggaaataaaaaaaagaaagaagtatgtgtttgtttttgaaaaggttaggtcacagaaggatttgttgatattaggaatagaatgacccgtgaaaaaaggacaattaagttccaggaaaacatcttttcagtaaggagagaataatcatttatgcttaacctcaactctgttaggaaaaaaaggatgtaaacaaaaccctttaaagaattgaagaaggagagtataaatttaaatgcccaggttagtgaccacccttagagcatactgaggtcaaagcgtactgtcaagcttaagaacatttggttttcaatgtttgtacaactaattgtactttagtcaagaggactgttatcgaaattgctcaggtagccttgaaactaatatggcccaaatattccagagtctgtctttctcaccctaggagaagaatggtctggttttcaagggaattctctattttttttttttgaaggcatcaggatgtgtgaaactacagggggataaatgaacgatgtacagaatgtgatgaaaaaattatatgaagtataaaatgggaatgaagccatcaggagccaaagaaatatttatgaatttaagagaatgaaaagcatattattattttcagatattttataaagtgaacccaaatcattataaagtattaattaggctacttgattgcttgatctttatatactaatttctaatttgttttaatcgggaactatttttgctagttctaaggctagctattatggtaatccatgtaagtgtgtttattattgtttttaaaaatggaatgtgttcctagtaaatgtgtttaaatagcaaaatgtatttatgcatgcatgtatttattttagtttcctgagacctctagttccttactagaaacatgtatataattccaggcatttaaaattgccatgatggtcatgttttcttgtccttttcccttattctgcaactgacatttgcccttgtctccaatttctcactgctttattctttgttcttgtaagtgttcttgtctctctgggctgacctctctccttccctggagtttgaccccgccccaccctttcttctgcatttgtttgcactggttgttttcttcattgcctttcccactgccccgctgcgctgcatgtgaaacactccgccagtagctgctcacagttcccatgctacatcatacccagcattcaaagagctgctgttctcacatggccgccagtaagattcccgactcctccttcacagcacattcctctagaaagtagaaagaatcccctttcaggccacatgagaagctgcgtgttaaagccaactccataaaggggaatggaaactagcgtatgaaattcagaaatgctacttttaaaggtaaataccacaaagtgaatttcaaattcatacagtttatcataatacttctttatttttataaatgctataatgtccttaatataatgatcactgtgatataagttgtcctctcccttaatatattaattaatttactaaaggagacgggagggtggaaatataataaattagaagatgattcttatatcagaagtacagcctttatacatagttttactttattcagacaatcaatgtagtcatatggtataaatttgaaaataattttagtgagcattacgcttactgagattaatagtgagaacttacctagcacttactgtatgccattcacaattataagcacttttgcatgtgctaatgcttttaagcctcacgtaacccagtgagggaggtacaattttaacctcattttacaggttagaaaaatgaggagcccaagggttaagtgacttgcctgtggtcatatatcaggtaagtgagagagccaggatttgaacccagacagtctgcctggggaatctgtcagaactcctaactatgcagtaccactcctctgataaaaagttgaattgacatgacaacatttcctattcatttatgattcgaccctttaaacaaaaagaacagcatcattctcacatttattaatttgtcaggaatcacctggatcatgagttgaggaaatttaaagtaggagggttgtatgaatttcagaccacgatctcaagaattgcctgtttaactcagagcctgaatcattcacagactaaaaactagaatcactcttctgtaggaccaagagggttgaatcatcaaagtcttgctgaagtgaacggaaatcctcctttgttcaatcattcattcaataattatttttttctggtgtctactctttaccaaactctgtttgagatgatagggattcagtcatagacagaccttctctgccctcatggaggttatggtttcttgggatgacagacagtaattttttaaatctcataaaataattacaaatgtgtcaggaaagaaaatacaggacactaccagaatatatagtaaggacctaaatgtgtgtgtgtgtgtgtgtgtgtgtgtgtgtgtgtgtgtgtgtgtgtgtgtgtgtgcgcgcgcgctgcagtaagggtgagaggcaggaaagggcaatcaggacaccctcccaataaaagtgacctttgaccgagatctgaaggatgaagacaagctgagtgactcttctattcatctatatcttttgttttaaatggcctgaagcctgggactaactaaacagggttgtaaaattccagtatgtaaattgaataactagggatcatttgaagtaatggactgcagagttaatgtataattaagtcacatctagggaagatttcccatcattatcacagagagcatcctgtttgctttcttcacagcacttacgaaaatctatagctatgtgtttggtggcttgtttaatgaaagtctgtttcccctatctgaatgtgagctccataaggacagaggccctgaataccacatctactgacatttggcagtgtctttcatatagtaagcattctataaatgtcttgaatagatgaatgcataaaactaagttaaaatgttactgaaaactataaaaataagcagaaagttataccagaggagaaaaattaggggaaaaaaactataatttctgaagacgtagtacttacatctaaatttgtggcttcataaggttaaccaacacttaaatagttttgccaaaactccaagaaaaaaatgaccgggtgtcgtggctcacgcctgtgatcccagcactttgggaggtcgaggtgggtggatcacctgaggttaggagttcgagaccagcctggccaacatggtgaaaccctatctctactaaaaatacaaaaaaattagccgggcatggtggcagacacctgtaatcccagttactcggaaggctgaggcaggagaaccacttgaacataggaggcggaggttgcagtgagccgagatcatgccactgcactccagcctgggcaacagagcaagactctgtctcaaaaaaaaaaaaaagaaagaaagaaaaaaaagaactaccatttgacccagcacttccattacttggtatgtacccaaagaaatataaatttttctaccaaaaagacgtgcgctcatatgttcattgcagcactattcacaatagcaaagacataaagtcaacctaggtgcccatcaatggtggattggataaagaaaacgtggcatatatgcaccatggaatactacacagctatgaaaaagaaggaaatcatgtcctctgtagcaacatggttggaactggaggtcattatcctaagcgaattaaagcagaaacagaaaaccaaataatgcatgtgctcacttataagcaggagctaacctttgggtacacatggatgtaaagttgggaacaacaggcactagtgacaagggcaggagggtgtgggacaagggctgaaaaaactacctatcgagtactatactcactacctgggtgacaggttcaactgtactccaaacctcagtgtcacacaatatacccatgtaataaacctgcacatgtaccccttgagtctaaaataaaaattgaaatctaaaaatataaaatatcaaatcataaaaataaataagaaaacaattgaatctactgatatgtttcattgcttttaaaatatccactttgaattactgaatattttaatatttttagttttacacttcagcacagaaagtccagaaatccaacccttgagtttacaaagacaccacatgatagttcatagttcacacagctagttagttgtggaactagaacccaaaatttgctctctatgtctctcacataccttttccctttattctaataaaggcatttgtcagtctaaatgtacaatattcgaagacattttttaaaggaactacttatccaaatcccacctgtcttacaaggtccatgtgaagcaatgagataaggtctgtgaaactgcttccgaaactatcaaatgttataaaaatgttaagttttattattagaactgcagttcatctctatgaaacctttctaaactttctcacttttctgaacttgactacgcagcgtcttttctaatctatttgttctccctttataagaagaatttaatcctttccgccctgctgggttgtaagaaaaaggactctcttcttttctataatctattgatatttgattatattacacatctaatgggttcccaataaatacatagtgaatagaattgaaccaaatttctttctagacatgtgaaaaaaaatcctgatctttaaatagaaagggtactttcaaagattatatatagaacctcttggtattttgtatttgcaatgaaaatattttaatttgggccaggtgcggtggctcacacctgtggtcccagcactctgggaggccgaggtgagcagatcatgaggtcaggcgttcgagaccagcctgaccaacatggtaaaaccccgtctcaatcaaaaatacaaaaattagccaggcatggtgacgcatgcctgtaatcccaactactcaggaggctgaggcaggagaatcacttgaacccgggaggtggaggttgcagtgagctgagatcatgccactgcactccagcctgggtagagagggagactccatctaaaaaagaaagaaagagagagagagaaagaaaagaaaagaaagaaaatattttaatttgtcttatgttcaacagttgcatcatatctgcatccttttgttaaaattgaacaggcttctagtttcatataataatttctggccaggcgcagtggctcacgcctgtaatcccagcactttgggaggccgaggcgggtggatcacctgaggtccggagttcgagaccagcctgaccaacatggagaaaccccatctctactaaaaatacaaaattagctgggcgtggtggcacatgcctgtaatctcagctactcgggaggctgaggcaggagaatggcttgaacccaggaggcggaggttgctgtgagccaagatcacgccattgcactccagccggggcaacaagagcgaaactccgtctcaaaataataataatcataatcatcatcatcataataataatttctaccaacagctggcaggaaaaaaatatgagagcatagtcatgaacttcagattccactccccttacttttggcattccattcctctgaattatagcttatatttctttattatctcagtttgatttagtctttctaaatattcacctctgtttccatccataaatatcgactgaactaccttttaatatactatctttttgtaacagagaaaatcaagtgtaggtggattattgtaagtgacactgaggaaatataaaaagaccttgacttgtccaggcgcggtggctcacgcctgtaatcccaccactttgggaggccgaggcgggtgaattacgagatcaggagatcaagaccatcctgaccaaatggtgaaatcctgtctctactgaaatacaaaacattagccgggcatggtggcaggcgcctgtagtcccagctacttgggaggctgaggctggagaatggcatgaacctgggaggcggagcttgcagtgagctgagatcatgccactgcactccagactggtgacagagtgagactccctctcaaaaaaaaaaaaaaaaaaaaaaaaaaaagaccttaacttgcttcaaacaagtcaggacccccaattccaattcttaggtctggcattcccatcagacacttaaactgtaggggcagtaaagttgcccatgtggctacagcttttgtggctgtgctgtacttgggaattttaatgttaccctctttgaattaggtccttcattgatcatgcatctcaaagtatctcagtgccacataaaaattttctttcagagtcatattttcccattatgaatgctacctactgcttatctgttgagtgtacacttttaaaccttctgtgggtggtggcccctttgccactgggtgagttagatgctgatcctggtcattatcgctgcctttccagccttttctgctcttacaccaagcacaagaattctctgctgatagtcaggatctagggctgggaaaatgggatgagttgtcctgttagacaggcccaaaaggagtattgtttaatccccagggtgtggggaagaaagatactcttgttttcttttccccaaatgtgtccatatacacccttctcctttgctggcagccaccaggcttgttgaggatctaccctcctctgcatatcatgtgcatcaagggaagccccaacccaagggaatacataatgatagtcctgagctatttcatggtgctctcgcagtcttgattgccctcttcggaattggacatggtcatattacgcaattttaggtaataaaatacaaagggcattcagctaagggaccttctgagaaaggtttttctcgtctagagaactaaacaggcatccttctccgggcactatgcgtagttctttattctacctggaacattctttctccagaaatctttgtgactaactctgtcatttccttcaagtcttattcaaatctcaacttaaaaaaaaaaaaaaccttcttaaaatttgaccacactaattagacagcaactgccccatctccctcttcccagccatctgaatccatttcccacttacctttttatgatagctcttctaggaaggcactccctcctccctgtgaatcatgtctccaggcaattgttccttgtgtagaggaacacaccaaatctgggctgctcctgtacaacaaactgaaggaggtagaattgattctgcaagaagttcaaagctaaataagaaggagtcttgtagcttctgtcttggtcttctggaatgctcactctggggaaagtgatctgccctgtactaagtctactctaaggccactgtgctgtctacatgaagaagccacaaatctaagctagccacatggggaagctgcatggaaagacaaatacgtggctagcccccagctgttggccgaagatccgcagccatcccaagtgaggagccagatgtacaagtgaaaaaactgtaacagccattccaatggagccttcagatcaattcagctttggctactatctgactgcaaacacatgaaagaacccaagcaagaaacacccacctgagcacagtcaactcacagaaccatgagcaatactgataaatggttatttttagccagtaagttctagggtgatatatagcaaaaggaacatctgtcctgttttttctggtttttcctatcatacactcattctgcaggattaacatgtgtaatatactttttttttttttttgagatggagtctcaatctgtcgcccaggctggagtgcagtggcatgatctcagctcactgcaacctccgcctgctgggttcaagtaattctcctgcctcagcctcccgagtagctgggactacaggcatccaccaccacgcccagctagtttttttttatttttagtagagacggggtttcaccatgctggccaggctggtctcgaactcctgacctcgtgatctgcccgccttggcctcccaagtgctgggattacaggcatgagccaccactcccggcctaatatacttttttaaattgtctttcactatgagaaggtgagctccatgaggccagggatattgtctgttttgttagctaatgtatccaaattacctaagaatagatcttagcgtggtaaatatttgttgaatgaacgagtgaatagatcagaatttcagtagctacgttgtgagtatgtggacagttcaccaagaatggcagaatggaaggatgggaggaacctggaataatgtcattgtgcttctggattacccagtcctggagcagctttgcctctgtgggccttgactagtcaagacattttgtgttgggtttttatgttaattccatttgcatcactataaaggaatacctgaggctgggtaatttataaggaaaagagatttcattggctcatggttctgcaggctgtacaggaagtgtggtgacagcctctgcttctggtgagggcttcagcaagcttacaatcatggtggaaggtgaaaggagaaccagcgtgtcacatggtgagagatggagtgagggggtgggaggtgccacactcttttaaacagtcagatcccacatgaactcactctgagtgagaactcacttattactgcaagaatggcactgagccattcgtgagggatccagccccatgatccagtctcccccaccgggccccacatccaacactggggattacatttcagcatgagatttgaagggaacaaacatccaacccatatcagttttctacaacctgcagcagaaagcatctcatctggcacatggtcttgcaaataattctgacttagatgcatgggactcagatatgactgaaccagaagataaatctaagtagcagacaccacagtattctcaaaaccactctttctctttctcttgttgaccgaggcttttctactgagcaaagcacctggtttataatatgttctttcattacgccttctcctaagagacctccttagtgtccctgcaatggatgtctggggagccaccaatctcttagagatgactagacatgtagccccagaaatggttacaccttgagcttttctctcagtgcagatgagatacattgcccatcccaccaatttgccacatttatctaaatttctgtgttaagctgggacctctaccactcaagctgggatgcccctcaccaccaccacactgcaaaaactaaacatttttcattagcctcctacttgcaattaagtacataaaacctgcaaaacaagtaataaaattaaggcactatttggttaatgccttttctcagaaatcacttttgcatgaagttcagttcagtattttatcagtgactacattagtctcgagaccctctacccaataggagggacaaagatgtacatgacacaggctcccttcaaagatgattaatacatgaactacatacagtattacaagggctccactagagatgtgagccccccagaaatgatattaatgtgcagaagagttagcaataaattttgcacaaggggtgacatttgagcttagactcgagcaatgagtagggttccaagaggtaaagaaaaaaatggaatggttttctaggaagaaaaccaggtctgggaagatctgatataacctgaggtagtttataagtctggaatgactgagttatcgggtatatggtggggaaggcagcagaggtgaaataagtaatatctaagcaaatgaaaaacatgtaattaggggagatgaaatataattaaattatttaccttaattcctcttttgactctttacatttgtcattcataaggaaacaatttcactaagattgttttgacctttttaccttatttggccaagtaaacaagggacagaaagtttttaatgtaaaatattcattcaacctgaaagaacattgatgattccagaccatttaaagttaaatattttagagttctcaattatttctatttggatgagtagaaccttttttcagacttcaggaatatatgtttagtttttaacagactaattgttcctgctttcatgccagcctcatgggcatcagcaggttcaaggttagtaggtaggaatctgccccctaagaatgcagcctaagagttaaggaatgcatgattacccctgtaattacttgagaggggctctgaaattctggcagggttggtgaggccaccagataacactgatcaagaatgtacacgaggttaggaattcagactgtagctgaagtggggagttcgggtaaacaggctctgaatggaaaagatcaggaattcaaatagacagttaagtcaagaaaccaacatcttagaaatgtaaacctcactttaagtcaaaggctctccaagctaagacttcataatatatttgccaaggcaagagctagtatctgcttacctgagtggtcctggagctgcggccagttgaaacaggagattgcagatggaatgtcagttagaatactttcagaggccagtaacagatacctgactttaaagttcttaagtttgtctttcccaaggttttctggtcataagaatcaccaggggcacttgattaaattattaattcacaagccccttcactggagattctgatgcaatagacttgggaatatatttttttttaacacgaactccagtggaatcaggcaagaagtgaaaaccctatcgttaataatagacacattagaaataatagagacatttgataatctagcacagttcccaaactttagtatgcatcagaatcccctgggggcttgttaaactacaggctggcaggctgctcccagcgtttctgatgcagtaggtccagcgtggagtccgagattctacatttctagtaggttgccaagttatgctgctactcctgtggtcaggaactgcactttgagaaccactaatcaaaataaactgaagtccaaagaccatcagacctagagctggttaattcaacagattagctatatcaagacttgaggtcagcttctctgggattctcttgtctttttcctcatggtcccaagatggcttcccactgcgccaagcaacatatccgcagacaacaataaccaaggcaagaaggaataaggttcaaggataactgtattgtgtgcgtgtgtgtgtgtgtgtactcatgcctgtgtgtctgtgtttggaaaagcaaacgtttcccagaagctccccaacaaatttcttcttatgtgtcaactagaactggatctcactgaacctctttaagccaatcactggctatgagaaacaagcttactgtgattggcttagaccagattttaattttttcctcagagctgtgtcctttgttgcccaatatctgaacataattgagcttctttaccaaggaacaagaagtaaatagctgttagttaggcaaatagctgggtatgtccacaaatgggttctgaaacaagtgtgattataatgaggttcagaattgaaaatattagtacaaatgctagtaaataatgtatgatattggctttcttatcaccatttgcaacagaataacagtctcatgaagaatttggcacagccattgtagaaaaagtgccttttcagagctcacagtatgcatgtactcatcttgcttttattatacctgtatatggaattgcaagctgtcccttcaggtaatgaaatttagacaagttggaacctgtataacagcaaatcaatactgaaattataggcaaagcctgtacttgtgcagactaacacataggatagaaagactttgtgatcaaaattcaacaaatcccacatttataggtatccaacatagagagaaaactatatatagtggtgtgtctttttatgtgtttgcgtttttctccttattcattcctgaaagtgtattttcttttaacagactcacaactcagctacaccccatatgcccacagtcaacacagtggaaaactgagttgtttatttgagcctcaagtcatccaaatacttcgttaaacgttgtagtaaaaggtctcccctgaattcaaggaggatgccctaagttttctgcatccttttgatagaggaaagtattaactaatgtcagactatctgttgttttattttcctttacagcactagattttgttaaggacattgataattttgaaagagaagctaagctaaggtgacaaatatatcttctgttggtcaatatctaaaattatgtattatttcttttttgactacaccttacagtggttagtttgcactttacgtaaaaaactgatgtctaccatcttccatctttgtaagcaccatccagcctaatagttgttggtttgaataatgccacaagctttgtccagaaaccaaaaacctgatttccaaagactagtctatgtagctgagcccttcattccataatcattaaactatggttaggacacagtatccagtctcccctcaaccttgtccaatcacagtctatgcagagatcatgtaactcgattaaaatctagaaccatagagacatttcccttccctggggcaaatgggaattgcacatgggggaaaatggtgtggataagcaaaaaacggaagtttccaaagtgcaacagaatattgataattttagtacatttcaacatacagtgagtgtaatgacggcattttcctactgcttccttagttgtgaagattttgttttttcttctgggttcactgccgggaaaagagcagaaaatgttttagagcctctgccagcagagggggcatttaccatttgtgcataaggtctctggcactgtgccctggggttctcttttctatatgtttctaacagtcacacacagcagtgtgactgtttacagatactttaccgtcttctctgattgaagcagggactggtttgccagcaacttttggttgtttttgtttttttgaagaccatgcaactaacagatgtttgttgttggctccatatctacattctttgaaagctggagaatcaaattgctgacattcagacaacactaattcccatatccagggagcctaatttgccgtccctgagatcctgattcctggtgttcacgggtttaaaaaccatttcagtgacacaatataagaatgggcttgggagatgcagcgctgtctccactaaagataatcacattttataaacatctgcgtcattactggtatgattcatctctaagctgtatacagctgtgtttccagtttcaattaacaatcccttaattgcatatccatctcatgttactaatttagttaatttattcataattaagagtattctgttttctaccaaggtttgtcgagctcagaacattataaagaaaaatattttaaggcagcatctccgagggattttgtttcttataatcacatcacagtaaaatgtcattcatgcgcccaaaggaagatgaattgctaagggatttttttttccagtaaaataagaagctttgggaagctgcagtgtgttgtgtttttaaaccaagttaaatgcgatgcattttgttcttttctttctccttccctgacatcctctcaaaaaaattatcattttatttgtattattgcttaagtatcacagcaaatccagtcaccagtgcaaataaaactgtcattaccctgtcaggtaatggtgtctcttaaaatctaagctataaagtctgtacattttagaggacattaagatcaagaatttttaaattgcctaagtctaagcaagtggagtacacccttgtggaaaatggaaggcagatgaaaacatgatgccaggcagtgaattcattttagtttgatcttttctacaaaaatacatatatccgtgcagcaagagtcttgcctgtgttagtacatgtgtctgtgtgtcattcaaagcagcaataacaaaaaattaagaccatttctcactttgtttattgttcaagaactcccacctatagccttgacctgtgtttgagcttaaaaaaaaaaaaagtcttataactgcccagtggtttggagattttacacaatagaaataataagccatcttttgcctcacatgaattctactaaaatcaaaactccataggatactttccaaagtaactggtgaaaggaaaagtgtggtagtataggtatgcatattatccccatcactttatttctgagctcttctattttttaaaaattttaatttgtatcttaaaagggcaaaacataagaagaggtaggagtattctaaatttcagtgacaacaaattcatttattttacaatttaaccattgcccgtcaacatttacttaaaatttcagcatgggaggttttaaacacttctagagtcccatcttaccccatttccacgatgcttttcttctccatgtgttgctgcagtttaatattgtctgcgtgttttaatatgttaaacgagttaaacatagagtaggaagttaaaactgttagcagctatatgtttcccaagattgatgaaaattcaggtaacactccaacctgttaaagatacctgcaatctggccaggtgcggtggcccatgcctataatcccagcactttgagaggccaaggcaggcagatcacctgaggccaggagttcgagaccagcttggccaacatggtgaaaccccgtctctactaaaaatacaaaaaacatttagccgggtgtggtggcatgcacccatagtcccagctactcgggaggctgaggtgggagaattgcttgaacccggagcctgggtgacagagtaagactctgtctcaaaaagaaaaagaaaaaaaaaatatatatatatatatatgtgtgtgtgtttatatatatatatatgtgtgtgtatatatacatatatatatgtgtatatatatatgtgtatatatatatatatatgtgtgtgtatatatatatatatatatatgtgtgtgtgtgtgtatatatatatatagaaagagagagagagagagagagagagagtaagcagggaggggttgaagccagaaaagactagaaattatctaggccaaaccctttaatttatagattaggaaatagtttctggttgacttagctgagacgttctcatttgttaaaagcaagatcagaaatcagacacaattcaacgctcttcactacaccttgtttttctctttgtggaaaacaagacgtatcctgttcaaaaatttatgctgtttatctgaaagcccaaaatgcctgtttacatcatattttccattttgcaatagcagctcattttggggattattttctgatgaaatctctaggtttagttgtacttgaatatctttttatctgtacacactggaatatgcatataataattgatagaaatgtggattttaaaagtagagatgatcattattattttatgatcctttaagttaataaaattcacctagaataaaataaacaagtttaactaaagttctcgcattttcccagaaatcgtagactagaaactagtcttatttgcttattttattccaaagcttattttacctctattattttgtggttctataaaatatttctgtgtattcctccaaagaacctcttggaaaagaaagtaaacatcacatctgaaaaatagctgggcattttttcattatctctgcaaggggaggggacgtgaaaggcaaccccatatagaaactcaactccctgctttttacaatgaatgaagtttttccactgcactgtcagaatggtaattcttgctaactactcacctatttcacaacattaacagagttccaggattcatgctttaatattgcataatggtccatgttttgaacatgaggagtggcagcggagattacactttgattccttggatttcatgtggcactggatgggagcaaggcactgattttaagttgagataaaaaggagaagtcagtcaatgcctgcagccagacaggactcttgtaatagctagggagtatgcctcatttggatatgcatgactgccgggcaaggacactgccatgaatcgctaatggcagcagttgtatgacataagagagatgtgtatcagcaactcacaagttgactttgttacatgttatgaacacattcctgtgggcactcattcatagaagtgagaaatgtggacaccacagtgtcccaggcctttgttaccttatggcctgggaatatcttgctttgctggaacatgaagccacgtctggttataagaagaagtttgatctgggagcaaaattgcctgttcacgcatgtctttctcacttctttaaaactaacttgctataagggtgattaaaaaaaacagatgtcaggtgagagttttgctttgcatcaacttcctacttgtagaggtaataacataaaccttgcctggcaatcattatttgtcatccagctgagggtgtttactcttgagaaagaagtaatggacaaaattgacttggattctggttctatgtttcccattaattgactctggacatatacatgcaatttaatccatcttactaaaaacatgaccaactcacaggatgtaaattctattctatagaaagggctttccctcagtagttagtcaagggacggttcctaactcctgtctttattgagcttattttccaaaataaatgtattattttctactttgttcacagagcaaggcagcataaagaaattaagcaacaaaacaatagtgtatttttacccaactttctagaaaacacccatttttcttaagttttgatatttttttgccaacaggcagtcaaaaagaagataaataaaactgggttaagttggtaatgacacaataaataaatgagatgaagaaagaggcaataaatatgagtggataccaacaagaaacatgttcaagccctgaaaaaataatgagaaaaggtagaactattaataatacatcccgctctcgtatcacaccttgctccccagatacatcctatctgtcctggcaccatgttgatgctgttgttctgtaagctatgccaatgaacatgttggatgacctactccagctctacctcaagatttccaaataagaaaaggacccagggatctccttgctgaggtctttatccatttactcaggtcacaagtactaattaagcagctcttatgtgcaaaatgttattgcttcaggtcagtttttcctatactgctgttctataagagaggaagaaggtccctgccctcagaaagccctagaatacagatctagagatgggttcaacatctttgttatgcaattatttcattccaattgtaatgagtacttagaaaggacaaaagcagagtgctgagagagtataacagagggacttgacctggtgtagtaggcctggaaagtttcctggggaagtggtattttagacaaacaacacacacatacacccatgaatgtatacgtgtggagaatgtattctaagtaactatgatgaatgtatttcttactgtaggtcatggtcaaagtttgaaaactattgttctaactagtattataattccagggatagtagaggtcatgtgacctgtttagcacatgcctgccttaacagtatctagtaggccaggcaatgtggctcacacctgtaatcccagcactttgggaggccaaggcaggtggatcacttgaggccaggagtctgagaccagcctggccaccacggtgaaaccgtgtctctgctaaaaatacaaaaattagccaggtgtggtggtggtgcctgtagtcccatctactggggaggctgaggcaggagaattgcttgaacccgggaggcggaagttgccgtgagctgagatcatgccactgcactccggcctgggccacagagtgagactctctggaaaaaaacaaaaaacaaaaaaaaagaatgtctagtaaataagtcagtgccaagcaactacctgataactgttaccaccttagtcatcaccgaaggcagaaggtcttgcattcattggaggagagttaccaatctaagacatttgcatgaaaatgtgcacagagccctcacctgataatcaaagcatgttccaacacttctctttggataaaataagagttacatctcaatgaaatcacttgtggatcaagttctcatcctttcgtaaataaagagaggggcagcaagaaatggaagtgagcacatataagtgtgggaacctgtactttcctaacctataaagcattggatgtagtttttgctattggtgcgcatggagtcatgtggccttggagcagttaggtaccttccctgatgataggggagaaggcaaagaaattgatgatacatctctctcattgtcattccctagtatattacacttaaatctaactgccctattttgtgattgccttactgctgtggcttgaatatttgtgtctccccaaaattcatatgtggaaacctaattccatatatgatggtattaggaggtaggccccttgggaggtgattagatcatgagggcagagcccacatgaatgagattagaacccttataaaagagacccagagagctgctttgccctttttgccatgagaacacaagaaggtgctatctatgaacaagaaagcaggccttcaccaaacactgaatctgccagcgccttgatatcagacttcctagccttcagaattgtgagaaaaaaactttggttgtctataagccacccagtttatgatattttgttatagcattccaacggactaaaacattcattttccagaaaatctactccatttataagccagcattcttttttttttttttttaattttctacagatctctgcagaaacatgcagagtaataatagggccaggcacggtggctcacgcctgtaatcccagcactttgggaggccacagtgggtggatcacctgaggtcaggagttcgagaccagcctggccaacatggtggaaccccgtctctactaaaaatacaaaaaattagccgggcatggtggtgggtacctataatcctagctactcaggaggctgaggcaggagaatcacttgaactcaggaggcagaggttgcagtgagccaagatcccaccattgcactctagcctggacaagaatagtgaaactgtctccaaaaaaaaaaaaaagaagtgataatatatttgctgtatatattagttatagatagttatattgcagtactatcagaagctatgccacatattatttacgtatttcttaagatatagaaaacatccctcccctgcagtcattagtacttttgcattcaaacttcaaatgaaacaggactttagaaattataggcttggtgccatcctggccaacatggtgaaactcgtctctactaaaaatacaaaaattagctgggcgtggtggtgcacacccgtagtcccagctactcgggaggctgaggcaggagaatcacttgaacctgggaggaggaggttgcagtgagccgagatcgcgccactgcactccagcctggcgacagagcgagactccgtctcaaaaaaaaaagaaaaaaaagaaaaaaagaaaagaaaaaagaaattataggcttggtgatttctcaggcattaactcaagaaagcagcctttataccgattacctacattcacccagcacttaccccattaatttctaatgttgcttggaacaaatgaacattcctggaatgcaagctaaatgaaagagccccgaagaagaacagggcatttcctggttcctcatattgacaaatttaaaagcctgtgctataatatgggctcctgtttcctttcaagtttgtctttgaataagtggacagagtagctgaaagcagagtatttaaagctttgaaacgaccactttatttcagtctctgttcttgctgggaccactcttataaatgaggagattagaaaatcacctagaactatttaatcgttgtgcagaagaccctcttaccccaaatatttacttaccgctcattttattggcacactgcctcaaattccacctgctgtgaactgacctaagtgaatttaggtcacgtgcaactattaggttctttttgggaaataatggagaaccacagatgtgtttgaggtggatgaggaatggctacctcaagccgcagcttcatgcttcatgctgaagtcctccacaagtgcaatcatgtcgttaaccaacatttgttagaaggcaggcagaagtcagcttacagcctgttctacaatttttatgaagtgtaggattttaggcttaaattgacaccattgcaaatacagtattctcttacctttagatttggcatcaggtcacaagaattcttcctaagccaatggttggatacaaggccattggagaccagacgtaaaattaaaagcccaagcaacaggttttgctggattcttatatcctgtttatgcaatgttaggggatgtcattaaaatattttagttaatccatgtatcttgattgtcttaaattttactaatgagatcctatagggatattcattgcaatccactatttccctcagcaaaaacacatttgcgatatctattacatgcattacaaaatcctccaaggttcacagagatatatagtagtagcagtctctgggttttggcctttttcataagatgaaggctgtgctgtcctagaatatgaattcctaattaaaataaccatttgcctcaagcctctagagttgaaggttgcactaactgcacatataaaatatccaactatctatgttgagatatttaaaattaattacagatattgtaacaccattatttaacttaaattccattacaggtcctttgagtatgcaaaatatttctttgagatgtggtaacccctttaactgatcaggaaataaacctttattatcaagttgttatcccaccttgacaggcctaaagcgcagaccacatatcagaatcccctgggcagcttataaagctcctcatgcccaggctgcatctcagaccaattcaatctctgggggtgggctccaagcatcagcatttgttgaaaatccccaggattacaaagtgcggtgaagtttgcaaacccttgtaataagagaatgggaggagggatggctgtttgccaagcagaaccaggaatgaggaaggatattggtaaacaaaatttatccataattgacttttcatgaatcacagtcctactgagacccagccttgtctcatgagactttggctacgatgatgagtgagaaaaggactcctcctaatttaccagactcttgattagaagcaaatgaaattttggaaaagagacaagtcactttcaaaagaccccagcctgtacctgaccctacctctggactccatagtaatggcaggtagtggtcattcctggagtaactctgtatttcttaaaggaacatttgcataatgaacctacagcaatctggaagacgactggggtaaatagagaatttgttgattttagatggctgaatactatccgtgcagagcaattaaaaggacaactgtcagaatcaagtaagagaaaggaaataagagaagtctcatgttagtagaccttgtttgatcaatgtgttttcatcttgtatatgattaataaaataagtttgggagttaggatcaacctttgtttactcactggagaataacttgcatatagaatgaagctgggattgtccaggctggtttttttccatttggaagtttggatacaatacaaggaagcctgaattccaaactgtttctcttaaagagtgcctttctgagccgctattaaggaatgcttattgtttcgaaaatggtagcacagaagtgttataactagagtacaccttgtgcctgcaattaattacccagtgtcttcaaaaattcttgtcttttgctggtagaaaacctttgaaactatagttgtctgtggtattcactgcagcaccttagatataaagagagaaatttattttcagaggaatcttgagacagtttgtgtgtgtgtgtgcatgcctgcttacacatctattggttttccccaaggattgtagaaatcccattaaaattccagcttcttaaggagctactgaaactccagtttttcatattttcttttataatatttggatgcgtttaggtaaacttgcagcattttaattatgtctgtatcagatgagcggaagaaatgtaaaagggtttggggagagatttaattttagatagcggcgtaattaatagcatttggaaaaactagtggaactttaattaaatgtctctacattaatttagtcatttaattgaacatgtagtgggatagtccttacaatttttcacccttactctttgaggaaaaatgatttttgaataacaaagcatcagtatgactactttttattatttagctgtatgttcactacttggcactttgtttaatttttccccccatatgtttcgagctttttaaaacattaatttggcttgtcgcttttatcttaaaaactataaatctgggggccgggtgcagtggctcatgcctgtaatcccagcactttgggaggccgaggtgggtagatcatttgatgtcaggagttcaagaccagcctgaccaacatgacgaaaccctgtctctactgaatacaaaaaaaactagccgggtgtggtggtgcatgcctgtaatcccagctacttgggaggctgaggcaggagaattgctggaacccagggggctaaggttgcagtgagcagatattgcaccactgcactccagcctgggcaacagagtgaaactccatctcaaaaaataataataaaataaagaaataaagaaaactataaatctgggagaaaccgtatttggaaacattgagcaactgtttcttttcctttattttagactttaatattcactagagtcatgttgtaaagttttcaccttaatattgtaggctttttttttttttttactttgccaacttaactggcttttttaaagtggtgttatgctgcagcagtgtatctgaatttcagcagtgccttttacgtggctgctcacaatcttattaaactacatgaattatacatggagagaaatataatttggtaaatttggtgatgtttcaataaccatgcccaaggaggaatgttgtgttaaactgtcaatttgagaagtgttttgtggtgctaaccacagagtgaattcagttctacttcatttcacaaccctccataaatagtgccccctaaaagtggtgcctccttgcctgtactttgacccagatttttgtcatttttctagataagcatatacattgtgcacttattaatttttcaaatgacacaaaggtgagaatgggagtcaacacactgaaagatcaaaatcaagactcaaaataagattataacagactgggatactgtaccaaaataaaaaaattaaaataaaatttaacaagaacaagcaagatgtcctgcctttaagatttttaaagtcttttgtacaaatataggctgaggaacatctgactttgtggcgctttatatgaaaaacaaattgggattttaaataaccacaaggactgtattaatctccagtatgatctggtgtggcttactgtacgaggcaatacagtattagattgcattaatgaaattcacaaatgttccattaatctcttcactagttaaaccacatctgcagtcatattgacttatgagcatcacgtatgatgagaacactgaaaaatcataatacattgacagcagggcaaccaagattgtgaaaggtatagcgatggttatatgacaaatatttgaaagaatctagaatgttcagtaagaagataacatgaaaatacaggacagcttcttcatgcatctggggagggtgggtaaaggacacagcacacttaattaagtaagattgtagaagagaactatgggcaagtgttacagtggagcttactctgagtaaggaaaatgtaaacgttagagttgttattaagtggcatgggctgcttcacaaatttccatcattttttaatctgattcatctgctaataggacaaactgtaacaatagcttaaacaatagagaaatgtaggtctctctcatgtacaagcccagaactaggtagatcaggcctccttccgctattctgcttcactaagtccgaagtcctcctttaccttgtcctgccatggtggcctcaattctcgttgtcaccacatggtccaatatgtctgcttcagctccagccaacacatctgagttccagcccccagcaacatggaagaaggaaggaggcacagagagggcgtgtgtcagcagtgttgtgagaaaatctttcagaaactgtcatgaaatgtatcccctgatagttccttcaccagaactttgtcccatgattatatttacatctatgtgaggctaagaaatatattctttccttcaggcatctacatacccaactgaaaattatgagttctattgccacaggaaaaaatggaaaatatatggggacaatcaacagtacttgcacaaagatgttttacagagaattactcttttacctgggaattttacaagataaactttaagatcctatcaactctctctctctctttttttttttttttttttttgagacaagagtctcgctctgtcacccaggctggaatgtagtggtgcgatctcggctcactgtaacctccacctcccgggttcaagtgattcttctgcctcagcctcccgagtagctgggactgcaggcgcccgccaccatgcctggctaatttttgtatttttagtagagacggggtttcaccgtgttggccaggctggtctcgaactcctgacctcaggtgactcgcccgcctcgacctccctaagtgctgggattgggattacaggcatgagccaccacgcccagccagatcatctctggaggcagggggatcacttgaggtcaggagtttgaggccagtccggccaacatgacgaaaccctgtctctactaaaagtacaaaaattagctgggtgtggtggcaggcaactgtagtcccagctactcgggaggctgaggcaggagaatagcttgaacccaggaggccaaggttacagtgagccgagatcgtgccactgcactccagcctgggtgacagtgagactctaactcaaaaaacaaacaaaaagagtctatgatcctataatttatagacaacatacaacctcctttctctacaaagagaattggttctcaagggctgtttggaaattcatttccttttaagtccaaaatgacatacaaaagtgaccaatatatacaatgtacacccttctacaataagttctcttttgttgccgtagtaatcgcatgtcttttcttaaaggaacacttttttgactcttttgtacttttgaacatagcggtgttaataataatatttataaaacattatgaaaatatgcacacaaaacacaacacaggctaagaaaacctaatggtggcctaaagtaagttctgatgtcctctgttggtggtattcttcattgccatgcttctgctgtgcctgggacctttattgctacctatgggaagttgtaagtagagaagtttctttactacagggatgtgaacaatcattgtaagtaaggaataatgaattcacataagttcacagagcatgtttttctgccctggtaatactgcatttctcactttgcatttaaagtacctacgcccttacacagaaaaagttatcggggttgggtgcagtggctcacgcctgtaatcccaacactttgggaggccgaagcagggggatcacttgaggtcaggagttcgagaccagcctgggcaacatggtgacaccctgtctctactgaaaaaaaaaaaaaaaaaaaaaaacacacacacagaaaaaattagccaggtatggcggtacatgcctgtagtcccagctacttgggaggctgatgtggaagaatcgcttgaacctgagaggtggaggttgcagtgagccgagatcgcaccacttcactccagcctgagtgacagagtgagattccatctcataaatatataaatatatatatataattatcgattgattaatattattatatggtccccattactctaaactctcaaaatgtaatgtaggtcaaaatcagaaaaaggccatactgtctactccttcctctgtttcattccaactataagagaaagggagagggcaaaacaaagatgacaggaggccaaattgtacatagaattcatggaaattcttacccaacatgtaaaattatgatagtataaggaaaagtatactgcaaaaattaaacttctacattgtgaaatggagaacatttttacatctagctctattgcttctccctgtggagctgttctaagcacaaagttcccattacataatgaacaactccttaaatactgtgcaactatttctcactagaagcacgatgcagcaaactctgtttctcagtaaccatttatatcatacctagtggtaccgagttctataataaaagggtgatatgtgcatattttgtggtcatagagtgcaaagttgacatctacagtttaaagcattgcattgcatgaataaggtcaaaatttaaatacttttctatgatcatgttctttacattaaaggttaaagatgcatgccgctttaaaaatggtttaagggccggacacggtgactcacgtctataatcctggcactttgggaggctgaggtgggcagatcacccgaggtcagacgttcaagaccagcctggccaacatggcaaaaccctgtctctactaaaaaatacaaaaattagtcaggcatggtggcgggcgcctgtaatcccagctactcgggaggctgaggcaggacaatctctggaacccggaaggcagaggttgcagtgagcagagatcgtgtcactgccctccagcctgggcgatagagcaagactctatctatctcaaaaaaataaatgaataaaataaaataaaaatggtttaagaacttcaaaccatctggcaccagaaaacacctaaattgaattaaaaatctggaaatttaatttcacaacttgtcctttttcaagcctaccctaagttttgtttacttaatggggagaatctgttttatttgttcctatgtagaagactgctgattttatcatgattgtattagggcccaaggatatttaaaatatttcagtagctattacttatactttatatctgcattgcactttagagttgactgagcattttcaaagtattatcttaccaaattgccacaatagtcttgagaggctagtaaatcatgggagaagcccccatttccccactggaaagcagagaaaacccccattgtagtaaaggaggggttccctccagagctcttgtggttgtgttgaggaggaagtattaatgctgctgggcatgacttacaagaaataagtcaattcacttaagcaaaagtgctatgatcctgtataccatgtgagcagctctaggatggggtcacccagcattttggagcagacattagaacatctggagggagtaaacgcaaagaaaatgggctagatacctttccttggatgggaaaggataacattaagataccaagatcaaatgttcaaagagcacatatacaccatagaatactatgcagccataaaaaatgatgaattcatgtcctttgtagggacatggatgaagctggaaaccatcattctcagcaaactatcacaaggaccaaaaaccaaacaccccatgttctcactcataggtgggaattgaacaatgagaacacatggacaaaggaaggggaacatcacacaccggggaatgttttggggttgggggagtggggagggatagcattaggagatatacgtaacgctaaatgatgagttaatgggtgcagcacaccagcatggcacatgtatacatatgtaacaaacctgcacgttgtgcacatgtaccctaaaactttaagtataataataataaaattttttgtaaaagcattgtataataaaagtagtaagataaaccagtaaaaacaaaacaaaacaaaaaaaacaaaaaaaagttcaaagaggccgggtgcagtggctcacgcctgtaatcccagcactttgggaggccgaggcaggcggatcacttgaagtcaggacttcgagaccagcctggccaacacggtgaaacctcgtttccactaaaaatacaaaaattagctggatatgatggtgcgtacctgtaatcccagctacactgaggcatgagaatcacttaaacctgggaggcagaggttgcagtgagctgagattgcaccactgcactctaatgtgggcaacaaagcaagactctgtctcaaattaaaaaaaaaaaaagtttaaagaaaaataagttatttctccatgcttcaggagatatgtttcgcaggagaaagaggcttaatagagaaaacagatccctacaaacatttgtggtttttaaaactgccccattggttactaagtggataacatgagcgtgatgccagattcagtactctagtgagccatgcagctttgctgtgctctgcacctgatgagtgtggcctcacttcttataaatgcctgtcattgctaacaggggtccttgctgaaacaacagggctggactaatgctctagttcccttcctggaaaacctatcccaaagctgagatcctcatgatgccttctctcatatatgaatgattgcaggttacgctatcatcattaaatcgaaacattttagaccactttgcgtttgtttgtttgtttgtctcattatgtccagttttatcctgtttcataatttaataaatttttattgggtctgtcttctggttaaatgttgtgtgtataaaaaataaagtcaagagagagaacaggagttatggaactaatgacaaatccatccttcagctaaataaaattatactatggatgatttgagctgtacgttgagtgataatttttaaaaataagatagatcgggtgcggtggctcatgcctaaaatcccagcactttgagaggccgaggcggatggatcacgaggtcaggagttcgagaccatcctggctaacatggtgaaaccccatctctacttaaaaaaaaaaaatacaaaaaattagccaggcgtggtggtgggtgcctgtagtcccagctactcgggaggctgaggcaggagaatggcgtgaacccaggaggtgaagctcgcagtgagccaagattgcaccactgcactccagcctgggcaacagagccagactctgtctcaaaaaaaaaaagaaaaaaaaaagggccaagcatgctggctcacacctgtaatcccagcactttgagaggccgaggtgggtggatcacctgaggtcaggaattcgagaccagcctggccaacatagtgaaaccctgtctctactaaaaatacaaaaaattagctggacgtggtgacaggcacctgtaatcacagctactagggaggctgaggcaggagaattgcttgaacccaggaggcagaggttgcagtgagccgagattgtgccattgcactccagcctgggcaacaagaacgaaactctgtctcaaataaaatgaaataaaataataataaaaaataagataaagtatcacaagtaagatgtagttgaaacttcatgcatttttctatgatgcctatgatattcaaaagataactgaatttcatgagcagagttcaagaacttctgagtatacttttcattgatgacttaatgtaatggatttctatgatgatggcactatattcttttggtgtttatggtattaataaaaaattgtggtaaagcttgtggaaatgaacatgccttggattagggtgccttaaatgtgcctttgtaaatgcagctaggagactccaagtcacccttctagtctaactgctactcctttcttttacaaactacatgccaactaaactgaccttgatctgtttatggaaaggcggtataggaacaggggctctgcaattggacagatccaattctaatcaatccactccattgatagatatataaccttgagtccttcctgtgcctcagtttcctcatctgtaaaatggaattaaaaaccaacttcgtgaggcttttggagaatgaaaatgacataactcaaagattattgggtatcagaaacaataatgttatctatcactgtctttactgttattattattattgtcattattattattttctctacctggaacaccaattccacaaactcttaatgtcaagaccatgctgtatcatggagccttccctgattcctccatatgaaaataattaattctcatattaataatattacttttctacttgtattttctttttttagcttttattttaggtttgacggtacatgtgaaggtttgttacataggtaaacacatgtcatggaggtttgttgtacacattattttatcacccagatattaagcccagtactcaatagttatcttttctgcctactcgtattttcattatccccaagtatactatacatatcttaaaattaggatccatgttgaaaaaacattgatatttcctatggcttctaacacagtacattgcacttagatattcagcaactctgtattgaatgtatgggtacaatctgctcttagtttctaatttggtattaatatgttcaagcctcaagagctcatgtaaatgatggtttgactatattgcccatcttttgttaagttgaaaagctgaaattcatgcactgtttgttagtgtagtaatttttgacaacgtctagctattaagtcttttctaggtataaaacctttatatctgtcattgttcccctcttgtgtttttgctttaatatcgttgaaagcatctattattggaactttcacttctgaatagtacttttgagaacctgtatagaatttcagaggccttagaaaattgtcatagattgcttttagtatatggtttaccactgtggtctcttaacttttcaaaaagtatttccaaagggcacttacatccataaatggaaattgatttacatctattattgctgattgttcactattctgaacttcggctaaacaggtgatttaggcagaatttttttaaatattagattttttcctactttctaaatattttgtagctctttcttattaatttgagtcaacttatgctcgcttttttttgtcaattatagatggttgtcaggggtttggcaaatgtcatatgaaggtaattctttaaaagttgggatttttgaactgtttatttctactacttttgattttgctggaaattatcattctattaaagggacaaaagggtgctcagaaatatgcattgaaaaatttcttacagatttatcaaccattgccctcaggcactgatattcagccagtatgttccaatacatccatgtctttccattttaaaccttttaattctgttctaatttttcattgcctgtgcctgattgttctgtatccatctgatacgaatggttaagtacaacatgttaaatatcactcttgcctatacatattatttttcttgtcagatgatataattgtagtcattacatgtttcttaagcacaactgaaatcttaatttaaatcaataagtcttgtttctgtggccattgtttcccagaactctccggatttctaagcatggtggttattcttccaggaatagtgccgagagtcttcagcagcatgcatttctctctaattgacattatttcacactctccattttccttactattgaaaactgtatttcattggtattttgccaaggatcctgctctgtttcataataatgttctgttcgcactctctgcactgacaaatacctattccatgcatcaattgcataaatggcaatttgaaagcatttaaccacagctggatatttttcattgattcttttcatctgaagatcattcattaggcttctccctcctgtttcttctcacatccatacctcctttcctcctatgtacatagtgtcttttgcattttctgtatttaagtgtaaattgctgactacagttatgcttttacctcattccatggtcataatgaaatcacaaatttaaaaatgtactactttttaaacctgttttctgacttgtccatctaaatgcaattttataattcttcgacattcagcctcctggtgaatgatttctgcaatctctccaagacatctgtgcagtgttatggattatattgattgcattttgtccatgttcaaatttgcagaatgtaacctacagaatatatattgactaataaagaaatgcatccacatggtggatggttgtaaagagaaaatatatattggtgtgcagcaggcgcccacacaaatgaaatctagaaaacagcagcttgccatgtcagagttgcaaatgaaggctgtggctacaaaacacaggaagtctggagtgtatgaaaggtttttcttccaaattcattcacacataaaaatgaaaaaattgaaaaatcatatatgtgcaccttaatttttatatcgcattggtgtttgggcatacgaccctgagattttcataccctcgatttttttaatataaccacctgagcgtttcttcccatggggttactttagaagatggggggtgtacacactacgtatgtatgtcaataaagaaatgaaggaataaaggaggaaagaagtgaagaaggctgggggtaggaagggagggagaaattcagtgattcattacttattcatcatcctaaactggcatataaaataatatgtttaaatcagtctaaaattttcattgtataatctctgaaataactagtccccactccctaaactgtttggtgtaaatatttatctatgtctaatcatttctatgcaaaatagccttatatatattttcattttcataagatcatctaagaatcaaaggaaaagctattttaggcaatgaacataggcagtgatttcaaaatagaatttgagaaatgcaaggatagatggaatcacaaaagatgatctcattcatggtgttttaaaccctacaaatagatttctgtttagttgacctcatttcaatagcttctcatttttttcagaagtgtatttgatgtgtatatttctaataaacttatttttctttttgtacccagtattaaggagcacagcatttatatccactgaacaaaggataactgaaaggaaactccttgatatccaacttggagtatttgtttctcgaatgaatatgagtttatataagtagtttttttcacatacataaaattagaatttgtttgtattattgatattatttcagaacagcggatttaacgtcatagatgatctagatgtgtcctttccttagaaatctttaaaatgaatcacatagtctagaaacagatccagatactacatgctctcatcagaaaggactttcttctcttcgtgtcaagttcagtgttggcaccgtatagacaaagcgtgttaaaatagcagggttcttgttctctgacacattacaagagaggcaagattataaaactgctatgtgtctcattataattcccattagtttcatttgcttcaaaacattcacttctgtgctttttgcaaaagctttcaaacttattttttgatgattctaaaagtaattcttctatgtcttttcctagtgatactagcattagttttcttttccaattgtactaggaggcatgagagattatcgatgccctattttcttgtctaaataggcaacccaaataatcatagtgacctgttcatttatattatctttatttcttgcctcatacttcttcatatttcttcatttcccatgtttccttattctttggagccagaaacgatcacgttaatcactctttccattagttttctcctatacattttctgatctttctctgatccagttaagagtcattcagccatttgataatggacactagtttactttgaccttgcaaacacaaataccctgtttgatctttatttgctgagagcagtaagacagaagaattacaataaactttttagcacccttctgttcaattctttttcagaaatcgttccctcaaaaagcctattctaggctctttcttttggcagtttcctagaattttcctttgcttttcaccaactggaacattatcactagaagtaaactaagggaccatctaattcaacaccctcgttttgtactttaggatactgaagccaagagaagctaatttttttgcctgccataacacaactagttagtgaagcagccaaaactataagggatcttgccaccataagctttatcggcccatccgtttatctcctcaaagcagccctatacctgatttccttatttctgttctctaagtaagccaagctcagaccttagagtgaccttcccctaatccaccctgcctgacatccaataaactgacaaatccagttgattatgaagctacagtgtttttcaaaccataccataattgtctaggctgttgccatgctctacacaccagttttcttattccagtccctccctgccccagtcccagttcactctactcagcctctctactgcaatggataaaatcacagtttccagattcacaaagctcacagctctgccactttctagccttgtatttgtgtttcagttgctgctgaaactctctaagcctattttccatctataaaatggaaaccaacccagaggctcgttgtattacagagatattgcatgaaaagcatttagcgcagtgtctggcccataagaagtcctcagtaaatagtagtcttggggaagcagtagggtgttgtagtaagagagcagagcaggggacagcaaactacaggtctcagtacaaattcaacatggggcctgggttttttttaatagcaggggagctaaaaacagtttacttgttttaataagttgtacgaaacccaaagaagaatatgtaacggagatttatgtgttcctcaaagccagaaatatttactttctggccctttacagagaactttcattaattcctgttgacagctgtcagggtatgaatcctctctaccacttagaaactgtgtaaccttgggcaaatgttttaacctctccaaggtttggtttccctgactgtgaatagtacctatgttacagggttgttatgagaattaaatgagatcatttatatcaggtgcttagctcactagctgaaataggatttaataaatgttagctgacatggttacgtctactcattgttgcagataaatagcctctaagtgcagctttaatagtgattgtttcttaaaatttttgaacaaagtttttctatttcttatccaattaaataaatattccacattctggcattcaatatttctaacgacatcaagcaactctaaaatcattgaatgttttaaagcaacaggaaaccttagaaataactcatctaaactcatatcatagatatggaaactaagggccaataaaaccaaggcttctaggacctgaaatcagatcctctctttttaggtagtgtgatcttcatcgtgcttctgccatgcaatctcagaatttaaagggatttaagaatcattcattttcttcctaaggcaggattcgaccctataaaatccctgtcagtttggtcattcaaacccagtttgagtacagtcattgatgataaatcacccttttcccagggagcagttctggttgtttcaaagtctttataataaatgaaaattggctttcctgaaatctctatatattgatctattcctgcccactggagccaaagagaaacgtcacttctctacatctgtaaaatactcgttgtcaattttcgtatcttctctaagcatcctcgtttcaagctgatgtgaactagttgggtttttgattgttttcattgtcctgctaagtcgaaaagctaagaaaagcttggctctttcatcactgttatatatcccactgtgtaacagaacttgagttcagggtatacactctaaataactgcttttgtaaaagtattcaattatattgatttttttcgttccctctgttgttcctcataattaccctcagtcaagactttcatcttcgtctttatcttcctctgcaagaattaacagtggtcccttttgtgaacttcaaatatctgagactggtctcagttaatttaggaagtttattttgccaaggttgagaatatgcacccatgaaacagcctcaggaggttctaacgacatgtgcccaaggtgtttggggcacagcttggttttatatatatttagggagacatgagacatcaaccaatatatgtaagatgtacatttgttccatccagaagggtgggacaacttgaagcaaggaggggcttccaggtcacaggtaggtgagagataaatggttgcattcttttgagtatctgattcgcctttccaaaggaggcaatcagataagcatctatctcagtgagcagagggatgactttgaatagaatgggagacaggtttgccctaagcagttcccagcttgacttttccctttagtttggtgattttgaggccccaagatttattttcctttcacactttcaatataagctatccagaactgatgataatattccagatatggcccaaccaatggaaatgattgtgtttcctacataccatatcacaatcaaacctgttttgcaccttgcatttactttctttattaatgatgtcattgcaatttagaaaatttggggccacatttacttcttcctctctattatcttcagtttttatttggtcactaaattctgtttgctgactcttatatctaaaaataaaaacactcaaatccagctattcctctctaactactctgcccttccctcagtcctttctcagtgactattaatgatttggccttctaatgattagcctccctgtccccagacttttatccatctttatcactatggctagttatcttgctaaacaacagatctaatcctagtaccccattatattaaaaaaatcttctatagctacagctttctctccctccaggtcagtatccatagcctgtcaagatgtggctttgataaaggacagaaggcagggaaattctgggcagaagagggcaggtccccattgaggacccaccctcaagccaaaaagcctggaaccatggcccaaagtgagaacttacatccctgttttccctcttgaagggtgccttttccaaaaccatccattaccccccacccaccccccaacctgtgcctataaaaaccccagagctcagctggcagaaggaggagaagcagatggatgtcagaaactacagttggacatcaaagagaagcggcttgactttagagggacagtttgacagcatagctttggagaggagtccagctgtggatggtcagactccaggggaagattaccttcccactccatccccttttcagctccccttcccactgagagccactttcattggcaataaaatcccccatatttaccatcttcaatttgttcatgtgacctcattcctcctggatgctggacaagaacttgggtgccatgcgtgtgggtgaaaaaggctgtcacactgaccctccactgagctgttaacacttaagccatctgtgaatggcaaagctaaaagggcgctgtaacacttcctcatgggcaccctcccctagaggctgctgcagggcccgtacggtgttcactcttgccagcactcaaaaatgctggccccagctgctgcacctgctcacctgtgctcccccttccatgaggggtggaccagcgagtgagtggagtttgctcccctccagttcccacccacgaagggatcagggaaatatcctccttcagctccagtgaggcacagtggtatacacctatagtcccaactactgaagaggctgaggtgggaggatctcttgaacccagaagtttgaggctgtaggcactgtggttgtacctgtgaatagccactgccctccagccttggcaacatagcaagatctcatctctaaaaaagaaaaaatatatatgatgtggctccaattcactgatctagcctcttaactgaattccttcctcctggctgggcacagtggcttatgcctgtaatcctagcactttgagaggccaagacaggagaattgcttgagcccaggagttcaagaccagcctgggaaacatagtgagacttcatatctacaacacattttttcaaaaagaattttttcctccctgctccccaccctacccccttgcaaccttatttactcttcggcctctggccctctcgctatgtctttctcagcttcatgcctttgaaaatactctttctatgcctggaaagcccttataaacctggaaattcctattcttattcaactctgagccagtccattttagtggcttagttcagaggctctagatttaaattgcaattctgtcagattctgtctgctttgccaacctcaatcaagttatgtactatgcctcagtttcctcatcagtagaatgaaaataatacagtagtgcttttttcatagggttgtagtgaggattaaatgagatgaagcgtataatcctcatgtacataacacagtacatactatatgtgttgcacatagtaagtgctcagttctttttctttgcattattcttagcacataagtcaagttacatttgctctcccttacgcaaggtcaattgttcttttttatgtgtttacccgttactttgttcatgcatttgttataaccactgccatcataaagcaacttgctatctttgttcataaaacaaatcccagattcactgagctcaaagtgagagaaggaaactttgcattatgtgcagttcctatgcttttctccaaatttcacatctccgttggggatctctcactagttatccttgccatacccccacaccagccttacaattttgcattatgtttcctacatcatgattctaaacggtcctcctgttcgctttctctccatcccatatcgttgcagatagctatttcctctttttaagacagaaacacatttgcattttgcctaagctacatttgtaaattttacagtattttcgaaagacacaatggaatctaggaaagatgcaacagataaagagattaactggccaatttttgagagcaccatccgtaaagtccacgaacaagtgaggcttccttgtcggagaaagcaattcagtcaccataaatgatcattcaagcctgatctcattccctcttgaaactggaaattgaaagcttgttcctctgacagttgtgttgtcagtggatatgcccagtgtgcaaaggactggacaaagggcaaaagtacacatatcccatctggaattctgagtcatccctgagacatcattttggatttgtctactgagatgaaattaaaacatgagtaatcaagcccacacttcttccccctcaaactcatctctttggtatcatcaagaaaatcaaatgctaatagccattgacctcctaattctagtgctcttagctatgataaaacagtcattaacttaatctaaatgttgcaaataaaggagccccatcaaagctgaagccccaaaattatacaaatgagttaactgggaaggcatgggggaaacaacagttttcataagacacactctaaatctagtttattctcttaggaagacttttctcatcaatagagagccacataaagatgccttacctgcctttcacggggactatatcaattggctgtactgtcactcactccaaaactctcaaaatgcctaacacagattcttgattttattgattgcattagatgttacgttttctaaattttcagcaccctggaggtcacctcaggaaatcatgcagtttttgaatgattttccttagaaatacacgtgtagctatacatatgcccatgcgttatttaatcagttagtgaaaggaggaaaacagcatttctattattgacctttctcaatctctgaggagactgtatgtcttgcctacagtccaggattgaaagcaaaagaaaaaggcactgacaaaatagcattttattttaatagcacattatggagagacaaaaaaaaaaaaaaaaaaaccctgggatttcctttgtctaagtagaattgacgtatgggtgagatcagtctctattttactcagtacaagtgcacacatatttatgtacacacatataattgtcatctttgggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgtggttgcgggcgcctgtagtcccagctactcaggaggctgaggcaggagaatggcgtgaacccgggaggcggagcttgcagtgagccgagatcgcgccactgcactccagcctgggccacagagcgagactccgtctcaaaaaaaaaaaaaaaaaattgtcatctttggaagctaagggccctgtatcagagtatcagaatatacctatatccaggatgcagtgttctccagttttgcattaacatcagctacaaggttcactgccatctaagactaatcaacagtaatagctaaaggacaaaggtcagttcctgagagatatgcctaaattcatctggctatatcttctgttcctcccaaaccctaaccccataaattcttcattgtttagaaggattcatattttttgtttgtttttcatattcccattttattggctggggttagaattgcaatggcagcaaaaaacacagaagctatctacagtggcttaaataaatagagttttatttatctccaatattaagatgtctggaaataaggtgctttgggcccaacagtatcaggactggcatctgtatattttttattgacttttcctcatgcaatatagcagccaccattatttcacagggtgaaaaagagaaggcaaaaagggtgtactatctgagtcttatcatttttataaagccaaaaatttcccagaaaccttttttgaaagacttctacttgtatatcattgtatagaactgtgtcacatgacagccaccaacaaaaagatggctagggagaagtggttttcaacaggtattgaagtagctaaccggcagtgtctgccggtcttcagttataaacaccagcagctaactctggctaattcaagtcagggaaaacaaaggggatggggtaggggctctttatttaaaagatactcatagaaatgaacgaagtaatttgaaaactaggtctcagaataggacatgaagtataagagttctaaaatctcaaaagcaggaacacatgcatcttctttttaagtgttgtctttgaaatactaagctccaaagtctttccaaccttgtattattttcttcctttgtcagcttcctgagtggcagagtctgagtaacctatggggtctttgaactctttaggggaattgaggaaggcaaaaaggtaccatgattggcagctctactagagtcacaagaaatatggggaaagcgattcctcaaaggaaaaacaaaaacagaaacaacaaccaggcagttagtagaaggatgaaatactggacccacaaagacaacatatgtcttctcaccacacttggtctctctctctctctctctctctctctctctctctctctctctcacccttctctctctctcatagtaatgaaactaaagctgcaaaactaaggcctagctattcattgtgatccttatgagatcataaaaaaaatctgtatttaagtggagaaaaataaatggaatatcaactttaaaaaattttttttgagacagagtctcgctccgtggcccagactggagtccaatggcatgatctcagctcactgcaacctctggctcccgggttcaagcaattctcctgcctcagcctcctgagtagctgggactacaggcacgtgccaccacacccagctaatttttgtattttcagtagagacagagtttcaccatgttggccaggctgttccgaaactcctgacctcaggtgatccacccacctcgacctcccaaagtgctgggattacaggcacgagccactgcacccagctggaatatcgatttaattgtaagagaaaaatgcactagtttaaaaatgtgtcctctttatcctcaggttttaaaaatatttttaaggtagtttagaaaaactgaagtgattatttgataaataaatttcaaatgctatcaatggaacaagaatggatattagatatcctgctaacaaggatcatatttttacaagttgtttctccaaagagaacagagctacagctgagattctggtgcgcataaacctttccatcagagctgtagtcacctaacaattcttatatcacaatcttcatatctcaatcccttttccaaataacttcatctttcttaagttgcatacaaatgttataatctaatatttttgagatggatatcatgtgtcataaaaagaaagccattgtaatattaccaataccaagtattagcaaatattgacatagctttagaataaaaataaacagagctcagggtctggctctgccatagctagctagatttatcttaagacttcagtttcctcatatacaaaatgttgatagtatcatcatcttgtaagccttgttgtaaagagcaatttagctaacagtaacagtgtttaacatgcataaagtgaaggctcctttctgggctgataagaacgctagtttattcatttgcttatttctatatttttaagcttagagtctgaaaattttcagagtctgggagtcaacgtgtggggtgtgaattggaacttcaccacttactaacaactcccttttgtagtgcttccatttatttatctgttcaataggagtaataatagcactcgctcaaagagttgtctgaggattagatgagacaatgcttgcaaaatgcaaagtggagcacctggtgtatagttggtattcaataatttctagttgttgatatgatgatgacgatgatgatgtattctcttgatatgtgaatgctcatcacaccatcctatggaatatttgattttaagaaaaagttgggtttgttttttttttttgtttttttttttttttgagatggagtctcactctgtcgcccaggccagagtgcagtggcgcaatctcggctcactgcaacctctgtctcctgggtttaagcaattcccctgcctcagcctccagagtagctgggactacaggcgtccgccaccatgcccggctaatttttgtatttttagtggagaccgggtttcaccatatttggccaggctggtctcgaactcctgatcttgtgatccacctgcctcggcctcccaaagtgctgggatgacaggcatgagccaccatgcccagccaagaaaaaatattttaaacaagttaagatcatttactatactgtgccctaagatgaggtgaacatgtagatcatgagatctaattgattttagatgcagttcagttttttaaaagaatgacctgctttccatattaaaatttcaaaacaatgatatgtggagatgatgacagaatatggctgaatgaggtaccttgttatcctcaaccttttggctcagagacctcttccttgctggaaactttcctaaccttttaatgatttattaacattttgcatgcactctttatacctttcattaatgactagttcactgcaaatttttctttgctttatttcctattcttggtgtgacattcattctctatctgtttctatggaagcttttgtgatgcctcagagagaaagaattctgagtctttgaaataatgaaaacattactaaaccataaaacctagatttcaggagcctaatagaggattagagctttattacgtacagccatcttacagtttagccttcaagtctcaattgtggaatgatcttttgtcctttctctccagtgtgcatgtgtgcatacacatatagacacagttcgcgcttcagtcatataaatgggaagccacaaagcttcctagagtacccagatgcagaattagaagacccaatcttgacaccagggtcaggggatctgtggtttggggggacttgtgctggctatattgttgtcacagcaggaacagtttgtgtcggtatagaggctttaacttctagtaaagggatatataatgaaaatgtaagcaaccatcgtttatttttctcacataataggaatttaagagaaagatatacccaaaattggtttattagctcaacagtttcattcagaatccaatgtctttccatctttgcatttgctatccttagcctttggctttggtctttggaattgtcacgcgatggttataaaatggctgccacactccaggaattgcatcatgacagtgtgaatggaaaataaaggaagagtggcagttcttgtcatgtttcagaagcaacagcatgtctccctaacatctctttggccagaactaggtcaagtagctgcatctacctgcaagggaaactaagaaattgactatcagtgctttttaaacttttttttgtgtgtgtggaaatagataatcactagagaaaaaagggagagtggaatggttgttgatgaggcaaccaacagtgtctaccactctatttataaaccttttcttgatttttcctactaaatgtgtggccgttttttttgcttgctttttgttttttgtttttgagatggagcctcactctctcccccaggctggagtgcagtggcgtgatctcggctcactgcaacctccgcctcccaggttcaagcaattctcctgcctcagcctcctgagtagctgggattacaggtgtgtgccaccacgcccagctaatttttgtatttttaggagacatggggtttcaccatgttgatcatgctggtctcgaactccagacctcgtgatccgcccatctcagcctcccaaagtgctgggattacaggtgtgagtcaccgcacccagccaatgtgtagccttttagttcaaggacctttcattataaatcttcatagtccaaacacccggcatattgtctggcacaaaataggaagaaatatttttggacgtgccaaggaatttgcaagacagtgagacaaatagccagtaaaaatgttagcattaatatattattaaaaatagtgagaaatgctccaggcgcagtggctcatgcctgtaatcccagcactttgggaccccgaggcgggcggatcacttgaggtcaggagttcaagaccagcctgaccaacatggtgaaaccctgtctgtacttccagctacttaagaggctgaggccggagaattgctggaacccaagaggcggaggttgcagtgagccgagatcacgtcactgtgctccagcctgggtgatagggcaagactctgtctcaaaaaaataaaaataaaataaaaagaaaaatagtgagaaatgttatgaagacaaagaataggctactttggaagaataatagtgggaacttcttcatagtctaggaaggcctctctgaaaaggatatatttaagctaaaatctgaaggttaggtcagtcatatgaacagggaggggaatggaataatattttcaagacaatgacctaaaaggaggcaagtatggctaggagctaatgactgagggggtgagtggtacaggacaaggctggagagtttattttatgggtaagcagagaaataatataatctgacgtacctgtgaaagtacacctgagctgatgtacctgcaaaacatcatacaatctgatggacctgctgtataaatgagagattgaatgtggcaagagtagaagcaaagaggccaggtaagaggcatttgcagttgtcttgatgaaagaaaatgactactgggagtaagatggcggcaatggaaatagagagaaatgaacagatttgagatgtattttcgagacaaaatctgtatgacttggtgatggattagatgtcaggcatgagggattgaggatgactcccaagttttttttgtttgatcaacttgttgtactgtttgctgaggtgataaagatggaggaggaagcagatttggaaaagatcaacagttcagttttagacatgttcagtttgaaatgtgtgtgatatgtccaagtgcagaagtcaaattcaattatagctcaaaggagagacccgagctagaagcgtaaatgagaaaaatattgatacaaaatggaatttagagcatccagaatggaaatcacttagcatgtaaagagggaagggaagatggcctaggaccaaaccttgataaacttcaagaaaaagaagtcaagcagaggtaggagaagagaagtcagtcaaaaatcaaaagaatatgacatctcagaattcaaggatgtgaataaatgtgtaagtgatggatggctttcggtctgggctttttgttttttttttccattttaagttccaactttgctacaatccggctacgaatcccacaccctcccaaattatctgaggatgttaattgatacttgatcagaaagcagtgatttttaaaatcatatacttctaaattatctgagatatgaagcaatgagatagggaagtggctgaaatatgtttctctggctcagctgtcatgagggcttgctctagaatggcactcaagcacatgtttatccactgagctctatatcatttattccattagctgaagaaggaatctctcacactctaacttcagttctgttggacatgggaataaaagttagatgtatacagactaaactaaacagatggtagaaaaacaaaggattcttaaagtatattggagaaatgcatttctatggtcaattttcttgaatatcctaagatcaggtttcatgtatataattctttacatttcacaaagcacctttagatgtgtctattccatttaaccctcatcctaactgtgtgaagtagggcacagaagtgtagaaatgattttttaaaactcactaagctaatcaatggataatctgtgattataatagaatctgagtttcggcatctttatcttattccttactgcactatatctggaatggtaaatattgttcatctcacaagcaagctcttattgactgatatcagctgcctagagtggtttattgtaaaagagcataaagcaaattggggaagactacaatacagtgccataggctgattagtaatttctaccattggtattaaatgagaaaataatggtacaagtgctttacatttgtctgccattcctaaactaaggcacctcctgttatttataaggaagaatattctgagaagtttaaaagtctcttgttaaatcatttgatgacgttggataaaatggcttaaaataagaatatgcctgttgcacaaataatctacactcccccaagataatgaataagtcagctggagcatctcaagtttcaatatgtagaggatcaaaatgaaatagtcataaaaccccttgcagacatttcttgggcaggcaaactaatttcctagtaaaagaagttggaagttggacaaattgtatatgggaactttctatactacttttgcaaattttctgtaagtttaacttttcctaataggatgctgagattcagatcttccaatggtctcaaatgttttttggttttgttttgttttgttttttgagacggagtctcactctgtcacccaggctggagtgcagtggcgtgatcttggctcactgcaacctccacctcacgggttcaagcaattctcctgcctcagcctcccaagcagctgggattacaagtgcctgccaccatgcctggctaatttttgtatttttagtagagacgggattttgccatgttggtcaggctggtctcaaactcctgacctcaggtgatccgcccaccttggcctcctaaagtgctgggattacaggcatgagccaccgctcctggcctcatttaaccattttgactttcactttttctgtcttcaaaatgaggtattgagctaggtaaacttaatgtcttttttcgctttaattatctaataattctgtgattctcaacttggtgtgttaaaccagattacacctaagaaaccctgaagactttttagctaggagtttaaatattcacttagtcattcaattaatatctattgtgggtctgttatatgccaggcgccattttaggtattgataataaagcagcaaacaagacaaaacccctgccctcaggagagcttacattcttgtaaagaagacagatgataggccgggcgtggtggctcactcctgtaatctcagcactttgggaggccaaggcgggtggatcacgaggtcaggagatcgagaccgtcctggctaacatggtgaaactccgtctctactaaaaatacaaaaaaaaaattagccgggcttggtggtgggcacctgtagtcccagctactcgggaggctgaggcaggagaatggcatgaacctgggagctggagattgcagtgagccgagatcgtgccactgcactccagcctgggtgactgagcaagattccatctcaaaaaaaaaaaaaaccgaaaaacaaagaagaaagatgataaacaagtacacaattatcatataacaattttaaatagtgacagcatgttgaaataaataaagcaaggaagacgctagagagttgttcatggaaggaattgtcattttatataaggtgatcagggaaggttccactgaggaggtgacatttgaggaaagacctgaaagaagtggggagggagacccgaaagttcatgaggaattgtgtcccaaacagggcaacacataaaaagtccttgaggcaagactaagctgattatataacatttaaaagaattaggccaggtgtggtggctcacacctgtaatcccagcacttttggaggccaaggcgggtggatcacctgaggtcaggagttcaagaccagcctggccaacatggcaaaaccgcgtctctactaaaaatacaaaacttagccaggcatagtggtgcatgcccatagtcccggctacttgggaggctgaggcaggagagtcacatgaacccaggaggcagaggatgcagtgagccaagattgcaccactgtactccagcctgggtgacagagcgagactctgtctcaaacaaaaaaaaaaagaattaatttacatatcatgagatcatctagtctaacacccttactagacaagttcaaaaaggttaagacttggccaagatgacacagctatttaatgtgatatctgggttagaattcacctcatctgaattcctctcaaattgtgctctttgaggtcaatgtgccttttaaaaaatgacagaaagcatggctgtagatttcagatcataccaaatttgatggaacaatgaccatttttagcttcctatagagtctaagacttgaacttgccaagggagtcacagctggatttgtaagcatcaaatccacaaatgtacttaatgtcaaccaaggattttgtgtcacctgtaatgctcccccaggaagcccccaagtccactagtcctaatcactgtgtttggcttcataacctgttggcccaaacattacgcaaaaaagagcaatattcccaaggtggtcatgttagttgtggtgagatgtcaaccataagtagatctgaccgaggaaatgccttaaggaagcagctcaggaacacctgagtatatgtgtctagaatgaagcctattaaaaaaactactgcagagctaaagacagctgaaagccattatgacagtcacaactacttgatagattgaaaccaaagagttcctttgtgattagatagatcaggactctaaatcatgtttttacttcatgtgttcattcattcatcatacagtcagtgattcagtaaacaatattgagcatccattatgtgccaagcactgtgttaaattctggaaacacagagatggattagacccctgtccccagggagcataaagactagcagagttagacctccctcccatatgaagaaattaaatgaggtaaggcattaaaagtgctatgattacataatacagaacccaaaggggaaggcattttctgaaaaacagaaaactgaaaataccagcttttcagcctcacacagacataggaaaaccaacccccatcaacatcatctcttcttttttttttattattactatagtttaagttctagggtacatgtgcacaacgtgcaggtttgttacatatgtatacatgtgccatgttggtgtgctgcacccattaactcgtcatttacattaggtatatctcctaatgctatccctcctccctcccctcaccccaaaacagtccccggtgtgtgatgttctccttcctgtgtccatgtgttctcattgttcaattcccacttatgagtgagaacatgcaatgtttggttttctgtccttgtgatagtttgctgagaatgatggtttccagcttcatccatgtccctacaaaggatatgaattcatccttttttatggctgcatagtattccatggtgtatatgtgccacattttcttaatccagtctatcattgatggacatttgggttggttccaaatctttgctattgtgaacagtgccgcaataaacatatgtgtgcatgtgtcttcatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgctatttctccacatcctctctggcatctgttgtttcctgacttttgaatgatagccattctaactggtgtgagatggtacctcattgtggttttgatttgcatttctctgaacatcatctcttaatataaaaagcataatgtgctgatttcacattgcatgcctgtatcaaaacatctcatatgctctataaatatatacgcttaatgtgtacctacaaaaattataagaattttttttaaagcaacaataaatatcttcattagtcaaccaaattaaatctattaatatatccatgtttgtgaacaggatggccacagaaccctgtggatgcttaccacttaaacatttcctgaaacaaatatgtttccaaaacatcttgcctgtctaatctgacaactgcagacatcctaactaggctctgaaggtgctctccatagcactgatgttattgattcagttgttaacagcgcaggcataaatgactgatgataactctctaaacgtcccttcctactgccgttgaaatggctctgggctttatccaagcagggctgctaaatgaatagtagatgtaccagcagaggagaaattggtcctgaggtgaattaactctcctgaggtagatttgtttgtgcttccaacaacctgtacgttaaaccttgtgaaccttcatgtaggaattttgaggagaaatgggcaatttttggaaagcctaatgttttatcagccgctttttcttctcattgagacctgtgtattctcaagggactttggaagtttgccattttaagaacagacttgatgagaattatttgaagtcctccacgtttccatttatcagttttcctaatacagacatcctacgcacatcgttgaaagaatgttctttttgcctcacaggtagatcacaaaagtgggcccataatcattgggtagagggtttctcagctctgagttaaattgcagctgggtattgtttttctgtaataggatcttctctgagtgaatggtgaaacatgcccatttttgaggtcatgagagcagagctttccacatcatggacagaaaagggcaaccggccatggtttcagttatacagggagaggaaacaataggttttgtctctgctttgctattgcttcaacagcagcatactgttggacactcagacattagggcacaatttagacttgtttcacagctgtcatttctttcctcaaaaacaacaaacctgcatgggggaaatgagtctacatttcagggtttttcaagaattgataacataacatgtacttcaccatgaatttatattccacaggtccctgttctcttctctggtcatcagagtacaaaatcacaaccaaaaagcaagaattgatatctatgaagctaaagtagtagtagtagtagtagtagtagtagtagtagtagtagtagtggtgaagcaggatattaccctgatcccctcgcgggcgggaactggactgcatagccgcttcggtgctggcaggggcagactccactggctcagtctcactgagttccacccctcatgggagaggaagcacaggtgagtgggtacaggagccagggtgagtgcttttgggcgccagcaggaacaaaactctgtgtgggccccatggcagtgtctaggagggtgcccgcgacccttgaatccccagaaggagtgttacagggcccttttatctttgccatctgcagatggcttaagtgttaacagctcagtggagggtcagtgtgacagccttctgtactcgcacttgtggcacctcagatcttgcccattttccaggaggaatgaggtcacacaaactaattggagatggtaaatgcgggggattttattgctgatgaaagtggctctcagcaggaaaaggagctgaaaaggggacagagcaggaaggtaatcttcacctcgagtccagctgtccgcaatcagactcctctctgaagctatgctgccaggctgtccctcggaagtcaagccacttctctccaatgcacaaccatagtttccaacatccagctgcttctcctctgtgccggctgagcctgggatttttacaggcacaggatggagggcagggtgggctatgggtggttttggaaaaggcaacatttgagcaggaaaacagggatgtaagttctcactttgggccacagttccaggcttttaggcttaagggtggggcccttgccagagacccgccctcttctgtccagaatttccctgcctcctgtccctatcagtagtaatagtagtagtagtagcagcagcaacagaagtaatactaactactacataccaagcattatctacgtacttcatatctattcaccaacctaattgttacaactttcactcgcgtccgtgtgaagagaccaccaaacagtctttgtgtgagcaataaagctttgtaatcacctgggtgcaggcgagctgagtccgaaaagagtcagcgaagggagataggggtagggccgttctataagatttgggtaggttaaggaaaattacagtcaaaggggggttgtcctctggtgggcaggagtggggatcacaaggtgctcagtgggggagcttttgagccaggaagagccaggagaaggaatttcacaaggtaatgtcatcagttaaggcaaggaccggccattttcacttcttttgtggtggaatgtcatcagttaaggcaggaacaggccatttaaatttcacttcttttgtgatttttcagttacttcaggccatctggatgtatatgtgtaggtcacaggggatatgatggcttagcttgggctcagaggcctgacattcctgtcttcttatattaataagaaaaataaaacaaaatagtgttgaagtgttggggcggcgaaaattttcggggtggtgtggagagataatgggtgatgtttctcagggctgcttcgaggtggatcaggggtggcgtgggaacctagagtgggagggattaagctgaaggaagattttgtggtaaggggtgatattgtggggttgttagaagaaacatttgtcatgtagaattattggtgatggcctggatacggttttgtatgaattgaaaaactaaacggaataagagaaggagaaaaacaggtattaaaggacgaagaattgggaggacctaggacgtctaattagagagtgcctaaggaggttcagcatagccttgccagcaaagattatttactttaagagttaagagtggtggtttggggatagcaccaagagatatcagctgtgatggcttggagaaacagtgtaaaccagcagtgtaaacaagagcagggcatttatgactagttgagactggtgaataggagtatgactagacagaagataggagggatgacaagttttttggggtgcagtctaagttggtctggtgtctggaatgagactggggcctaataaaaaggagcgtccatacaggagcttaaatgggctgtaccttgtagcattctgaggacaggcctgaattctgagaagggcaagtggtaaaagtattgtccagtcctttttaagttggtggctgagcttggtgaggtgtgtttttaaaagaccattagttcactgaatactaagagcctgagaaactgcttgggtgatttgactaataaagtccagtctgttataggaccgtatagaggtgggaaggccaaaccgaggaattatgtttccctgtgggaaaggcctctacctatccagtgaaagtgtctacctagaccaagaggtattttagtttcttgtctcggggcatgtttagtaaagccaatttgccagtcctgggcgggggcaaatcctcgaaccttgatgtgtgggaagggagggggcctgaataatccctgaggagtagtagaatagcagatggaacactgagaagttatttctttgaggatagatttccacgatggaaaggaaatgagaagttctaagaggcaggctagtggcttgtactatagcatagcctgcctttgctggtgtgtggccattaggcctggtggaactgccatcaataaaccaagtgtgatcagggtgaggaacaggaaagaaggaaatatggggaaatggggtgaatgtctggtggatcagagagatacagtcatgggggtcaggcgtggtatcaggaataatgtgggaggccggattgaagtctgggccaggaacaatggtaattgtgggagactcaacaaagagtgagtacagctgaaggagccggggagcagaaagcatatgcgtcaggtgtgaggaagaaaatagattttggaagttatgagaactgtagagagtgagttgagcatagtttgtgattttgagggcctctaaaagtattagggtggtggcggctgccgcacgcagacatgagggctaggcaaaacagtaaggtcaagttgtttggataaaaaggctacaggacgtgatcccagtccttatgtaagaatcctgactgcacagccctgcacttcagcggtgtgtaatgaaaagggttgggatgagtcagggagagctcgggtgggagcagtctctaaagctgtcttcaaggaatggaaagaggagtggggaaaggatttaggatctatggggtcagctaggtttccttttgtgagtttatataatggttttgttaggatggcaaaaccaggtatctaaagtcgaaagtatctaaccatgcctaggaggaaaaaacttgttgttttctagaagggattggggtttgggagattagtcagacatgatcagcagggagagcacgtgtgtttttatgagaattatgccgagataggtaacaggtgaggaagaaatttgggcttgactgaagtaatgggggctgtctgtgaagccttgaggcagtacagcccaggtaatttgctgagcctgatgggtgtcagggtcagtccaagtgaaagtgaagagaggctggggtgaagggtgcaaaggaatagtgaagaaagcatgtttgagatccagaacagaataatgggttgtggagggaggtattgaggacaggagagtatatgggtttggcaccacagggttgataggcaaaacaatttggttgataaggtgcagatcctgaactaacctgtaaaccttgtctgcttttaggacaggtaaaatgggggaattgtaaggggagtttataggctttaaaaggccatgctgtagcaggcgagtgataacagactgtaatccttttaaagcgtgctgtgggatgggatgttggcattgagcggagtaagggtgattaggttttaatgggatggtaaggggtgcatgattggtcgctaaggagggagtagaggtgtcttatgcttgtgggttaaggtggggagatacaaggggagatgtgaaggaggctttgaactgggggaaaaggcggcaatgaggtgtggctctagcctaggaatagtcagggaagcagatcatttagttaaagtgtctcggcctaatagggaactgggcaggtggggataactaaaaaggagtgcttaaaagagtatcgtctaagttggcaccagagtttgggagttttaagaggtttagaagcctggccgtcaatacctacaacagttatggaggtaagggaaacaggcccttgaaaagaaggtaatgtggagtgggtagcctccgtattgattaagaaggggacggacttaccctccactgtgagagttacctgaagatcggcatctgtgatggtctagggggcttctgaggcaatcgggcagcgtcagtcttcagccactaaaccgagaagatctgggaaggagtcagagagccttgggccagagttccaggggctctgggagtggctgccaggtgagttgaacagtccgattatcagtggggtcctccacagatgggacatggcttaggaggaatcccgggctgcgggcattccttggcccagtggccagatttctggcacttgtagcaagctcctgggggaggccattctggaggaacccctcgcagctgcagttcaggcatttggagttcttctgtgctggagatatggctggggtttgtctcacagtggagggaaggaattgcaactcagaaatacattgctacttggctgcctctactttattattgtacaccttgaaggcgaggttaattaagtcttgtggggtttgagggctggaatttaatttttggagtttaatgtcgggagcagattgggtaataaaatatatattgagaataagacggccttttgaccttttagggtctagggctgtaaagcatctcagggttgttgccaaacgagccatgaactgggcttgtttttttatttgatgaaaaagagcctaaacgctatctgatttgggataaagaaaaaggagcattaaccttgactatgcctttagctccagccacctttttaagaggaaattgctgggcaggtgggggagggctagtcatggaaggaaactgtaagccggaccgggtgtgaggagcggaggtgataaaaggattatagggtggaggagcagaggctgaggaataattgggcctggcgaggaggggagaggtcagatgggtctgtagaaaaggaagattagaaagactgagcgatgcttggggttgggactgaggggacaggtgggagggaaagaaggaagatttggaaggagttgcattgggaacagagactggggaggggcagatgtgtaaaagaatgcctggacatcaggcacctcagaccgtttgcctattttatgacaagaattatttagagcttgtaggatggaaaaattgaaagtgccgttttctggctatttggaactactgtcaagtttgtactggggtcaagtggcatcgcagaagaaaataaggcatttaggttttaggtcaggtgtgagttgaagaggttttaagttcttgagagcacaggctaagggagaaaaaggaggaatggagggtggaaggttgcccatagtgaaggaggcaagcccagagaaaagggagtagagacacggagagaaggggtggggggttcttgtcccccagaaaagcggagaaggggtagagacatggagagaagggttggggggttcttgcccccgagaaaagcggtacttgccgctaaaggtgaaggaccaaggcaggcgtccccgtgtggtcagacacctctgaaatgtgggtgaataatcaggcaggcatccccgcgtgattaaataccaagggaagactcttccgagtccgtgaccggtgccggagttttgggtccacggataaaacgcatctcctgtctctaccagaaaaggaaaggaactgaagttaagagaagggagagattgaagtggggcgccaagattgaaaggagaaagaggttgagggatagtgagaggttggaggagagagtaaaaagaggccgcttacctgatttaaaattggtgtgatgttccttgggctggttagtctgaggaccagaggtcgtaggtggatctttctcacagagcaaggagcaggaggacaggggatagatctcccaagggaggtcccctgatccgagtgatggcaccaaatttcatgcgcgtccgtgtgaagagaccaccaaacaggctttgtgtgagcaataaaactttttaatcacctggatgcaggcgggctgagtccaaaaagagtcagcaaagggagacaggggtggggccgttttataagatttgggtaggtaaaggaaaattacagtcaaatggggggtggttttctggcgggcaggagtgggagtcacaaggtgctcagtggggaagctttttgagccaggatgagccagggaaaggaatttcacaaggtaatgtcatcagttaaggcaaggaccggccattttcacttcttttgtggtggaatgtcatcagttaaggcaggaacaggccattttcacttcttttgtgatttttcagttacttcaggccttctggatgtatacgtgcaggtcacaggggatatgatggcttagcttgggctcagaggcctgacaacaacgatcttgtagataggtactgttgtaattcccagtttacaaataagaagactaaggtatagagagattgagtaatttgcccaaagcccacagctagtaagaagccaagattcaaacccaggtaatatggctgcagacctggtaatcctaaccattacattaggctgactctcgatagttaacttatttaagctagtgttaatcacatcttaacaagtttgagtaataaaatcttaggttgaaaggggccttcaagatctagtctaaatcctttcaggagttcttccacatttctgctagaaaacactttggcctaggcttaaaacttagtgatggggaactcctcactttgtaaagcagcctgttcagttcacaaacaccctaataattaggctgttatctcttgcattgagctgaagttgatcttcccataacctctgcctttctgtctatatgtatgctttggaaatatacacagtaagtgtaaaccctcttggcaaagacagcccttcaaatacttgggaggcattcaattccccccgccacctcccgctctactctcactaccaagtctttagaatagagtacaggtatcaaaatcaaaacaaacagggagtagaaacttagtgccagactttaagtattttttacttataaaatctttttgtgtaacgagtagagcaactcctaactgcatatatgtactaagtttgcaaatggggcaatttgtttttccccatgcactggcatcagaggtggtaaatgctggcctgtcagattcaatgcattttgctgggttagaaccgcaagggctttccaggggaccaagctctctctgctgtaatcattaaaacctgcagaatcctgtgtgactctggggagaagcccagtgctcttggccctcatccaccctcactaggaaagctgcttaaaactaggacagaagaaacaaccactggcttaggatcagtcctcagacctgccttggcactaccccttttattccaaattttgcagtggcacctccaacttcttggtcacgttttgtaccttgtctgtttcctcatataacttcattccaaattccaacccatgctctgacatttcctctccattcttgctagacaggaatttctagatattggatattggcccctgcccataccctgactctgtatattcttttgtcctgctgaccagtttgagcttctgaataacaaaaactccccaaccactttaaagtcctctactttagcttgatgggtccctctcctgtattttctgaccttgactctgctctctgtacaaatagtaattacactcacccccaagcagagaatctgtgtcaaaatccatcaggatatctaagcacatcattatatctgtcaacttccccagactcctgatctcaatcccttattttcaacaacctggcaccgacagagtataatttcttttgtatcatgatgcagtttgatgtgcttttcgaaaggttatggtggtgattttaaagagatctgttttgttagaggaaggaaggaaaatagtgctgtttgcttccatgcagttcctcagagcctatgccagggtgatttcagctcatgagagaatctaaagtctaaagagatgtgtggagattagaaacattggtgtaaaaaatcagattacggagacgtaatatccagggtgtcagaggaggcagggagcttcaatcatgtttgaaactataggtcccacccaacaggatgagaaaatacaggagaagccagaaaaggtacctgcttgtgggtaaaatcaattaaatggaatcaatggtatggtagccatcatttctttcttttcaaattgtggtaaaaacacataatgtaaaatttaccattttaaccattttttagagtatagttcagtaatgttaagtatattcatgttgtcatgtagtggacttgcagaactttttcaccttgcaaatctgaaactgtacccattaaaccacttctcatttcctcctttcccccagcccctggcagccatctttctactttccgtctctatgcatttgactattctaggaacatcatgtaagcggaattatacagtatttgttcctttttggactggcttatttcacgtagcataatgtcctcaagtatcacctattagctgtcattgcttgaacacggttttctgccaagcacatgatctcgttttattcccaccacaactctcaataacaactgtgtaccttttttccctttcacagattaggaataaaaggctctccaagactaggctcagaagcagaagcagttggagagttgcttgcagaaggattattgtcatactgggaagtgctctcaggatttacacctctaagaaactgaaaggggcatgactgcgcagaggaaaagctggttcaccatgcagttgcaattatggctgcagcaggagcatgcagggaagctctggagtaggtttggcctttcagagttgtccccagtaaatcaaatgggtgaagactttaacccatttatgctggaggttgcaaaaatgttttgtgaaaagtcagaccttggcgatgaccttgagcagtaggatataaaaaactcccacaagcttagcgtcccaataatggaacactaggcataaatgagttaatccctgcatcagccagtcattggccctaggtctctccctgagggaggggatgtagctgtgtgaggcagttccctgagggcacattccaatgaaggccccagctgtgagccagcagccaataaggcagcaggtggcccatgcatgcaaaggccctaaagaggaggtccagggtggagcgccacggtgtctactacagatgctgaaagagtaaatacattttatttatttatttatttattttattatactttaagttttagggtacatgtgcacaatgtgcaggttagttacatgtgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggtcttttgtccatgtgacagtttactgagaatgatgatttccaatttcatccatgtccctacaaaggacatgaactcatcattttttatggctgcatagtattccatggtgcgtatgtgccacattttcttaatccagcctatcattgttggacatttgggttggttccaagtctttgctgttgtgaatagtgccacaataaacgtacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtacatttgtttgagttcattgtagattctggatattagccctttgtcagatgagcaggttgcgaaattttttctcccattttgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctgaatggtaatgcctaggttttcttctagagtttttgtggttttaggtctaacatttaagtctttaatccatcttgaattaattttcgtataaggtgtaaggaagggatccagtttcagctttctccatacggctagccagttttcccagcaccatttattaaatagggaatcctttccccattgcttgtttttctcaggtttgtcaaagatcagatggttgtagatatgcggcattatttctgagggctctgttctgttccattgatctatgtctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaaggcattggtagcttgatggggatggcattgaatctataaatttccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgcacattgcttttgtatcctgagactttgctgaagttgcttatcagcttaaggagatttggggttgagacgatggggttttctagatatacaatcatgtcatctgcaaacagggacaatttgacttcctcttttcctaattgaataccctttatttccttctcctgcctgattgccctggccagaacttccaacactatgttgaataggagtggtaagagagggcatccctgtcttgtgccagttttcagagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttgtaaatacattttttaaggtcacacaaatgacatatgggacagaacagtgtttaacttcaaaactcatgttctttctgctatactgggccttctctccgaaagaggcctaatttgcacactacagtcaagcttagaatctattcatagttaaaatgtggagtcaaagcccaggaactatgtccttcaattcatctttcattacttacctattccttatcattcccgctgacaccaaccattttttctgacccttgtcatgaggagtgaagttgtatcattgcagcagctttctacttgtactctatgcctaaaatctctccttcctccatctggtcagccaattgctgtcaagttaatcttgcaagaacactacttttgccagtttaatttcgcaaaactcctgctgtgtgccaggagtgtcccagacatcaggtagtctaagataagcgatagtctctgcccctaagccgtttgcaacctttggagagacaacgtcattatcaccaccagcacccccattaagctcagagctaatatatgccagatgagactctgccagtcactgtgctaaggacttgacatacgttatctcccttaattctaacaactactttctgaggtacctctgatgagtagtatcatttttagatacaaaagcagaaacttagcgagttaagtgctttgcccagtggctctcagttgagaaacgaggtagtcacaccaggcagtccaacttcagtacctgagttcttaatcatcatgtttacaactttggctcaacattgtcaccaagatcgggttcaaatacatccattatcaatattctttctgtctccttgtatgtccaaacaaacaaaacaaatgcttccctcctgatgaggaaagtctccaaatcttgatacctgctgtgtctggacagtttttcctgctatttgctgagtgctggaaggattccctcaatccagatgtgattgcagatccagctcaagctcagcgtcctccagggaacctttgaactaaccacccagaaacgagcctttcaccggacactactcattttcacatatctagatcttatttccccatctgaactgtaagtgtcttaagagctgattttgttgttttttaataaaaaataattcttagttttttttcttattaccaaaaaattattcgccattgaagccttctgaatttttaataagaaaactattggtatattgcttcaaaaagaaatctaagcttctagattcttgaaaagggatagtgacagaaccttagaattaatattcaatataactaatctgatgaaaattcagtcattgatacattactgagaactactagatctcagcatttttaattgtagattcacatggagttgtaagaaattatacacggactccacatacctttttaccgagtttcctctaatggtacacctgcaaaactctagttcaatgtcacaaccaggattttgacgtcaatattgtcagtatacagaacattttcatcactacaaagatccctcctattggccttttatagccacacccacttccctgccccccctacctcctacttccagcaactactagtctgttttccatttctttaattttgttatttcaataatgttatatgaatggaaccatacagtatgtaatattttgggatggacttgactcactcaacataattccctagagatttctctttttatatgcagcaagacttgtttcctttttatcgtgagttgtatgctatggtttggatataccctagtttatttaatcactcaccccttgaagacatctgagttatctgtagttttggactattgtgaataaagctaccaacattaatgtacaggtttttgtgtgaacataagtttttatttctctgagataaatgctgaagagtgcaattgttaggtcatatggtagttgaatgtttagttttaaaactgccaaacttttccgaagcgtctgtactattttatattccaccagcaatgtatgagtgatccagtttctctgcatcttcaccaacatttggtgttgtcattattttttatttttagccattctgatatgtgtgtaggaatatctcattgtgcttttaatttacgtttccctcgtggcaaatgctgttgaacaacttttcctgtacttgtttgccatatgtatatcctcctcattgaaatgtctgttcatgtcttttgtctattttctaattcaaaagtttttttatagttcggttttgagagttctttctgtatcagatactagtcctttcttgtgtatagggttttcaaatgttttctctctcatcttttcatcttcttaacaggggatgaaaaagaattttaattttggcgaggttgaatttatcgctttttccttttatggatcatgcttttgtgttgagtctaagaatactttgcctagccctggatcccaaagattttctcctgttcttttttttttttttttttgagacggagcctcgctctgtcgcccagcttggagtgcagtggcccgatcttggctcactgcaagttccgcctcccgggttcacgccattctcctgcctcagcctcccgagtagctgggactacaggcctccaccaccacacccagctaattttttgtatttttagtagagacggggtttcaccattttggctctcctgttttatatgtcttatagttttacattttatgtttaagtctgtgatccatttgatttttatataaagtatgaggtttaagttgaggtttattttttgcatatggatgttcaattgctctagcataattatttgaaatggctggcttgattattgaagtaaggtcagacttatttctctcctgggcttcagacccagccaccttctatgtttcttgtccaccacaacctgaatgtcccacagacacctcagacttaacatgtccccaacagctcattattatcctccttttgtcccaatccaccctcaacatttttccctccctaattgtgctgttcttatgaacgctacgcttcacccaattgcccaagtcaaaaattagggtattatttctgaatctacttttatctttaaatctaacatgatgcattgccaaattctgtcagctctatccccaagccatctcttaattcattcccttatttacacctcccttgactccaatatcttttgactcaaatgctacatagcctctaatttatctccctgatattgttcttgcttccgaatcccttttccacaatgcgcctatagtaatcctcctaaaatgcagatctgattaggtgactctccttattttaaagtctttcttattgttttctcctgccctaaggcagaagttccaacaaatcttgttatcagattctggattaaatcccagcctcagcagtgggacctaagatagtgcctgaatttccatgaacatttattgatgacaaacagggtcttaaataatgagtgatgtagactttccactgtcaacatcacagattctggtttttaatggtattcacatttgccttctccaagagtccaggtttaatgatggtgagacctatcctaagacctggctttgtagtgaggggttacctcatcacagaatcaagaagggacctcgggccgggcatggtggctcatgcctgtaataccagtactttgggaggttgaggtgggcagatcacctgaggtcaggagttccagaccagcctggccaacatggtgaaaccctgtctctactaaaaatacaaaaattagctgggcttggtggcacacacctgtaatcccagctacttgggaggctgagacaggagaatctcttgaacccgggaggcagaggctgcactgagccgagattgcaccactgcactccagcctgggcgacagagcaagactctgtctcaaaaaaaaaagggcggggggacctgggtgcaagtaattctaagaagcaggaataagagaacaagaagaatgaagcgacaaagaaagatgagcaattctctggaactgttgagaagtgtacagaagaaaacaaatctggatataggtagctacagcctgaaatatggaaagccagagcatgtgtatacctgctcctgctcccactggttgagaattgattcctttttcatctgatatgggcaagcattggatctgagtgggacacatcctctccagtgcacccctgccttttccgctgctctgaacttcacacaacgtcggaaagattcaaaacaatgtagaaaatctaagtataaatacaaaaaggaaacaagaagtttttctatcaaagctgtgaactatatgatatgagtaagctcaataaacactgtgcagaagttaggaggggaaaaagagaattgctgccaaagcactaacccctgtggctggctatgcttgcccacccaggaagctcccatgtcatgggggtcaggggaacctagaacagaaagctgaaaggctcagggatcccttttgagaagggatgctggctatacagcacgagttagaacttgcacagaaccgtccactactgctgacactggaatcacaggtgggctgacaagatgtgatgcaagcaccagacatatttgctacaaacctcaaagtggagcagagcagcggcagtgtcagtcttcttggtgtcaatagaatacctgtttatttgttgaattctccctatatgaataataataatacaagaattcaaagcaggataggctttgtgtcattggaggagtatggagaaccatcagtgcagtaagtgtcgtgggaggtttctagacagtttttaaaagtcgatattgagtcaaccatcaaatgtgaacaattctgatatgccagagcatttgtattcttaactcatggggttattacaaagatcaaatgaaataatcattataaagcactttgtgcagtgcctggcacaaagcacgcactcaatacatgttaatgtttatacaattattattattgattgtcagaattatcagccccacatcagcaaagaatagtaggtggtctgtcagcaggaacatggaaacattctcattacatagaagtcagtgttgcagggacagtcattaaaacaggatctaattttagtcttctgagggaaaatgctaggttctccggaaatgttgaatccttcctcgagcatgtagtttaatttttcaaaattatattgcatatcctgtaaaatgaaaatgaaattgtactgctgttcattaaaggcccccaaaaatcttaggcactatacaatataaatgaaaaaaaaggcgttatttttccatagggcataattagaaataaagaagcaaggtcactcacaaatttccgagctataaaggaggaaaggaacaagattttcccccggttattttatagctgccaggttgaactcatacttatccaatgagccccagaatggaataccgttctacaccaactgtactgatgatagtgattcagggagtaaatgataagattccatccttctaaagtgcttttgggattggattctagtaagtttcattttgctattggccaatcacaaaagagactacaatagagaaaagtgaagacatcatgctgaagacagactgctgcatagaaaaggaagagggaccccctaatttagagatatggatggagaaaaaaaggcacttatgctgtagcataagggaaacattaaataaagctataatagaggagaaaatgtctttgaatagaagaaaaaaatcagacagacagaaatagactaaaatgctaaaaaaaaagatacaaaaggacattgaaggggacatacagtgattattacacaaattaaatgcacacagttaaaagggaggtgaaaagcttctaaaaagaatgagtgtgtagtgaacttaattttatcatctttactaagacaaagttaaagtccctaaaatattttaagacacttaaaaaaaaaagtcttaaaattttgagagcctttcagctctgtcaactctagactttccctcctacttaagttttttttcttttttttcttttatcttttttatttatttatttatttttttatgttttttttttttttttttttttttttgagagagagagagagtggatcagccttaataagagaatggtcttctgccaggtggtattctcctaatccctttccagtgagatccacaagggttcaaaaccactttctggggtcttagaggcaccacttatctctcttcctctgctcatatctttctgctccagtgcccgcatagtttgtgttatcagtggtgcgtagcctgagacatccacgacctatgccagctctcgaagtaatgtgattggcatccaaagaaacacaagaagcccatgatttcgtccctttgcaatttaaaatcatatttaaaatgccttttggtcatacaaatttgaaaatgatcttgtaaatcacttccgggaatctatggtcaaaactcagcttagagttctctacttcttaacagagtgcctgccagtaactagtgactgtcaatgagtttgaaaacataaattgatgtgcaaatgctagataatagcaacatcctgtgcaactgggcagcatttctgttgtttggcttttttattttcgtggactctcccaatctgagagaaaatagatttgagttcctttttaatcggtttagacccagacaaggatttaattggtttagaccccattcacctacgtgtgtcactctgtctccaacataacagaggagatgaccaagacaacatgctctccagccaggaggtggggaatactttggtgtcatagcagacaattattgatggaaaactcatgttagaaaatgtaaggtaccttcttctagacggagtaaaaggggcagctgcccagactttcattttaaatagggagcccataatacaaatcttttaatacaattttaaaaagaagagacatagggggtatctcttaggacctgtcaacaaccaaccctctatcaaatggccaaatcacaggtggtctgcagcttagccaaaatgtccaagtacctttttgtaacacagaatctcctttgaagatccagctttcattaatgatccccagcagctctggtcaatgtgtcttttcacaaatgaagctttttaaaagctttcagtggacaaatgtggctttgagttttcaactaaatctttctgtttaaaaggagtgctgaaatgggcatactttataatcttaaatgctgcacacaaaatactgaaatattattgaccctgagaggttggttcaaatcaaatagcatactcacgtaaacgttctcttttcctaatattagcaacagggaatgtgaaatagagaggggcgggatatgctggataggggtgcaccaaaattttcaaaaagcctcgaaactagtgtatattgataaccttgtggcatctaatatctagtattctttttttttttttttttttttgagatggggtctcgctctgtcgcccaggctggagtgcagtggtgtgatctcggctcactgcaacctccacctcccgggttcaagtgattctcctgcctcagcctcctgagtagctgggattacaggcgcccgccaccacgcctggctaattttttgtatttttagtacagacggggtttcaccgttagccaggatggcctcgatctcctaatctcgtgatctgcccgcctcggcctcccaaagtgctgggattacatgcgtgagccaccgcacccagcctagtattctatgtctattatttcttcataatgagactgggggaaatctttggagaattaatgcagcagttggtaaaatcattctataataatgggtaccattctgctctgtcccacatttttatgaagtctctttaaatttaaaaaggcaatgtgctttgtggttcttgagcaacttaaatacgttgctctgaatagttattgtgatgaggtaatttgtaacaacttttaggatcaatgctaattttcttaaatgtttctgtagtttcccctttattataaagtatattaggctggactcttggctgtaagtgacagaaaactcaactcagattagttaagaaacaaaagggtgttggtgacagtggtggctttcagactattgctgcaggcccacctgccatcctcttaacaccctcaacataccctgcagaaaagagagagctactctgacccgagagcttaaagactggtcaagtatgggcttgactctttatggcccaaattgggtcacatgcccacctaggctaggggaatggaatcgtggaattgattgattgattattgttgcaggttgagtcctccaagaagcagatgccagggcagatttattgcagaataacacctgtgaagaaataggggtggaagcagaattgaacaagggaagccatcagatcacaatgcagatcttctagactctgtgtcagcacaacaaggaatgccagagcaaagactgccaattagaggaatactgaattgggcagatctgacaatagtctgtatataactcgggactgttaacttctccttcctcaaccagttatagacatagaataggactctcttatctcaaacatcaatatctgtgtatatgaagtagagggtgaaagtttactgtacactagtggttctcaaccaagagcaagtctgtcccccaggggacatggcaatttctggagacattttcagttgtcccaactggtgaggaggtgctactggcatctagtgggtagaagttgtggatgctgctaggcattctctataattcgtgggatagatagcacaacaaaaaattgcccaggccaaaatgtcaataatgctgaagttgagaaaccttgctctataaagatacatgtcttggccgggcacggtggctcacgcctgtaatcccagtactttgggaggccgaggtgggcggatcacgagatcaggagatcaagaccatcctgggcaacatggtgaaactcatctctactaaaaatacaaaaattagccaggcgtggtggtgcatgcctgtagtcccagctactggggaggccgaggcaggagaatcgcttgaacccgggaagcggaagttgcagtgagccgagatggcgccactgcactccagcctggtgacagagcaagactctgtctccaaaaaaaaaaaaaaaaaaaaaaaaaagatacatgtcttatgtgtactgaaagaggccacggaaaccttttgttgatacattcttgatagtttttgttcttatatgtagttatgaatacttgagattccatccaatttatttaacttttgaccagaaagggtagattgaattggtgaaacatctatatcctgaatatttaaaagattctgttttttaaaacaaatattaacttgaattaacgtaaatattcttagtagttaaagtccttaaagaccttagtttggtgaacagataagaatcatctgtgttcagcatatgcattgccttatgaagatggtaagtcaaaagtatgagtttatttctgatatttaaatatccctgaggtatagatttgtttactctggaagtttactctgttgtttgtttgtttgtttttgtttttgttttttgagacggtgtctcactctgtcacccaggctggagtgcagtggcacgatctcggctcactgcaagctccgcctccggggttcacgccattctcctgcctcaacctcccgagcagctgggactacaggtgcccgccaccatgcccggctaatttaatttttttgtgtttttactagagacggggtttcaccgtgttagccaggatggtctcgatctcctgacctcgtgatccaccagcctcggcctcccgaagtgctgggattacaggcctgagccaccgcacccggccttactctgttgttttatttcttcattatatattacaaagttgaatgttagggccaggttagatcggaaaacaagttaagtattccttatccaaaatgcttgggaccagaagtgttttggattttttatttttgtggattttggaatatttgcatattcctcatgagatatcttgggatgggacccaagcctaaacatgaaattcatttatatttcgtatataccttatacacataccctgaaggaaattttatacaatattttaaatacttttgtgcgtgaaacacaaaagttttgactgtgacctgtcacatgaggtcaggtgtgaaattttccacttgtgacgtcatgtcagtactcaaaaagtttcaaaatttggagcatttccgattactttggaaaagtctagaaaaagtttgatatcagtgcactgaaatcattttcaagtaggaacaatagcgatactagccctttactcatgcaaaattcacagtttttatctaaacaacacaaaatcattcaatgcttttatatttaatcatctatattcacctaaccataaaaaatcaatttcaatacagtaaggaaaagacaagaaaacgaatcattctaatcactgtattttgaaagttctttgcaaacaaccgtgaaatggttaaaagataggaggatggagaccagcctggccaacagggtgaaaccccatctcttctaaaaaatacaaaaattagccgggtgggttggcgcatgcctgtaatcccgggtactcgggaggctgaggcaggagaattgcttgaacctgggaggcaggggttgcaatgagctgagatcatgccactgcactccagactgggcaacagagcaggacgtctcaaaaaaaaaaaaaaaaaaaagatggtaagagaatgatgacttgttgcttactaaaataaaggaaagattgacactataagtgatactgtttgaaatctcaggaatctctgaatcattaagattatatcacaaatggcatgcaaaatacctgttcaaaaaatactcctcatggacatgagatgctaagctgctgatactgagtctgacctaggacaatgatgttctgtgtcacctcttttctgatgcctcccagattgctcctggcctcactgctgtctcacttccaaaaatacatattgcccttattggtcataacacagagactatcagttcaaaagtctctaattcgtctcagctgcagtcatctcccagcaagacacaaggttcttgagaaaagaaatttttcatgtcccatctttgccatccaccacacgatgaacatacagtacagtgtacatagcagcccttgaaaatgctggtggaatcattgattcttgaacccaactgtcatactttccagatttaagtcctggtaaatgattaaaatcgtatgggttaccctcaacaaaccagctcaagtatttactataaaaaagggaagctagatatggaacttcccctaaagatgggtctgtcaaactcaccccattgtattctgctctgacaccatgttttttgtttgtgttatttttttttaagagacagggtctcactatgttgcccaggctggtcttgaactcctgggttcaagtgatcctcccacttcagcctcccaggtcactgtgagagattacaggcttgcaccaccatgcccagccccaccttttaatacaaataagtaacagttaccatttactcagtgctcaccttataacagatgctgttaaacgctttacacgccttagctcatttttagttaaatacattgtttttgccccagctatggtagggatcttgctaacaatgagaatgaatgataagaggggctttaaggagaattcactgccacacctttcataattttcccatcattcctccagtctttgttcaaccgtccatgatttactgatttgctattacatcaaactatgctgcaacaaaccagtggttccttctgatttttatccatctcctcctcacctagggtgagagtctgaggcttccttgagtctactttctgatattgttacatttaacacagaacatctcttgttttcgtttctggcagcttatcctctcttcgctttctccatgctttcattcatcctaaaacaccattctgacaatgatatttaggttggtacataagtaattgtggttttaccattaccttcaatggcaaaaactgcgatcacatttgcaccaacgtaatatttttcttacttaaaaaattaatgtagagtatggaaatacttgccatcagggaatggggaagaaaatggctagagagacatggtgaaagagagacttgatttttaaataactttttttgtttttcttgaattttattatcatgtgaatgcatttgaaagaaatacaattttaaaataattattaaaaaaatatttgaatgccttcccatgaacaactaaatgaagtctctattcttaaacctgacagtcaagtacagctctggtttgactccaagctacatttctagccttgtattattcaactctttttctgtttatccttcatatccgggcctttactagtgccaaaaaaaaaaaaattgctcattctactcttgtcacccagagtgtttcttctgtttttgcccatcaaaagcttacccaattgtgaaggcccagtttcaaagcaacctccttcattaatttcatccagatactctgtaacccccatagctgtttaggcttgttctagcaatttgcagttatcagaaaaatgagtacataccgagtgccagaaagtggtctctccaactgtgcacattacaacatctcattctctgtgcctccatttcctcatctgtaaaatggtcactatggtgtactttcctcatagtgatgttcattctttcaagtagttagttaggtacctactatgagacaggcactgacctgggtcctgggggtacagtaatgaataaaatagattgagtcctgccctcatcaaatttaccttctgataagaaagacataaatgaaatgtacctataatgctcttgaaatagcacttgggatatagtaaatgctctataaatgtttgctattattactgtcattgttggtagtgttgttatgtggtatttctattaacacataaagaaactaaggttcacaggctgttagataagatgctggttaaatagctagtaagggactccaactcaggtcttcctgagtcataaaattcgtggcatttccactacactgatggatgtataccaggctgtacatcagaactatctgtggagacttaaagaaagtaaagattctcaagcctcagcctcaaattaactaaatcagaaattatttagacgagctaagaatctgtatttttttgaaaagttctcaaatagttgtgatacactgtcaaattggggaatgactgcactacattaaaatctttcccataatactttattatgcttatttgtaaatatcaaatctacaaattcactaaagaccatccccttgttttcttatttatttttattttttctgcttcctctcctagcaaagtgccttataaacactcaataagtatttgagtaattaatggcttaattatttaaagttgcacttaaaatgcaaatactcacagctgtggtactggaagcctgttatgaacaatcatttatcttcctagggttatttactaatcagctaaggacaagcagttgggaaagaaaggctgactatttgggaacagaactgagaaggccctcaaaccaaatgttagccacgttattgaacagcctagggccccgccttaactttacctacacttcgttgacaatttcaggtaaaatgcagaaaatatacgctaacaatcaggagattcctccctcacaccattgtagtttcatttcttttaagccgacacatgtctctcttatggaaaatatgggaacaacctgttttaaagaaagaaaaagaatcctttattcttgtcacaccacaaacatggagttcactgctatacgttaagattataaagcaaaatcccaaaaacgcagtgactgattattcacagtagacatatgaagtcaggaagcttattttttctctctttgctaaggcacaaagcctggggctatatgcatttttattacactgtactgtgttgatttcacttgaggattaaaaagagagttgaggcacagtgcacgtatcttgatggattttaggatttcttgctttcgtgaaagaaagaagcttataaagtacctcagattatcgcccagggaagtgtacctacttccatgatgacctagaaattcaatcttttgtttctcctataaaagatcacattgtactttggatgttttccctgtagttttctgcactatgtaaagccacatttggaaaaacaaaatagttttagtttagagttgaagtgaaaatatctgaaatagttcaggaaagtcttatgagcatttggggagcttacaaacagccttgggggtggggtgagggggaatgagggaagagggaggcagggggagagaagaggagggctaggtcagaagtgtgcaaagaagacagagggagagagaccgtagagactgtgagtccatggcagagttttaattctggttctcacacatctacacagagaaacaatggaagcacattgctccatcccctgtcctttactaagaagcgtgaagtaaataacttgtggcttatgatatgcgaagaagagagaagacagaatgttgtaggatttggaagtacagtagatgagatcttccggtttattgatttgtaaagaacggcttgatactggtttgtcagttctgcatcagtgagagaaaagaaaggcgcttttcagtcacttgccagaggaggagagccgggaagtggaaacagggtcttctggcggacaagcttccttgagtggtggtcaaattgactgtgaagggagtcaaggtcaggaagctttggaaatgctgcaaggatggtacgggatttaaggagggttgatttcctcggttaagggttgttgcagacttcagcaaattcccccttccagcctttattaaagaagtgtttagtagaacaaactgaaaatctacaagtatattgttacccaaaatataaaagcttctgccactgagatgaaaatgtttgatttccagtgctttatctttttgcatttatctacctgtttcagtcattcgttaatatgaatttcctaatatatgccgtcttttttttttttttcggacaataccagttctatggtatctcactgatgattatttcaaattgccacttttgttccttggaaatactcctgtgttcaaataccaggaggcataattatgtaattaccatgtgaacattatgctacttatgggccaaaatgcccctagaaaggaatgctccaatggcctcagaaaatttctgtgagaacgatatcttccaaatgtggtataaataaagctcaagaataaatagctaaggctggaatgtaaatgatttaatgtaatgatgttgtaaggtgagagccacttgactttagttcctgttgcaaatcatgagatacattaggaaaacttttaaaagggaacctattttttaagataaaatctgtatcaagttacatcaccttccaggcaaagtaattcaactttcctcttttctctctgagaccaaaaaaaaaaaaaaaaaaaaaggcagaagaaatgcttcctatgatctcttctcttcctgtcacaattttcataagtctgtagatgtaattaaaactaaagattttgacaaatgaaacaggataggaggttgattgctgcttttctaaattaaaatgaatgatacccttaaggtacttgggtctatgaagtcaatttaatgttgatataacctgactccattatcacagaatgaggcagttgcataagcaagaaaaccaataaacaaacatccaaagtgcattttagaaatcggtgaggtgaaagattaaaggcttaacaacggacaaagagcttgctgttttgttctctcttgccttccagtttgatggcagagttcatcagaattagaggaagaatgttcttggagaagcgttgggctggcactaggctaggagtcctattcatatcctgcctcgcttgtcttgcaagcatgcacagccccttcatttgaggcactgtttgcctcagcagagtctgtgtactcttctggtaggttgtatagaacataataaagggggagggctggaggagaaaggacagaaaaaggagggaataaaaaaaggagtcagattaagaaagaagtcagcacagaaatataaaatggaaggaaaaaaagctgtgatgcaggaaccttaaaaggtagattaaggatggtctcagatggcacggcattagtatcaatgccataagtcacacaaaatctattaagaattatgctcctactcagagtgagtgccatgttagcactagttgtttcccgtgatctatcctgaagtcaaacgcaagaaacactgtttaactcctaagtgccctaatgtcaggaaaacacagaaataaactcaaaggaaagacaattcagttaatctttgcattcaacaagcccaggttgttttgccgcagagctatacctatcacaaaacttcattccagaagatggccggtagaggtggctcatgcctgtaatcccagcactctgggaggcccaggagagtttgaaatcaagaccagaacttatctcagacttttttttttattattattttttcagttacaactcaaaagaatcagaattagaataataatggattttaactgaaagggattaccattagttaaaaggattttaactgaaactgtaatcagtctcaggagcgtttcccggataatgtttgggcacgtatttatgagtgttacttgtgaggatttgggagtaagaatgaacgaggaagttcctcccccaacacagacacatgcacacagaaactgtacaaactgaaaaacttcaggacaaaaactcgtgaatagactggagagtcatttgtgtgcatatgtgtggtttatttactagcatcacagcacaagagtttctgtcttttgcttttgtttttgttttaataggctcatttgtgtaagtgtcatgtctgtttcttgcattcccatggatatttatctagggtctagacaaactgagaaccagaaaatcaaaacatacgttcctagttacatattttctctagactggagtaaacatgatttatgtatgtagtaatcagtaagatgtagcttggacactaggaagaaaccacattgcctagcagtgtatttccacatggggaggtaatgcctgtctctcctaaacttctagtgaagataaaactcaaagtagagtaattaacagaaaggtcaaaagacaaagtggaagcccttgagaatctaaaacaaagttaaagaaccaacatttacatttagataaatttatttgaaataatttctaagagccatgatgttgttatcggtcctttttctttctttcttttattcttttggcttatttaaaagcaatgttgaagaaaaaatgaaataaagcttatctttcacaatacacagaggaatggactgagctttgggaaacagtcacagcttggaattaagagtgtgtgtcatatcgtaatttagttggatgatttggtgctcattcattatacccagaattacgctttcaagtctaccgtattcatacttatctcagtgcctgacaaataagaggaactcaaaaagcctttcattcattcatccattcagtatttcttgatcatcttctatgtactaggcattgtgataaattcttaacaagacagataagatctctgtctttgtggacaataaacttacattctagtcaatatcttttgaatgaatgtagtgatatttcttactgaagctaagaaaggaaggtctctgcaaacagtatactgtctacagaactcatctgaaatgagaagaccaaggagaataatatatagccctcataactctcaaatcttaaatatgattatttaaaaactagagtaaaacaaatgtggaggagatttggacttcagggttgttttataaattgccgttttacatttttaaatctagtattataggcaaaattgaatctaaatggttttcttcttttcttttttttactttcatcatcaaaaatggaagaaaggaagaaaaggaggaaggaagaaaagaaggaaaggaagaagggagggagggaagtttttcaaaagcttgtgtcagggatcttgaaaaagaaatgattcattcaaaatatagttgttaatagtaaagatccgtgaataaacagtacattaattcattcaactaatattaatttagcacctattatatgccaggtactgtgctactcactgaggatttagcagggaaagatgtgtccctgtcctcatggaacatataaaaaaggacctttttttcctgagatgcttttactgaagaattgctgcaacctagattatgagttctcatggaccagatggcagttttctgcccatctgggatagttctgaagaatagaccctcgtgtatcaatcaaggtttcttccagttctaagctttcgtgatctatgatctaatagttgaaacaggatgtatgcttccaaaaagatgttatatttgtattacttttataaaaggaaacagagacatgccctattaattcagaagagattgggttcctcctggctgtttaaatcattctatttaaactcctttatctcttctttcttggctcaccttccaaagctcactcttaccccttttagtctcacttccctttcctttctttaattgctgagacaaattgttcatctctaactggctatacatgacatctccagttaaatgtttcactgttaggacaaattcattatgttccaaatgaattcatacatacatatgctatttcttccttttctgattttcatattgccaccagcaatatcttcattctcccagtcttccttactcgaaatccaagagtttatttgcttcttcagatattaatctccaacaccaaattggatagttcttcctcctttcaaaataccttctcatatgtaccttcttttacattgaatacaatacagccttaattctaatgcatatcaacccaagtctagtaagttacaacagcctctttctgatctcagtctcaggtgccctttcgaatctgttttacactatactgatcttcccaaaccctaactttcctctaaaatagtgagtcatgtcacagaaattttcagtggttctctttgcctgcagggtaaatcttgagcctcagagtctgggacgccttgctttgcatcatcggctttcaacatgactaactaattgtatctcactgtcgtcctcaacaccactgttctgcagccccaagcctttcttcagcttgtcactacttcttacctccaaacctttacacttgcagagatcagggactatagcatttgttttttgcctatctctttcaatattaacaaatacttataaaatgaataaaccaccaaggaaagaactgattgtgccagaacataagacacaggtatatcatttctggcttttgcttcctgttttgtatataccacggtatattgatttaacatacagccagttagaaagatctaatgcatggaggctctcgtttaatagattatcaaatttcatttccttgcataattgctcaaagaataaagtgctttgttcctaagtcccaagctaaagctttcgaggactttggttgctttcaagtttttctcattcataaatttgtttctttatttagccagttgtgcattcaatccacacaaaacctttctccagtgataatttgtggaaagaaatattttatgcttaattcttctcgctgtcataccttctcttaagtttgagttatgaagatggaaattcactttgatctcattttaaaatcttgacaatattgaatgtacactggaaactaccactggagcgctccttgtataagaaggcaaaattcttcagagattgggagtctagaatgaactttgatgctgcatcggctcagtccctatgaaactaacattcttactagagaaagtggcctatggcacagtcataatcctttaccatctacatcttccccttgggatttctttctcagtatgtgaaaagatttctgatcagtgtccactcccatatggcatcttcatcttctcctctctacccccaaacactcacatttatctctagattgatttattcatgaaatgacccattctaaatttagaaataatgacatatgcccaacatttatttgcacgcgttttcccacaacctttctctataatcttatggtatcacattcttcaagaccaggaattgaccttgcattgggccataaaatacgttgaacaactgcagtttcatcgatatgcacactagaattggtctgcattcaataaactgattaaagaaattaaaaagccaattacttattaaatatttataaaatactttttttcaactttaatcttcaggatagcagttaagagcaagacccagactgaatgagtttgaatcctagctctgccaatttactaactactgaagcttaggcaagttttttttttttaacctctcatgcctcagtttttatgtcaatgaagtgggggggaataatattaactcctattgcagagttactgtgaagatgaaataacataattcatattgtcatgccacatattgcttaataaacattagccatttttgtattgtatgtggtgccctgcacattatagtctattgctctccttttttgctttttttttttttttttttgagatggagtcttgttctgttacctaggctggagtgtagtgacacgatctcggcgcactgcaacctccacctctcagattcaagtgattctcctgtctcagcttcccgagtagctgggattacagatgcccaccaccacaccaagctaatttttgtatttttagtagagactgcgtttcatcatgttggccagaccggtctcgaactcctgacctcaagtgatccgcctgcctcggcctcccaaagtgctgggattacaggtgtgagtcaccatgcctggcctattcctctccttttattaaccataatagtagcaagaacagtagctggtaacatttattgagcaattaccacgtgacagaaactaggctaaatgctttacattgtatcatcttatttaattcccacaaaaccctataagttatattattttccacattttactgataaggaaagttaagaataatttacccagggacattgattagtcaaggttctccagagaaatagaagcaacaatatacatatgtatgtatgtatgtatatgtgtgtgtgtgtgtgtgtgtatatatgtatgtctatgtgtgtgtgaatatataaaattaagtattatctcatgcagttggagactaagaagtcccatgacctgctatctgcaagctagagagccaggaaaattggtagtgtgatttcagtcccagtctgaaggcctgagaaccaggggagttgatgatgtaaatcccagtgcaagtgcaggagaagactgacatcccagctcaagcaggcctgcagggaaaaaaggaacatgcctttttgttctgtttaggacctcaactgacaggatgatgcccgcccacattggggagggcaatctactgaatccactgaaccaaatgctaatcttgtctgcaaaacaccctcacagacacacccagaaatagtggtttacctgggcaccccatagtccagtcaacttgacacatagaattaaccattacagacctgcagtcagtgcactcagtgtcagtaggcatacttgtttgttccgcatcgcttctcttctcttctctctctctctctctctctctctctcacacacacacacacacacacacacacacacacacacacacgtaccacatttactcatttactcatccatttgtttggtcaactagtcattaaacaaatatttgctaccatttactatgtgcctcctgcagaaagggttggagacattcgaagagaaaggtaaacaaaaaatggtccctgctatcaagaagtttccaatctattgcaagacacactcatgtccatataactaaaatgaattatatgatagaagtgcttcaggtataaaccatatactgttagaatgctgaggaagccattaattctaacctgggagatgaggaagtaaacatataaacactaacagcattgatctgggagagaagtggggtaagagcattgccgagagaaggagcagcatgaagaagccacgcacaagagttatattggatggaatagtgcaggacaggcaggtagttttggtgggcttagcaggtagagtttgggagtgcagggtcataaggttgggaaggtaggtttgatatgtccctcatgcttttgtgtatataaaataaagtaaatcctgcattgtaggggaaccccacttggttatccacgtatttgggccaagcaaaaatgggcaagtctagggagagagtgaaaaaatgagattgttctggatatacactaggcacttaattgatattggaaggccagagttggtttgagaccaggctacctgagccacttttctgatgagattaacatcgatttttacctctcgggaattctgcacaccacgggaactaccccctgagttctgattgctctgtgcaagctctgatcaacccctagtttagcatggactgttcacaactaaatcaaaatccagagttagagagctaggatgcctggagccaccacttatattggattggcaaaatgccaaataagtaagtatagcatgtcacccgtaaaattattcctttcttccccaccaagaatagaactcactaagttgacagcacactgtgtcaatatattatagaaaaacctaataggaagaaaagaatggcagttttcactgcatgccccctaaaggtatatttcttaataatttccaagtccactgaaaactgaattccgaaaattagttttatcttactacccaccctattttatcccaaatttaagccttgcctgtacttctttgatacttaatatttttttctttgaggtggagtttcactctgtcacccaggctggagtacagtggcgtgatctctgctcactgcagcctccctcctgcctcagcctccctaggagctgggactacaggcatgcgccaccacacctgactaatttttgtatttctagtagagacgggttttcaccatgttggccaggctggcctcgaacttatgacctcaagtgatccagccaacttggcctcccaaagtgctgggattacaggcatgagtcactgtgcccagcccataattaaatattaatcaaccactggttaattaataattatcaataattaaatatcactcaatgatttattatctattaatcaatattgcttctttaaaaatttgtcaaaaacaatagcctaagacttaaagacaagacatgtcatttctgagattctgtagtcacctataccaaatgtcaccctccctaatgtttttgtgaaagtaaagatttgtatttttttatggtactaattgaagcagtagttcatttgtggctgccaatgagttgactgtaaaaaaaaaccaaaatctcattttaacattgtcgagagaggaaatcctttgtgtttggccttggattgataaaaacgagtctggaatactatatacggtaagtgaatattaaaactagagttatgaaatgttgctttagtgttctcagtcttggagactcaaagtatcttatcagaaaggatacattgttttaattgttcctcattatatagaatgagagaacatcatttctctccttttcctcccaggtggccgtcgaggaccgagtcaggcagctgcatgaagcccacagggactttggtccagcatctcagcactttctttccagtaagtcattttcagcttttatcacttaactttattgcatcttgattaataagaataacagttgaaaaaacaaaagaattaagagttgaattatagtaatcttttatcagatgcagtagaagcataaatcatcctgaaatataacttggttgataagttgagaaggttaggaagaggaaggccaattggatcattttgtccagtcttcagctaatgcataattgtttcctgcactatattctcaaatgttaaccatattaatatttttgagtctttttgaaaaatgtggaacactttgctcaggagccatgctagtattctctgtatcattattccaatgttagtatatgggctgctgaagcaaaaacatacttttgagtttttaatttctgcctatcagttcagttcataaagctaataattatgatatcatgtaattataatatgatcatccaatatatgttactgtgactctataattctttaaataattcattaaatgatccctgccttatgaaatgagtgacaattctcaaaagaaggcatacaaatggccaacaggtatatgaaaaaatgctcaacatcactaatcaccagggaaatgcaaatcaagaccacatgatatatcgtcttaccccaattagaatggctattattcaaaagacaaaaaataacagattctggtgagaatgtgaagaaagggaactcttttacagtgttgatgaaaatgtaacagtaaattagtaacagtatgaagattctcaacaaactgtaaatagaactaccttaccatctggcaatcccactactggttatccatcccaaagctaagaaatcagtatatcaaaagggtacctgcacttgcatgcttatcacagcactgtttaaaacagcaaagatgtgaaatcaacctaagtgtatatcaacagatgaatggataaagaatatgtggtatctgtacacaatgaaacactgcaagaatgaaaccatgtcattcacagcaacatggatggaactggaggtcattatgttaagtgaaataaccctggcacagaaagacaaaaatcgcatgttcttactcttgtgggagctaaaaaaattgataataaacatagaatagaatgatagatactagtggctgggaaaggtgtgtgggtagagggggagataaagagagggtggttaatgggtacaaacatccagttagatagaaggactacgttatatcatttgacagcagaatagagtgactgtagttaacaacgatgtgttgtatatttcaaagtaccaagaagaaagggcttgaattgttcccaatacatagacaaatgacaaatactcaaagtaatggatgcctcaaataccctgacttgatcattatgcattctatgccagtaaaatatcacattacctcataaatatgtaaaatattatatatcaataataaataaatactatgcctccaagttgaaacctcagcctatgggcatttcctttccctaactgtttgcatccttcttttttttttttttttttttttttttttttttttttgagagggagcctcattctgtcacccaggctgtgagtgcagtggcgtgatcttggctcactgcaacctccgcctcccgggttcaaactattctcctgcctcagcctcccgagtagctgggactacaggtgtacaccaccaggcccagataatttttgtatttttttagtagagacgaggcttcaccacattggtcaggctggtctcgagctcctgacctcaagtgatccactcgccttggcctcccaaagtgctaggattacattcgtgagccttgtattctccttttgttcttgacctctagccattctttttatttactggttttgctattttattaattatgtttttataattaatactaagagaaataaccttggttaactgaaagtttaagtattagaaaatcctatttatacaatattgcatattaaattggcaagcacctgttttcctctgattaatgttaatttataccactttttatttgattataaaagtatatgtgttgagttttttggtatttaaaaagccatactttaccacatggagttaacatctgttagcattctgatgtatttccttgtggtcatatatgagtatatatgagggtttatccatcattttaacgcaattactttgtgcctagaaatgttacagattttaactagtttaatccttatagcaatcccttcaatcccttaaggtaggtaccattattatacccatttcaatgatgaagaaactgaggcacacattcatacagctagtagatgagggagccaggattgaaactcaagaagttggctccagagtctgtgtttttaagcatcgcactgtaattttacttaatttatatattttatagagaggaagtaattctgtatgatctccattcttctgccatattctttcattgccattttctgatcatttcctttcttttccattctccacgggttaataaaaagatccacgctcacaaatactttaaagtatttgagtagatgttgtcatgtgtgtctccagttggctgttgtctttttgaacaaaatttcctggaaggtgttggtcctgtgtttttgtcatacatcgataatagattaagaagaagtatcttattttctggactggctctaactttattatccgcatgtggtctagttatttggacacagtttcacaatgctttggagttgccaagaaaaagggataagttaaagcagtttatctaaatgagtgggatcgtggcttttaggaacggctctagaaaaatgataaaggctacagatttcgtcttctgcatctttccaaatctctggtctacttaacttgccttggtgacagccattctattcgatttaattgagattaaatgtgataacatactcctaagcgactcataaaccataaataaaaaatagtactattatgaatattaattactcctcagacaccaggtatattcattcatattttcttctccctgactccccctctgaattcccatgtcttacccattaaaacctattttcagaaaatgatatactcatttaacccaagtgataggtaaagtttaatgtgtacttctcctgggttatttgcattttattagtgtgaaaatccataagcctgaggtggtagaacatcggccataagctctgagctgtgaggaaggaactttgaggggccaaggggagcattctcacacctttcaaaccatatcacatcagtgcccacttccagaaaggtcaggcctgttagacacaggtattcataaagagactgatctacctgcctgaatggagccagccccggaagtcatcagtctcttggatgcccatgtggaatatcaatatacgcttaaaagctttgcttgcaggtataaagaaaataccaacttggtttaagggatatttaagaaataggacggtgagactaaggatggattgtttctttacattgtactttttaaaattacaaaggtactctatacacatcaagaaaaatttggaaagcccacagtacaaacaagaaaagaaaaagtatccataatcctatgactcagagataatcactatcagaaatttggtttatatactttctgtatttctcttgtggttgcgtgtgtgtgtgtgtgtgtgtatcaaggttctatcttttatttttttatttttttgttttttgagacagagtgcaatctcagctcactgcaacctcccccgtcctgggttctagcgattctcatgactcagcctcccgagtagctgggattacaggaatacgccaccacgcttggctaattttttgtatttttagtagagacggggtttcactatgttggccaggctggtctcgaacttgtggcctcaagtaatccacccactgaggcctcccaaagtgttgagattacaggcatgagccaccacgcccggcctctctcttttcttttaaaccatgcgcagataaaaacatgctacagttttatgagctgcttttttcccttaaaactatctttccaatattttcgtgtgtttaaatattcttcttcagagtaatttttctaatgactggctaatactctcttctgtggctgtaccaaatttaccaacacaattctaaattgctcaatataaagattatttcacaatctttattatatcgagcattatggctaatatcctttttatacctttacaaatatctcagattctttctacaggataaatgcctaaaggtggaattgccatgttaaagaatgtttacattcgtaagccttttcaagtgtattgccaaacttacctctagaaaattgcaccagaaattgggtgtgccatccaaaccgtatttgagctaggcatggtgtggctcatgcctataatcccaattctttgggaaactgaggcaggaggatcacttgagcccaagaggtcaaggctgcagtgatccataatccacccccccccgcactccaatctgtgtgacagagcaagaccctgaccctaaatttaaaaaaaaaaaaaaaatcaccatatttgaagcaggacatctctgaagtcacgtatttgctactataaaagcagcttccccccaccaatgaataaaaatatgttttaaatattcctctaaggtcatattaaatgaatttgaattgatacttttttttagacaggcctgagttgatacatgtttagtaatgtgctttcaggttactataaataataatagggtggctcctaaagcttagaaattacaaagaaaagaaaaataaggaggaactactaattgcacccgccagcataaacatgcttactgtctctgtttatcttattctctctctctctctgtctcgcacgtgtgtgcactctctctctctctctcacacacacacacacacacacacacacacacacacactcccctttggaaattatttggaaattacattaccagctgtctgttgtttatcagaagacagaggcagccttttactaaaaaaaagaattcactgtttcttcctggtggcccaatctctacatgttaaagaaattttttcttttatcttagatctaagagaaaatgagaagagaaaagcgttgtgaaatatgacccttctccgctgatagacactaacttgtccttacttctagttttaatacactgctactcctaattgacttctacaacttaaaccaagaaaaaggagaaattctaatagtgtgacttcaaatatgtatataatttacaataaaattatcatttaaattatttaaattatatactaatttatagttatatatgtataattggtaggtatattgtcagtctcttcatatgtctgtgattaagaaagtactaaagtattcattggttggcatagtagtctgaaaattgtccttttcttttgaagagtttaaagatttgttgggcgtggtggctcacacctgtaatcccatcactttgggaggctgaggtgggcagatcacttgaggtcaggagttcaagaccagcctggccaacctggtgaaacccccatctgtactaaaaatacaaaaattagctgggcgtggtggcactcgcctgtaatcccagctgcttaggaggctgaggcaggagaatggcttgaaccctggaggtggaggttgcagtgagctgagatcatgccactgcagtccagcctgggtgatagagagagactctgtctcaaaaaaagaatttaaagatttttcctgaccattatttcaattctctggtcttctgttctaaattctacttttctcaccaagaaagatcactatatatttgggtaaagggagaaatcattctataacagtaaaaagaatccatggttttcttaatattttacaagttccagaggtcccttaaaagaatattttccaagccaggttctttaaaacattaatgttatattaggttttgataactgtcccttgaaaaaaatagtactgattaataagattggaaaaacactaggtttcaaagataagcaagtttatttcttgttagaattcttggaatttttattatacactgagactctaagaggataaggagtctatagttctccagttttaggtgactgtggaagcctttttcaggcacaccagttaatttcacactaaactttatgccatggatcacagtgaatctttgccttaatgtggtatttgccagatgctttaatgacaaaaaatttctgctaaaggttgtagaaacgtgatccaattaaaaagaaaatgagtatttatgaggcaaaagggtcaagtccctctctttactgaagttcccagccccactcccacccaggagccctcttgtgctgtggagtttcctaactggagataagcttagaaagtatctataccagtagtttccaaactctgaggtgtggctcattagcaaatcctaaaatcagtttaatgacttacaaccaacaatttttgactggtatggaatggaatggaatggaacagattagaaaatatcagagtgcattacctaagcaaggttaagtgttgttttggcggtggttaatttgttagatgtgtgtgtacatgcgtgtgtgtgtgtgtgtgtgtgtgtgcgcgcgcgcacgcacgcgcgcacgccagatcacagtgtaaaacgtttttcttctgtgggttgcagtcgaaatagtttgagaaacattgaatcattcgagccctttccttattttacagataatgaaataggtgcagaacgatcaaatgacataaccaaggtcacaaagatagttataatactgggactggaacccagtttctggacatccaagccacacatcacactgccttacccgttaagaagaaatgcccaggccaataactgtctagtctatctgctattgccaacgattattctctcgtatattcctcttcgtttggccatcctaagttgatttacataacctaaatttttctctcaacacctctgggctaaaaactgccttatcaaaatggtatcgatagcggttaagagtaaaagctgtaaaatgaaactgactgggttcaaatattgactcagacactttatgcttttttctttctctttattcttcatctttaaaatagggataatagtaacatatttggtcaattgtaagacacacttttccacccacgtttcaacagttctgaaatcagaatgcaccatacgaccaatgggatattgaattcggtgaaatatggctgtattatttcatagggttacagtgaagatcaaacagttaatatttgtaaaacccttagagtagtgcctggaacatagtaagtgctattcaagtgtttgctattagctttagcattagtatcattattactatcagcttgatagtataacttaatgcatgcctgttagagtcaaactagtcatgaaagtttcattcattctcttgcatttaatggtcagtataagtagttcctctcctttctgaagatgatttccaaggatctaatctgaaagtccagtgttttgcacattagaacggctcaatagttgtttgtataactaacgagtgataaataatcaaaaagatagaccttaatctctaaaacgtcaggatagtattagtcttgttgacagttatattctacagtacctaatgtggtatgtggtacttagtagatgttcagtaaatatttacagaatgaattatgtcttatacccaaaagaagaagaggtaaattcactcttgacattgataatacacagaggcatgagatttagcatagtggctatcacatagtagacactcaataaataatgtgaccttttctgttgcttctcagcaaagactaatagcattcataactttatatggtcgtttttatcaaagtcgactgtaccatgtaatacattaagggaaaaggctgacttcaaaattacagcatgatcacaactatattacaaaataaaataaaaataacagaaatgtacacataaaggaaaaatggaaaataaaaagataccaaaagacaaacagttattgcatcatttctttctttttacttttacaaattttctggtaatagcatgtactacctttgtaatggaaaaaaaacaataaaggtaacattttatactccagcttttaaccagtgacctcttgcagtggcaatgggactctgaaagacaaatttcctttttactatttattctgaatttaaaagctgtttcattgagtgaccttctcagattatgagacactgtaaaaagaaataactgatccattatttcttgcaggctttacaatcttaactgccttaatcatatccctggttaagtctttttctctcttgtcaaagtgactcaagcttttacagtttctccttgatacatagggcctagcagtttgtttctatcttgagagttgccaagctttcatcctggacattccccactacacatacacacttaattttaaaaaataggggaaacctttaagcacatctaataattgctgacatttcacttaacagtgctccaacctatgctaccagtgtcctcaggggacagacaatttgaaatatgagtggggcaataatttaaagcttcagattggcttaaataagccatcatgaggccgggtgcggtggctcacgccagtaatcccagcactttgggaggccgaggcgggcagatcacctgaggtcaggagttcaagaccagcctgaccaacatggagaaaccctgtctctactaaaaatacaaaattagctgggcgtggtggcatgcatctgtaatcccagctactcgagaggctgaggcaggagaatcacttgaacccaggaggcagaggttgcagtgagccgagattgtgccattgcactccagcctgggcaacaagagtgaaactgcatctcaaaaaaataaaaacatcaaaataagccatcatgataaaagtcagaaagaattttgcaggtccaatgtgagatgatttgcaggctaaaattctctttcaagtaaaatctcagggtgaaatgatttgagccagtttcttcagcagtcacatgttgtcccaagtgttaggaatttgggacaaatgccatgtgacctaccagtgatgctgataatgcccctataaattcaaagacagcctttccaatgcccataaaaagcagctacagcagtaataattatattctcttcttaaaatgtgttgtcatggcccttttctcctttagctcaaatgtatactccccaataagctctcagatttatttgctttacagtatcattagcaaccagattttgcatcgttggccctatatatcccatcaatttgaacacatgaggaaacagaacgtttttgtttctgctatgggaatttctgtgctggggctggcttacaatggctcaagagagccaattgtaaaatatacaggaattgtgagctagttattaagcctacctttggtagcttgaaatcaggcatagtgggaagatttactccatggaaattggcaaatactacaaattggggcactttgttttttttttttttttttgtgcatagatggtttcccagaaatgactaatttatctatgttatttggatcactcaagtccctgtaggcaaagaatcttcataaacttagcaggaaggatgctcaggatccaaatatttatgtgcgttgcagagtgaccactcatcctggtttgtctgggactttcccggatttagcactggaattcccattttccaggaaatctctgtagtcccaggcaaaccaagatagttgctcaccctagccttaggtaaaatccctagaagtagagccctatttagatagatggggcttcttgtagaagtaatttgttcaggtgaaagggagtgagggaagcaggataaagtaagaaggatgctggtcaaggagttaagtgggaaggaagagactcacttcagcttgatcccacagggagctctggagaacaaattgtccctactttgagataaggggcctgggctttttgtttgtttgttttgagatggagtcttgttctgtcacccaaactggagtgcaatggcgtgatcttggctcactgcaacctccgcctcccaggttcaagctattctcctgcctcagcctcccgagtagctgggactaccgcgcctggatttttttttttttttttttttttgtatttttactagagacggggtttcactaggttggccaggctggtctcgaactcctgatctcctgatccgcctgcctcggtctccaaaagtgctgggattacaggcgtgagccaccgcgcccagccagggctgggcttttattttcccgtgtgaattagtcattggctgtggatttctggggagtaggagatagcaaagcagttcccatttggccaagggaggatttctggtgaaaggaccaatgaggccttagcaaccaacactcacaacaactgcggctgggtgaaccagctcagtaaaagggatctgagtggaacaacaatagtattaacctctcctagactttatgaagctgctatcataccccatgcataatctggctttagagctgaatgggcgcatttagctggatcactaaccaccactccttcgtcacgtacttacatggaaattagcccggtggcatggaagagatgagacaaatgtctgtttctttcttatttcatcttcctcattgtgacagattcttctgggcctcatgaggagctagggcaaagagaccagcaccagagttctgaatcagttttataacatgggcactattttggtggaatgctggctctgaagggtgtatttttacactacccagaaaatgaaggcatttgtgaatttggcctggggtagcattttgtcatctgtccaaaatacaaagctttgcacaacagaaatagtgggatcacatccctgtgggcaagaatcattactttcgtttttccatttggatgttttccattttcagaacacaaccagtttgggattacaaagtactttctggtgagaactttgaagtgaggacaaaaggcattttgttctttagtagacttacataaactgttcctggtttaaaaaccattctagatttttaaatagactttcagatatctgcagtaaaaatcatcttgatttcaggcgactgcaggtactgctctgttatgtgctatgtctccttaaggctgtaagggacagggataggcttaggtgataaggaacattttcaggatacagagaggcatgaagaataacatgggccgggcgcggtggctcacacctataatcccagcactttgggaggctgaggcgggcggatcacgaggtcaggagttggagaccaacctggccaacatggtgaaaccctgtctctactaaagacacaaaaaattagccaggcatggtggcgcacacctgtaatcccagctactcaggaggctgaggcaggagaatcgcttgaacccaggagatggaggttgcagtgagccaagatcacaccattgcacaccagcctaggcaacagggcgagactccatctcaaaaaaaaaaaaaaagaaagaaagaaaagaataacatggaacaacagacaccacgaaacatgtttgcttctttctgtatatgcatttgctgccatagacttcagactattacagtatcatatcttctctcttctctccacctaacaccttctacttatagtttctactttcttatgacttccattttcttcctttgttatccgactttttaaacttccccacccatctgtcatctctgtttatctctgtgtattacattcaagctctccaagaaaaagcatctgattggattagttatttattatccatctaagggtaatgccatctcacaggccacaggccagactgtaaactaggctttcttgacctgggcactattggcatttggggccagataattagtggaatgctggctctgaaaagtgtatttttacactactcagaaaataaaggcatttgtgagtttggcctggggtagcattttgtcatctgtcctagaatacaaagctttgcgcagcagaaatggtgggatcacacctctgtgggcaaaaattattgggggctgtcctgtgcattatctctggcctctactcactacatgccagtagcactcccctcccttagctgtgacaaccaaaaatgtctccagacattgtctgatgtcccctgttgggtgaaattgcccctagttgagaatcactcctttataccaatgcctgcacaatttgtggtaatgaaagtcatgtggaacactaaatacagtgacctatgcctgaggaattatttgaagttgcttttctgcatccttagggaccctttagtctctcgatgaaagggagtgtcctcagcagacaatcttcaggaattgcatcagctgcctcacccaagatcataccccttacaggggcagctcttcctgatcagtgtaggggaataatgacctggccattttggcccaactcaggagaacattaacattctagctcaagagctcccatggggttgaatgagactgtcactgggtctgcattcaccttgacttctccctatttctattcctgtttctttcacttcccttccacagttgtctatcctgctctctaatcattgccttagagttggcttcctggaggaagccaatctgtgagggggcaatgaaattgacaggcatttagaagcatctaagaaaaaggtattataataggcccattacagtcactgggtaatttgatttactcttgctttcataatgaggttgattattttgttcaggataagtagtgattattattatttaaggtgtccaacctcatgatctccattaataggtaaggactttggggacagcataaaattacatgaatctcttaccttaaaccttaagctcagcagcatacatgcccatgacaggcaagagttagaacgtaagaggtcagtaannnnnnnnnnnnnnnnnnnntcagtaacatagatcttgaaaggaaatatgttggagtgtgagcactttaagggcatagagcctgcattacttttttattaaaaataattttgcatctaacacaacatcttgcatattagatgcaggatatgccttgattgaatgaataactgggcacttaaaagattgttcccagtctaataaaatgaaagaacttagcctagtgcttagtctaatgtccagaaagagttaatgaacttcactttatcttcagtcagttaagaattgattcactttgttactcaacaaatgtctgttgaatgaccaatgtaaatcaaactctgatctaggaactggggaaacggcagtaaataaaacaaagtttatttattgtggagcttacattttaacaagagaagatggacaatcaggtcatgataagtttgatttaaaaacaaagaataaagcaggctaaaggggctagaggatgggagaaggggacccttttagtggagtggtcaggaatggtgacatttcagtagagatgtgaggaagtacaccagtcagatattgggggacaaagtgttccaggtggaggaaacagtaaaagtaaaggatccaagatggagcatgcttagagggtttgagaaatattaatagcaaggaagccagtatgactgaagccaaggaagaaagatggtgaatgataggaggtcagtgagtgaccaagggccagacgaggaagggtcttatcaactatggttggctatcgttaaaagcctttggcatatatgctttgtgagaagggaagtcatagaattctgagctaagaagtgacatggtgcctgtagcattgttacttactgtgcctgtagtattcattcattcattcctatatttattaacaaaaacgagtcacctgaaatatgaagataaaaagagaattattgccttgggacatttaaataccaatcacaaaagacagacctataaaaaatgacctcctacagtggtagtaaatagtgggtgcaatgggagtagaatggaagggaggaatccattccacagtgagagaaaggagatgttctatctagttgagtattaacgcatattgtccctgaggctacatgcaaatccaaagtagagggtattccttttgataggaacttagcaaagaatgtttataattgcttggtccctgatctcacctagcaagagtcacaagatgcattcagtgatgaaaaatcagtttctcccttctacttagccattctgataagatgaatatctcgggccgggcgcggtggctcacgcctgtgatcccagcactttgggaggccaaggtgggtggatcacctgaggtcaggagttcaagaccagcctgaccaacatggtgaaaccccgtctctactgaaaaatacaaaagttagctgggcatggtgacaggcacctgtaatcccagctacttgggaggctgaggcaggagaattgcttgaacccaggaggcggaggttgcagtgagccgagatcgcgccattgcgctccagcctgggtgacggagcaagactctgtatccaaaaaaaaaaaaaaagatgaatatctccctttccagtttcgtgtgtagtctccttacagcccttctgttcagaaaagggatttcttacgtatgtataatgaatataaatataggttttagagagcactaatgttttaatgagatagaaataggcagacgagagagaataattgaaggattagtcaacatgagggcaatttgatagggaaagaaaaagtctgagcaggaaatgtctgtggaaaaaaaaattcgaagaggaatggaatgaaatgagctcatttatggtgtgagttagggacagaagggatttattctcaggaggtgaaaagtgaaggagttcatgttatagaattcgacctagaccagctatcaagggaaagaaagtaattcaaaagacttggtccaggagatctggagcagatacatctattagaggaagattcagttttgaactgcatcttcagttattcctggaacccaacacaaaagctcatgacaaccttgttatcttcaggcaaaaaaaaaaaaaaaaaaaaaaaaaggcgggggcagcaaggcttatgtcttaaacaagacagcacataacttcaggtcagagaattccattaacatgaatcacccacaccaatttaaataggaaaaaaaatagtaagcttggttatgtaaaaatttagtttaaaaatcagaaccaacaattgaaattaaacaagaatgttttatttatttctaaaaatatttagctatttattttgaattctgaagcaatactaatatagtatataatgataaaacacagttgattttcatagtaaacatcagcatcagaatgccaagaggaagatttgtctccgttcatgttttattactctgagaaccgcgtaacattttttaaagagtcagaaaatggctagaaaaagaggaagaaagattatttccttaactagttccctggtcccatgctttggtggttaacagtcagtttaactctagaaccatggaaagtctctgtcactttcctggttaccctgggattcctcacattggcagtaagttcgtgaatgagataaatatcctgataactagctacattaatgatgaaaataattataaacgtaggagttggaatttttaaaaagtatcgagcgctctgtgctcttaacacagaggaagcattttgcatagattaacccgtttaatcctcacaccaacctttaaaataaggactgttattgtctccatttcacagaagagaaaactgagactagaacaatttactaacatattcaagttcatacttgtaactattatggattatcagccttagaaaaggggttccagacaccagtgaatagcaacccacacgtgctcaactgcacagaccaaagaggatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcgatctcttgacctcgtgatctgctcaccttggcctcccaaagtgctgggattacaggggtgagccaccgcgcccggccgaggtggaccctcttaatccccttaagttttaagtgcactacacagtattgttaactataggcactatgttgtacagcagatctctagaacttactcatcttgcataagtgaaactttatactcattgaataacaatttctcgtttcccctgccctgtcttctggcaaccacttttctatttactgcttctatgaggttgactatttcagacacttcataaaagtggagtcatacagcatttatccttctatgactggcttatttcactgagcatgtctgcaaggcccatccacattgtcaccaatggtaggaaccttcttttttttaatgctgaatggtattccattgtatgaaaatgtggtgtatacatgcagttctctttgtacgatcttccttccttaaagagtccagccattctcatagcatctgctatgattctagtacttatggtcttgtcctttcacttgcatttcagtgaaaagaaccaaacttatgctgatgcaaatacctgtacacaaatgttgataccagctttattcatgattgccaaatgctaatcagtctatgggcctctgattttcactgcataaaatatagactaatctgtttatcattcatgctgatgaatggtggataaatggtctagctaagaatgaaagatctgttgtatagatgtcattggtctaggaagacagagatgtagaaagaagtaccataagcccaggcagttagatactattcaaaggcatttctctctgccatactttatactacatgtggcacattaacagtagttaggagtggattcaaggctgcagataaatgctgcccaggtgagagagaaagaattggttccacaattaaccatcattcagacaacacatcatagctatgtgattacaaacattatttgtgtggtgattaacattttacaaagcaatttcatattgatttcctcattttatcctgacaacattttggtgagggagatatcattattcccattggaatataaggaaaataaggcttaggcaggaaaaagactagcttaagatcatgaagtgataggggagtcaggactcaaatccagttcttctgaatctgtactctggacattttctgctatatccagctccctctcaagatgctggattgggctttgaaatagaaagccaacatcctgagtgcctttctaaactctgagttttacagtctatcaggggaagaggagagtgtgagaggaatgttcccaaataatctactgtatcaagcagtatatctaacttgctttgagaattatgccaactaaatactattgacctgcagaaaattgatttttctctttacacttatatcaataaagagaggcttctgctgccataagtgtaatttatgtaaaatgtttttaaaacattcatagcctttaatcaagtaaatatacttctaggaattttgctttaaaaaattaactaaaatatgtgcaaagatttatctacaaagatgttcactgtggccttacttagaacagtgaaaaactggagacaacttatatgttcccaaagagggaatttattcaataaatcatggtacatccataagtgggaattttttagcaatgaaaaatctgttgtaaccctacaagcccactcttaagcattcatcttagagaaatgaaaacttatgcttatgcaaacacctgtacacaaatgttgataccagctttattcatgattgccaaatgctaaaagcaacctaatgtctttgaacaggtgaatggataactaagctgtagtacacccatataatggcatactacttagcaatgaaaagaaacaaatcgttgatacagcaatatggattatgcattatgctgagtgaaataaaccagtatcaaaaggttacatactgtatttatatgacattctggaaaagacaaaacaagtctagtagatcctccctaatgccttttgttcaaccccagaggtgagttttctattttacctccagtgattgctgtatcggttatttatctaaactgtccccacttttttgacccacctatgttatcaaactccaaatccaccaagtatgagaaaagtagagagatgaatgaaggtatttgtgttggaattccagaaagtgctcttttggcatgtcttaaaataacattagcattctttttaattttctggttaggcccctatgttgattaaaatatgacttaacaccagggtgcatcacttggaacattctgttcatcatgcatttaaaaacggctgaaataacaacttcccctaaataatgtggcctgtgcttgtgattttcaaaactaccttgggcacaatattgaatcctgtcacctcaaggaaggaaaagcatttgaagatagaattgctaccctttcttgctcttaataacatactgtgtctgtaacacaaaaggaaattcagaggttggttttgcaataaataaatgcatgtgtagtttgctatctaaattcagtggacaataccccatgatgctggtgccgtatgataatggttgatttgtacattcaagaatctgaatcacaaagctgccctggaattacacgtagtggttataagcacatctgtataagaaaataccaaaggacaacccggtgtcatatagaaactatttgccgataaatttgcttttgatgggctactaaaaatggacacatcaggcataaaagatgtgtgtgtctattacgtaggctagctttatgaagaatgacaagcttccactggtacactgagataagaaacagctgttgttggcatcagtactgctacaagaaatgaaaaaattctgtggcacacttgtgagcactgccacatatttgatcaacttttgaatagatggaagaccagaatcatctggcagccccaaatgaaattgtcgacaacccttaagaatctcttgagaaggagcactgaacccaattccgtagaactatcatccaattgtgtgttatttctaaagcaagtagttccagtgtgtgtgtatgtgattatgatggggcagggaaggaatgaggggaggctgttgttattttcctttttttttttttttttattgtgtcaaggacatttttgagcataaaattgtaaggtttcaaacaatgactgcaaagcagttgcttaggtgaatttataaactgtgaatcaaaggggaaaaacatctttcagaaaaaaaatacactgaatctcaccattggacctatttgatggctacacataagacaaaaagcttttttaaggaaaataaatgaacacttaagaactgcaattacaaaagcttgaaatttcatattgatctagaatttataatatttttaaaattctttaaaaatattttcagctatttagttcaagcatattctgataacttctctgacatttaattgaaaattttccccttttaatgtaaacataaaaagtcaactctagataccctacgtaggtcttcccattagctcagccaggcaacgccaattttcctctgtctctcgctgcttagaggttgtttctttcaggccgaaagcccctaagccaggccaggcagccagcagccctctccagcacacttctttctgagagacgcctaagaatagtgtaggaaatccaaagtgattcttctgctatcagaggatggtctagcatcctccaaattagaaagaatttctggaccactagaatgataaaaaaaaaaaaaaactagaaaggtataataagagaaattgtgaggcctcagcccatagatacctttaaggaaagaatagccattcttttctcagtttaggtattcacaggcttggcattcacagccagtgagggctggaccaagagctctctggagttctcttcttccttttatgatgctggtattttaagaagaaggtacactgagcagccaggagctataatttctggctctccaccatgtttcctgctatagagggctagctttttaatatttccataacaacagactctgaccagataggtcaggaagtctagcccatggtttgtttgtttgtttgtttgtttttcagttggagttttgctcttgtcgcccaggctggagtgcagtggtgcgatttcagctcactgcatcctttgcctcctgggttcaagtgattttcctgcctcagtctcccgagtagctgggattacaggcacctgccaccatgcccggcttttttttttttttttttttttggtatttttagtagagatagcgtttcctcatgttggccaggctggtcttgaactcctgaactcagatgatctgcctgcctcagcctcccaaagtgttgggattacaggcgtgagccaccacgcctggccttagcccatgtttttaaatcagatcttatttactctgtgaacttatttggacaggagagctgcatcctacagaagaaaaaaggacaagagaagagttgggaagagaatgagaaaggcaaagatggaaagggaagcagggaaggcaggaggaagggaaaagaaaggaatagagaaagaaggacagaaagaaatggaaagtcagagactacttcaaaacagcagctaaatgtcttttttctctgtattaaaaatttccgtctgccaaaatgaaaaagcataattaccggccaaatacaaatccatttcctatatcgtttaaatgacatatctccaaggtacaaaacagcatgtctggttaaaggttgggtgatttgatccctctattactctatataaaacaaagaagctggagtttcattacgcttaaattgtctggcagtgggtgaagttaacttttattagaagctgttctttcatattatacagtgtagtcgaggatatattagctttgacgttttcttacatctcaatacactgcggagtgaatttactgtgagactaatttaaaagggagtttttcataggaggaaataatggtcagcatcagctgtgcttcaaattattagcagaatgaaaattcaggggaaaaagtatagacacataaagttgctagatattaataagaatgcgtcttttatttctgtttctgataatattctgtgtttcttaaagctccagtgtcttaaaactatattcaggaggaagattatattgttgaggaaatgttatagtgcctcctcaacaagattattttgtcttaaagaaagaaaaaaaaccatcagatcaaacagtatataaaatatatttgtagaggttcagctttagggaagaaatcctacaacttaagcctgaaaaaaaaaaaaacaatgcaaagatcattcatttgaccaatacacagtgaagtcataataaaacaaattcctagtatgtgaaatgaaatttcacgtataggattcatcactcataacaaaagtcttattacgctctgatatcagtagacattccctcacttttggtcaccttttctaataagatcacactggtcagctgacattttgaggcaccaaattaagcatctatttggtaagtgaatttggattctctttaaaccaataaagataaaaacacaccatatcagagtgataagcatattactttagcttcaataacttagaatgtaaatatatcacagagggatatttcagctactgaaataataaaatccagtcagtcaaatagtaaaaaatattgagaaccagcaacaggaagtattataaaaaaaagcactcaagggagacacatacaagaaaccccgtcagtctactcattcagtttcttatctgttctataggtttagcagtggaaatgtttgtgggttttttttttcttcgcatttatctttgtgcctgaatgagttcagtttcgcttagattaggacagaaatttcagaacagcaggttaatccatcctgtcttcatgggcagctgagcaaacagaccaatatcagtgtaaaattgtaattctggagattaatgttgtctttcctgtttgcgatgaatttgacctccttgcctttctttttttcctcccttcttttcagcgtctgtccagggtccctgggagagagccatctcgccaaacaaagtgccctactatatcaagtaagttggaagtatcacatttttaaaagagcatttattgtgactaacctgtatattcacaagtgagtttatttttaaaatgcgacattagcctggcctacaatacctgtgtcttttttttcctgaggaagcttggataaaaaacttattctaaaattaccattgtaaatttgctgatgcaatggggaacgacttttaagaaaagtttatttaatgcaggatatatggtgtgttttgtgacagagggggcggatttttcacaatagaaccaaaagctccagataattttattgatagtgggagtcaatctttgcgagaacaatttcttttatttaggggttttctcacatttcttcttccgtcaaagatagaagatttccgcagttatatgtacacaactgttttgggtgaatgaatactacatgtttccaaaaggcagaaagcagcagtcctcgactcgtagggcttagttgttcattcttgatacataacactcagtatttgtcacctaacaacagaaagatactgttttctggaaacatttgtgccagtcaaaagaatacgagtgcttggaagcaccttctgtagtattttgcatgaaatataaatgacaatacattgggtcaacgtggaagagagaggagagaggatattgagtgattacgataccttcacagtctctcatccattgtgcactagagtctaacttaaatttaactttgaattggaaacctcaacaacaattacaatttactgggttcataaaatagtcctcgataccaaccgaagtctttgaacttgcttctgccatgagtctgactaaaaatattagatgttttcccatttttttccgcctgccatcttttatcgaatctgtttttattctttcactgtccatcaattcttcttaattcggttctaaagcaataacagcagtcctagatcttcattactacagtcctcaagaaatttgattttatgcctctattttgttaactcagaaaaatgggagtgaaggtagtcttttgactctttcaggagaaatacatactttaggaaacggtttaccatttgtcttattacatttttccagatgaggtatctcttaacttgaaaattcttttttagtatgtttgattctgctttttagttttcatattttatgaatttaattttattattgttatatttaattcattagtcactcaaaactgtacattttaaatacctatttaaatcacatgctttattaaataatatattgctgtagacatgcactgtatattaccttacatccactgtatattttatggaacaattttcttcaaactctagacagtgatttcctacatcagtgtctttgtcctcacaaatttttatttccgactaagatgtttgagacctgctacttcttcaaccaattcataaagctctcacttttatccaattcctttatgagctgaaataaagactctttttctcctttcatagatgaggttttaggatcactggagaattcaagacacctttaagctattattctccaaatgactacttgtttggggctcactagaggtctcacatggattgctagggtctccccggtcccattgtcctttccctatatattcatcttctccctgatgttacttctactacaagagatcccagtacattgctgtgagggaatggaaatgaactccgtccaaaaaataataaagagacaaattccagaaaagctgtaattcccttctgtgtattagtctcttgctgtttctcagtggaattagagagcagctacatatcctatttgtccaatgctccttcatgtacctaaagaccatggtgatggtattgataagggcacagatctatgaataagaaaacttcaattttagtcctccagtctagtcttagaggctctgtcattaggcgactgtatggctttaggcaagtcacttaacctataaaaatcttggtttctttccttttttttttttttttttttttttttgagatggagtttcactctgttgcccaggctggagtgcagtggcccgatctcggctcactgcaacccctgcctcccgggttcaagcaattctttcgtcttagctcccgagtagctgagactacaggcacctgccaccatgcttggctaatttttgtatttttagtagagacgaggtttcaccatattggtcaggctcgtctcgaactcctgacctcaggtgatccacccgcctcggcctcccaaagtgctgggattacaggcttgagccaccatgcccagccaaaccttggtttctaatttataaaataaagagttggactagatgatatctaaaatcctttttagctctaagacgtaatgagcatgactcattcagttgtcctgtccaaacttaaaaaccgaagatctcagcttttgttcgataatatctttatttttaaaattcattattttaatgaacataatgtaaattcttactttaaaaaacaggaattttatttttccactgtttaattagctttagatatgccctatcaacccactccaatttcaccacacacctctttaaagagctcaaatcttggtatataatttaggattattatgcttcctggctcatgataagagagagagaacaataggcaggaaaatttgccaaaaggtgagtatggagaccttaaaagcctctgaaataatcagttccttgaaatgaggaaattacgtaatttctcaaaaatatctctgaaaccttatggagagcaattctctctacaattataatctctttgaaattagggatggtataatttctcaaatatgagtgtaaaatgttaaactgtaatatagggaaaacatacatgtttataaaatgaacattgtcagtaagcagatgattaatggcacttgtgtcttattagccattactattatctaaaatgttctatggaaaccaaattaatttgatgtacaaggttcggtggactttatgcacagcttaatgccgttcataatctgagatgccgtcttggtctaaaaagaacaaaaatacgtttacagtgacagtgcttcaaccagtcctcatttttcctcttttttatcttgtttgtcttgacttccagtcaagagtttttaccacagatgcccagctgcaaaaccaggtgtcttctctggctatgtttttaatgctttgtaactttttcttttcaatgctgggataaagggatcgcccacataacaagaggtttctataccagtggcacagttcctgttggttgttgaattgtgcactcattcttgagattttaagtcattaacatcttttgctctagtttgcaaatcaggcagtgtttatgcctgcatcctgacatcagcttttcatatgaggctaagaaccttgattttgatacttcaaactacgtgtttgtctagtttatttgtccacagcatacatcattgttacagttttcatattccctctcccttggggctcccttattcctgccagcatctctttcaggttatttgattacagctttcattgccactgaaaaaataatcaccaacaatgttcaacctgttacaactgccttttctactctctgccattttgtagttttttggcctactgtcaaactcatgaaaatttcaatataatagcctttaaccagctgctgcattctgttaggatttctttcacctttttatgttgcatgctcccatatgggtaaaccaaacagagccaagagctgggactctcttgctttcttaatgagttagaaaattgttcttctgtattctggactgtcaaaagaatttaggaatcccaaacatgcatgcaggatgttccagtatagatgtcataataaaagcataagaaatatcacactgggtcagaccaacagggcaactagcccggaactctgtcccagatgaagataccaatggttgttttgtcaggtaacctagtacattttaccttaaaaattcggatacatcatgaccacttcttaataatgcattggaaatcaactggcagtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaatgacatgatatcataggtcatttccagtactaacattttctgattttgtgaatgttgacttcgaaatagaaattgtttgtgatcattttccagagaagtgaaaatgaatcttcatattgcccttgaggattcttattgcaccatcaatcttatcgggatagaaaggacaaataatattaaatgtttcacttaactatttagcactattgatgataagaagtggatgcaacagagaatcagctgtctaatttgatctgtcagtctttgaggatgctggtgaatgattcggggtaattaaatttttgaaatcactgccaaaagcctgatgctctgacttttcaaaaggctttagtacacaaagataacccagaggtcaatcttctctgctgtgttttctcctctgccatttgatggtttcaaaggtcacgttacctgagtctcagtaagctctggaaccacaatgaaggaatagttggtaatacattattgatgatataatcatgaaaacaattcaggttaagatattaactgaaagagagtgaaaggggtgccatagtgttgtgcagagtactgagtctggttttggttttatagatcttgttgggagatgtagatgttgatatcatctgtgtctcataggttcatgaaaaaaaccctcacatccttttttgtagtttcataagctgatttgtatcaccttgactgaaataacagactccaggaggatagctgttgttatctctttttctagcatagtgcctcacagataacaggtacttggtaaatattggaatgaattcatgaacatatgtcagtaattctatgtgcttttcagtttgctgactcatttcaccttcaaaacaatcttgtagtatttgtgtgtcaatttagatttaccactcaaatccatctctcatgccctctagacatgaactttagtgttaggaagcatgccgagtgtttgatagagtttctcatagctcctacagtttggtgcttaagggacagtccttggcatggatgtatgaatggtacataccaaaacatgagttctagattccgttctatcttaatctaacaatatgataaggagtataacttagctcaacctcaatgagaaggttgaactagataatgcctgggaccactctcagctctagctttgtttcagtagaactagagtctgtttttcctaaatatcattcatgaggcttcttctggttttctagtggtcaatagagctttaaattgatcaactactgtttttcactgagcattgtggacaggacctactttttgggccagggatatagtagccactgagtcttaacagaaatgtcatcaatgatacatttttattttacagaaaaatgttgtaacattctatatggcatatgtcatgtggaaaggtggcaacatatatacatacacctatacatgtggcagctaaaatttaatgtgtgtatggggaaaataatcctgtattataatacacatggtatagcattccctgcctcattcgtggcacttttggaaatgtgagaatgagcatagaacatattcaagttggtttatccaaaagaagaggagtaaattatttcagctatttccccattttctttttctaactttcttaaacatgcactttcttacataatcacgtgttagaaaaaaaccagtagtcacatcaaataaatctgcatttgaaacaactgtatcatatcccaactctgttcgtttgagccatttgcttaacgtgacacccattctactttatgacacataaggaatattgcttaagaaatgttaattggctttccttttctcctctgaaactggattgaagtcttattgacctctattagatactgagtgttcaggtttttaggaaaacactcatagagatatagccccagtgtgagctgcatttttagaatattttctagaacccaaatatgtccctaatcaaagttagtttattttcattcttagcgttcccacgtaatttggggtatgtgtgaattcccaaacattcctgggcctctcctaggcttctctaattgcttcttattctgttcccctgggaagcagcatcctgttcccttcacaaaggtcagcagcaacagcccaggcaatgttttaaaataacttaataaccctgaactgcctctctcttctttgggataatttccttagagcattagtcctttgaacactgacctggttgcagaaaatgcccctttctcagtgggaaaactccaaatcccattcagtcttcccctccttccttccaggggatagggtgggggagtagggggtagggagagggtattaaatacttcaggaaaaatgttaacacggtaaaacacactctctctctctctctctctctctctctctctttctctctctctctctctctctctgtgtatgtattcttttttaaagaaatagactgtgagtgcattgtataaatcagtgctgtcacgttgcaaattttttaaaccgttgtacaagatagaaaaacagtatctctggatattgactctggaaagcttctaagagcaggtcctagatgagacttagctcactgtcggcattcggcaaatgatcacgttttctgtgataccattaactcctggggggatgaaactgaaaagcctcgctgctcttcctgaaactctcaactgcttttttctgtttttctttctcagcttatccacatccatcttggtccccaaagccattgcatgtcagatggtcagtgcaatgtgtaatttttaacttgcttctttgttgctttagaaggaatcgttttgttgttttctttccttttggtcactatttcttgttcatgagttttctgtaaacagtgtgtctcatagataagtccatgtaatctgctagacaggaagaaaagcaaagtttaatgtgtgcctactatgtgctaaatgacaaagtgtttcatctgtatcttcccatttaatccttgtaacactccacttattatccaataaagaaaaaaacggctatcagtcgggcgtggtggctcatgcctgtaatcccagcactttggcaggccaaggtgggtggatcacttgagctcagcagttcaagaccagcctgggcaacatggcgaaaccccatctctaccaaagatacaaaacagtagctgaatgtagtggcatgcacctgtggtcccagctactcaggaggctggggcaggggaatcccttgaaccagggaggcggaggttgcagtgagccgagatcacaccactgcactccagcctgggtgacagagtgagaccccatctcaaaataaataaataaataaaagttaaaaaaaaaaaaaaggaagaaacagctgagattcaaaaaagttggaggcttatccaagtcattctaataaaggggaggggggagaattgatacttaaaatcatcatgataagaaggatagacattagagattcagaagggcagaatgctgggtgaggggtggataatgagacattacttaatgggtacaaggtgcactactttggtgatggatacactaaaagcccaggttcaccactatgcaatacatccctgtaacaaaactgcacttgtacctcagaaatttatacgaataaaaataaataaatcaaataaaataatcatcatcatctcagctattgcttctagctgtttcaactttctaatgtttttgattgaaaactggccatttgtataaccaaatgtggccaatccaccactgtgaggctgccatcttgggcatcaccaaaactactctagtagtccttccctgcactgttaggtggattttccttggcgtatcttcgcaatcaagttgcagagacctaagttactctttgctgctttgggcaataaaggggaacaaaaaacaaaatgaaacaaaaacttggccagccctgatgtaagcactcttctacctccctgcaggctgagaaaacaaagtatttcttttttttttttttaatttttaaaatgtttgattctggtctaaatcaattaaaatgagatctccccccttcttttttctttttttcttctaaaaaaaaaaaacacaccaaaaaaccgagatacatgtgcagaacgtgcaggtttgttacataggtatatgtatgccatggtggtctgctgcacctaatgacccatcgtctaagttccctcccttcaacccccaaaccccaacaggccctggtgtgcattgtttccctctctgtgtccatgtgttcttaatgttcaactctcacttgtgagtgagaacatgcagcgtttggttttctgttcctgtgttagtttgctgaggatgatggcttccagtttcatgtccctgcaaaggacgtgatctcattcctttttatggctgcgtagtattccatggtttatatgtaccacattttctttatccagtctatcattgatgggcatttgggttggttccatgtctttgctattgtaaatagtgctgcaataaacatacatatgcatgtgtctttatagtagaatgatttatattcctttgggtgtatacccagtaatgggatggctgggccaaatggtatttctggttctagatccttgaggaattgccatactgttttccacaatggttgaactaatttacattcccatcaacagttcaaaagcgttcccatttctccacagcctagccagcatctgttgtttcctgactttttaataatcaccattctgactggtgtgagatggtatctcattgtggttttcatttgcatttctctgatgatcagtgatgttgagctttttttcatatgtttgttggccatgtaaatgtcttcttttgagaagtgtctgttcatatcctttgcccactttttgatagggttgtttgtctttttcttgtgaatatgtttaagttccttgtaaattctggatattagacctttgtcagatgggtagattgaaaaaatgttttcccattctgtaggttgcctattcactttgatgatagtttcttttgctgtgcagaagctctttagtttaattagattccatttctcaattttgtcttttgttgcagttgcttttggcgtttttgtcatgaagtactttgcccatgcctatgtcttaaatggtattgcctaggtttnnnnnnnnnnnnnnnnnnnnttacatttaagtctttaatccatcttgagttaatttttgtgtaagctgtaagggaggggtccagtttctgttttctgcatatggctagagagttttcccagcaccgtttactgaataggagatcctttccccattgcttgtttttgtcaggtttatcaaagatcagatgtttgtagatgtgtggtattatttctgaggtctttcatggataggaagaatcaatatcgtgaaaatggttatactgcccaaagtaatttatagattcaatgctattcccatcaaactaccatgaccttcttcacagaattaaaaaaaaaactgttttaaatttcatgtggaatcaaagaagaccccgtatagccaagacaattctaagcaaaaagaacaaagctagaggcatcacaccacctgaattcaaactatactacaaggctacagtaaccaaaacagcatggtactggtaccaaaacagacatatagaccaatggagcagaaaagcaaaggatttctaagtcatattccaccacctccatcagggcttccctaagatagagagtatggccaagaccatacttaataaatgtcatggaatgtgtttctcttcataccctcaattgtaagtctttctgaaaggtagcgcgtggtcaatttagatggacaagaagtgctctgcaggagcctttgcaacatttgtgcatgtccttgattttgacaccaccccccgccccccattccagaacagatcgtctcatccttcccttaagccagaggcctatggttctagctttactaggcaaatatatatggtctgtggctataagtcacaatttctcccaagccttgagctgggggaatactgagtctgcccatgtattacatgcagaacatttcatcttattgcagaatgatactttattcttattgcagaatgatattcattattgcagagtgatattctttagtctttattttttatcattataactacatggtgcaaaagaagtatttctcatactttttctcataatgactcaaaattacaaaagcaatctgggcaattaatatgtttttgaagataaataatggcttatgttttctgaagattaagaaaaatctctgtctgaatatagctgggcacagtgtctcaagcgtgtaatcccagcactttggggggtcaaagcagaaggaacacttaagcccaggagttcgaagccagcctgagcaacaaaatgatacctggtctctacaaaaaaaaaaaaaaaaaaatccttggcatggtggcatgtgcttgtggtcccaggcacacaggatgctgaggcaggaggattgcttgagcccagggggccgaaagttgaggctatagtgaaccgtgtttgtgccactgcactccagcttgggcaacacagcaagactctgtctctaggaataaaaaaaaaagaagaaagaaaagaaaaatctctatccgaaaaatgtaggcaccctgtgttaatatgtaaatacaagtgctttatcaaataaaggctagattaattgttttttctcgctcttacttatatcaatactacaagaacttttctgccaaaaaaaaaaatcaaataatagaaaagaatgaatcctagatagagcaggaggggctgagcaggcacagcaaaagttcaaggtggaaatatctttatgcatccaattaaaagtaatttgtgtacattttactcatatatctatatgtacacatacatacatacacagacacacacacatatatatatatatatatggagagagagagagagagagagagaggacaacgaagaggaaactaaagagaataaagggtattaacagcaggtctgtgacttattccctggggggatgtgaagggaataaatgaccttaatagaccacttcataaacatgttaatgacctcccagaccttcttgtttatcttgttaatagtggttaactagaggaaagatacctgcaaatccctatctataaaatgattttagtagggtatacctggcctggctagatagcttattgtaaataaacctggaatgtttggatttatgagtcgtggctggctggagaatagggcatagctacatgaacgtttttctatttttgtaattgacagattataaaatggaaaacttttgagactgaaatgatttcctttcaatgtttctgtgtaaatttttaaaaacgtatctgttaatatgaaaccaaagcacatcataatgggaaataacatggatgttttggaaacgcatgtgtgattatttcaggttccccagggaaataatgttctatctgtgcccagcacttccctataattctttcagtcattaataaagattggtactagataagaatctgagatttgtgtgagtctgatgtgagatccaaatgttatacttacacaatttgtgtttattttagtttaaaaattatctttgccatgagcaagaggggaaaaaaaggaggatgagcgggcctacatatttttccttaacatcttgtcccaagttttaggaaatcacaagtctaagaaaaggccagggtcaggactaggaagtgatataacagttatacatgtctacctttaaaattatataagtaataattaatttttaaccttattttaagcagatcctagaaatagcaagagcctctataacgtcccagctaagaccccaagttttctttcttgtttaactcttgaaatattttgttaattttcagatcccttgtctcctcagttcagctgtaaactctctgacaacgcttgtgccttatgcatctttgcatcatccctagcatgtattatatatctcacatgtaaaaataataataaatacttgatcatttgttttgattttgatgattaagcactggaagctgagctatgatcccaataggtatgcttatttaaagaaaaatagatggcagtccaggcgtggtggctcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaccaagtgaagttcctggagattttaggtttttacaggtctttttctcatgcatttgaaagtaactagattgcaagacataaatgctgctctgggagaatgcattggtgaacccgtgagttagggtgaggaaatatgaagatccagagtgaacagggagaccagatagtagtgtggaagcactgcgtagataagaccagataaagtagcagtggaatcacaagaggtggttgaatcaggaatatggttagaacaatcacaggtcttgctgatgcattgaggtcaggaggacagaaagaggcaatccaggttctcctcggtttcagcaggaacaggtacttaaagaggaacaaatttggtagggaaaatcaagttttagtgttccattgcagtacatggtaaccatggctaataataatgtctcatatatttcaaaattgctaaaagaatagatttttaatgttctcaccgcaaaaaataaatgatatgttggtgaggtaatggatatgttaattagcttgatcaactctttctacaatatataccaagatcaaaacatcacatcgtatcccataaatatacaaactattatttgtcaattacaaataaatgaaataaataattttttaaagagatgtcttaaagggtggcttgaagagcttctgtgctccaataatacctgcccattagccatactttgcttccagcaacaacaggaaaacatttaatctaaacaaaaaaaaattgcttgtcaactagatagctactcttccgtgtagaaaccctagagctgcctgggtttagacatgtttaagtttgaggtacttattgggtatctagctgtgcagttcaaaatttggatctgaagctaggggaagacgtcaggacaagagctttaacttttgtaatcatcaatatatacatccttcttagagtcatggggtgggatgccatcatattgggatgagggaggaaaccctgggacttcacaatatcgagctagtttctgttttgcaaaaggcaaatgtattaatgaattcattacattaattaagcaaactatatttattgggggctattgtaccagctattgtaaattttatattttatattatatatatatatatataaaatgctcacaaaataaaggaactaagtcataaatatgcatatgatttacataaaggagctaaaataaggatctctgtttctgtttcaattctttattaaagatctatctaagactataaagacatatataacaaggtacaggaggtaaagagtatattcttaggcatctaaaaatttttcctatgcttttgaaatctgtgtgatttactttcttgaattggcctgtaatataggagtacaatatcattgcagagattaattagtgtgtttgtgaactgttctcaaatgctaaaatgaaagcataaaactataaaatggcatcattattccttaaagaagcatagtttccaagggtgtctctgatcattgtcacagcataaatgaccaatttcacccataattagccaagttagtaagaagttattttttactgggtatattttgtttaacctcagttatatttgtaaaagtagaaactgctacttgttactgctttcagaatttctcacaaatgctaaaatgctttttaattctaatgcacttaaatggtttgattctccttacctaagaaaaacatttatctaaagatatactcttgactgattcattcattgattcatttgtcaatagatgtttatttatcagaatatgtgcaccagatacattgctagatgtaaagggtacatttggtgagcaacatgcatgatacctccaaagtatagccagggaatagataatggaaatgacactaagaatgaatacatattaacacaaaaagagagagagagtcatgtgtcaaggcaatttagcaggagggaacttgtcaatacaagggattaaaaggacagcatgactagggctggaggaggtgaggagaaaactcaaaaagtcctctggctgatgcaaatgaattggatgaggagcctatgaatacaaacgtttgaaggttactgatgaaagccaggtgagagaagatgggatttggaccaagatgatgatagtttggatatggtgagaaaggcatagatttgagagatttttaggaggtaaaaatccttaagatttgaggatagatatcataggaggaagggcgcaaagagaaagcaaaacatgtcaaggaatcacacctagatttctgggcaatgcacagttggtaattctttacagtgagttagggaactctaaagaaagatcagatttagggtggcaatttgattgtaaatgtttggatttcaaatgattggtgacatccaaaaagcactgtaaatagacagatagtgtgcacctaaagaaagaaggaggcgcatctgggttggagtcactaatttacatattacttgtatatagctagtaactgaaaccatgagtgtgaatgagattctgatgctaaattctggaaggtcactttttaaagtgttttgctttttgaagtacaggtgcaatactaaaaataaaaaagactaatttttaaaaattaaattaaaatgaaaagcctggaaagataaacaccaaagttatgatactagttgtagtatgggagagggggcatcagagaggatcggaatttcatcttgaatggtgtattttatttcaaaagaagctttgagcaaagataaaatgttaattctgagcattagaaggaacacatttgtttttttgtactgtggatctttttgtatttcctagaactcttaatctaaaacaaatattgcaaaatatatcactgtaaacaactggttggtcactagctttttaaatactttgtagcaacttggttgcttgtcagaggtcttctttgagtgaagtctttaatttatagttctttatacttgatcagcataattgcaccaaactgttacttaatctgaaaaatagctgtttcctagagccctacttaatactgaaaacctactgtgtttgtattgcaattgcatttttttttttacttttccccctgcttttcagtttgtataatttctgttaccctatattcaagttcactggttctttccttgtctttgttgaatctacagatgagcccatctaaggtatttttcttttctgttactgcttttaatttctagcatttccatttgattcacttatagtttccagctctatactgaaatatactgaaatatagagctggaaactataagagtgaatcaaatctaatcttgcatattgtcttctaatcttacatattttctatctaatcttgcatattgtctttcttttccctcaagagtctttaaaatattaattatggttattttaaatttcctgtctgatagttccaacaactgttacatatctaagtctggttctgattcttgctttgtctccttagactgtgatttttcttgcttaggcatgctttgtatctcaggggtaaaagtcaggcatcttagatagcgtaatagatactgaggtaaataaacctttgacatggtaatttatcttaatctgactgggaattgggctgtgtttgatgttggtagttgctttggttgtcattgttgagttttgttgctgctgtggccaccagagacttcaaattcctctggtaactttgtttcctcattggaagcttgttagtgtagtggttgagtgtcgggcagaggcattctctaatgtttgaattaatacacagttggcctgggtcttggggatgtggtctttacaattatttctttcccttcctccagaggtagagtaacttcaacctcccattcccttcctggagctgcagtggatatccaccagtgttctcagtctatggccccaaggccctttctcctgcataaggctgaaaaacaacaacaacaacaaacaaacaaaaaaaaacaaacaaaaaaagaacaaaacaaaaccacacatagatgagatctggtgttcccttcccctaaaatgcagtggtatttcctcagtgcctgatatggtttggttctgtgtctccacccaaatgtcatgtcaaattgtaatccccacatgttggaggaggggcctgatgggaggtgaatgaatcatgggggcagatttctccgttgctgtacttgtgatagtgagtgagttctcaagagatctagttatttgagagtatgtaggactttccccttcactgtgtctatcctgctgctgtgtgaagatgtgcttgcttcccctttgccttctgccatgattttaagcttcctgagggctccccagccatgcctcctatacagcctgcagaactgtgagtcaattaaacctctttgctttataaactacccagtcacgggtagttctttatagcaatgtgatgtcttttcctctgaagagaagggtataagcagattcatggtgactagctactgtgacccttccccaatcagcaacacagagggtgttggggaggctttctccagattcttcgcatcctccttgtgaaggcaaggtacagttcctgaaggaagaagcttgcaaaaggttgggactccacctatggcagtagcccccaggatcttcacactctcaggctagctcccacatgtcccccaacaatttaatctccctactagtttatatggcatctgctccagggatccaaatgctcaggcactgcttctggctaaaggccaatctctctccagatttcaggttgttctataatgtcatttctctgatggactgatgaaaagtcattaatttatctgtccagcagttttcttgctacaagtatgggagcaacctctttgcagctctccatctccatctccaagttgaaactggaagtctgagcaatacattttagaaattaatatttgtaagttttccgtgtcataacaaaaataataaatgttcactgtggaaaacatagaaaaagattaaaaatatttaagtgcccatcaccacctagacaactgcaatgaacatgttggtaatgtcttcttccagttttttaaaatctgctgataaaatacaaaagatattgtttatataactttgtatcctaccttttcttgagcaatgcaagtttaaacctaaatacgaagatactctaacttcctactttacatttttgacggcagatgtcagctgtcttcccaagtgcagtacccttggcttaatatcaggtagacaaataaggccaccacaaattcacctttcacctcaataacacaggtaatttgatagttctacagaccctataatattacttgactgaagacccagaatacaagtctttcaaggattactctagaaactatataaagtattggtatcatctcccttcatcatatcttgccaaatccaacaggtttggaacttctgtaggaagatttttgtaacatgaaaaatgcgtgttgcaccttccatatccagcaaatacaccatcggttttttgttggctgcaccaatgacataaaatgatttcactgaatagggggtgacccagaatggaaatgtagagcatcgaaaataaaatcaaccgacgcagtctttgcagcaaaccatgtggaaacaaatttaaatatggaacatactctttccaactcatcttcagatgttgctttaaaatttgtgcaggtgaaaaaaaaatctttattttaaggtaactcaatcttttaccattggagagaatagaattatttttgtttcctcttgtatattcccagttgtttaaatgttctctggttcccttgtgtggacacataaatccaaatatatctaatatcaaggtatttaccatatgcagcactttttccctcagatagttattttttgaaatattcaaatagcttacctgtatcatcccccccatcctttttttttttttttttttttttttaagacggagtcttcctctgtcaccaggctggagtgcagtggtgcgatctcggctcactgcaacctccacctcccaggttcaagcgattctcctgcctcagcctcccaagtagctgggactacagttgcatgccaccatacccagctaatttttgtatttttagtagagacagggtttcaccaatttggccaggatggtcttgatctcttgacctcatgatccacccacctcagcgtcccaaagtgctgggattacaggcgtgagccatcacacccagcctaccctattttctaaacgaacaattagttgacttttcttcagttcttactcagaaatatctgaccctaggttccaacttttgttttgctctttgcagttagtttttatgtgtactgttagggagatgtgctttttttttaccttcaaatttaaaagagagagttttcaattccttttaagtcaaaatacaactgttctactctaaagctttctttaaaaaaagaaaagtaccaaatcctcatccgtagtaattaattttgacagtgtaggctcagtagtgattcacaaacctgtattttgtgcatcagcattccttattattctaattaaagtggaacattgtgccctcgctaatcattaatgggttttcattttgtaaatgacatttgcagaagttaaaacagcgagttcatgtgaagtccacaggcaacggtgttgaaattagcatcaccatagcaacagtcttccatcattagcattcagggcaacaggaggtgttttgttgtgttttgtttcccaaaaaaagaaaaagaaaaaaacttcaaaggtaaagcctacagaaactctctcagaagatatttatgttccttgtgtgtatgtgtactgtactagacctctaagtctacatagaattttttttaaaaattgcaatgtggatcatctcctttccagatttgtgttttgcctagtatactagctaaatttcatgatctttctccagctgtacacgtctgacctgctgagcagcatttactcattgccaacctgctgctcaccaatagggtttcctacgtggatgaagagagtctgtattcatgaaaatatttggttcaatctaaaagtattatgtgtattcatgagtttttaatttaattcatggaaaatagatttatgctgttagatcctctggtgaactcatttagtcatgttgtagatataggtcaatgattattctcattcatgtttagacggaattaaagaggagtcaaatagagaacaatattatcttaactgagtctctggcagtggtattaccactattactctgtatgtgtgtgtgtgtatgtgtgtgtgtgtgtgtgtgtatgtgtgtgtgtgtgtgtgtttgaattctaatattctgggaaactttaaaagtggcatatctagcacttatgtttttctcagtactaaaatgcataaaagagcaccatattgacctaccagctgcttctaaatcacaccagtagtaggtaattatgaaattcaaatgaagtttaattttcatttattatacaaaaatgtcatagctcaaacccagaagtgttacccccaagcttggatatagacaggtatgtgtgtacattttacttttcaagatgaatcatagcagtcttctccattacatgtaaggactagaagttgtacattccactcaggtacctaaaggcaagcctgtgctagcccacactaacaaagcaaaatgaagcaaaggatctatctggctttcaatcagggatgcatctatgctaccatcagctctgtcacataataaatgagtctatagataacttgaactactcagccaatgggctgtaacccagtgattctgtggtattgaaaggcagcaacccccagaagccacatgtctcagtgtgcactccaggactgtaggcccatagaacttgtatgtatgcacacatgcatatgcattccccacttttctaatggcgatccaatctaggcctaatccacagctagtccagaaaagaacttttttaggttttctgtctgccatcactttgttgagaggcagtacaagccaagcaggtgtctgtatttataatatgcacaatgttaggataactcaaactcataagggaaagattaatggctgactactatgaaaaccgcttctagccttgtgataccagcacctactatcttcctttttctcttatatgatgaaaagatttcaatgttggcttttcattctgatagaatgtgcaagccaaaatctaaataaagtccagtggcaatgatccccttaaacattatatctttcttctcgatatgctgatgttttcccttataaaaatctatataagtttcaagatttatatgacagacaaaccacacaaacaggaggtccctcacattcactactagtcacttgctctatcactctgggaatagcggtcttcagattgcatctctactctacctcttgctcttttcaacccctctcctcttttttagaccatacagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccactcatctgcctttaggtagggttttaaaagatgcctagaaaatagttctgtgctagaaatcagagactcttgacctactgtaaagggagcagtaagcacgtttcctcaggagaatctttctacatactgcagattcccataaaaatctttgtgacaaaattgcctttactgaaaccatcatccattggattaaaaaatagcttaccattagctttttgaaaatagaaaacgttgagccttttcaatgatactttcaatagtttttcacaactatgagtcctcaagctatcagtcttatttttagataccatacttataagatagttatagaatttatagagtatggtttaaaagactattcaattatagagcaatcattcagtttattcccatggcagaagtaaatggaaaccactccagatcaacaagaatctactctcttctgattcagaaaagagatttcctatcttttcatgaataatccatgttcaatgtttaacacctcaggaagattttcttaatagcttcttctggtcataaatccttggtctgtcatcagggacatattgaagagttagttaccaaagttcttaatgtctcccattgtaaaaaaaaaaaaaaaaaaaagtcactttttggattgtttctttcatagagtccatgcttctgtacgcttaatactttagcttttgacttcaagctttaggtaatgcaaatgaagctattacatcaccaaagttaaatttttcttgtaagtatattctcaacattcacaattgagagctgcctcttctttggctggtataaggttttaatttattgtagcactttcaccctagaatggcaaaaaatgttgaaatcaattccatatatcaccaatacaaagtactaagtcaaggccgggtgtggtggctacgcctgtaatgcaagcactttgggaggccaaggcgggcagatcacttgatgtcaggagttcgagaccagcctgaccaacatggtgaaaccccatctctactaaaaatacaaacattagccaggcgttcatagcgagcgcttgtaatcccagctacttgggaggctgaggcaggagaatcgcttggacttgggaggtggaggttgcagtgagccaagatcatgccattgcactctagcctgggtgacagagcgagtctcaacaaacaaacaaacaaaaatattgaattgtacaccttaaatgggcgaatcgtatggtatgtatactaaatgtcaataaagctgttatatgaaaaaaaaatgctaacacacacattctgaaagtatattaaaagcaaacctacggccgggcgcggtggctcacacctgtaatcccagcactttgtgaggccgaggtgggcggatcacaaggtcgggagatcgagatcatcctggctaacacggtgaaacccagtctctactaaaaatacaaaaaattagccaggtgtggtggtggacgcctgtagtcccagatactcgggaggctgaggcaggagaatggcgtgaacccggggctggagcttgcagtgagccgagatcgcgctactgcactacagcctgggcaacagagtgagactccatctcaaaagaaaaaataaaaataaaaaagcaaacctacaatgtctcttacaaacacaggcaactattcaattccgagtttacactactgaaacacacatgaatatgacactaagagaatcacgtggatctgcactcttcaatcaacactacgtctctgagcacaagaattttacatctgatttccatttggggaaatagattcagaatgccataaaccagatacttcttgccttcctttagtggtcatttctgccattatcatttaagggaatggatctccttctcccaaaactgttaccctaagattacaagcttgtcctttaacttatctctgaaagcacacctctataacgggtcatcagtattcagtcagctaattagactgcagaagtacgtttactcaaatgtgaggagataaaattgtgaaatgtaagaggaagaaagaatgtcaaagataatccaacccaaactcttcatcttacagataggaaaatggaagtccaaaaggggaaagtaattttagtaacatggctaaactggtctagaaaaccagatcttctgatacctgatcccatggtctttctaatgccatggatgttcgggtagaggatatattcaggtagataacttatagatagccccatgtgtttgtatagcactttatcgaacactttcacctctattatcacacttgattcttacaatatcccatggaatgtttgagtatcatatatgattattcttattcccacagacttggaaactgaggctttgagatgtctggatctatcttagatcatttgctatggactagaatctgggactaagttgcttttgtctaagctgtgtgtttgttctgttgtgccgtattgttaattcatttctgttggtaaacaacacaaaggaaaaacttctataattatgtttctttttcatcctcaggtcatctatcctactttttatctaagctttggaaaatattatgtgctttccttttttttgtattttctttttgtagagatggcagcagggggtagtctcaccatgttgcccaggctgacctcgaactccttggctcaagcgatcctcctgccttggcatcccaaagtgctgggattacaggcgtgagccaccacacctggcctattatgtcctttctttagcttgctcgtttaaccatttgtttggcagggggagtcagaactgtgttttacttagtcgattaactgataggacaatttaatatctaccctgcactggcagtaacccccatagccccgctctgtgtctcattctgtgccctgaacaaccttgtcttaaaaacattttaaaagcagcaagtatggggagatttcttatctccatataatacagaagcaagtgtagagtatggctacggaaaacaaccagcaggtgaggctgtgacataacaattttaacccaagcctcactgctacattgaggtatccttgttcaataaatagatcagaaaatatggtgtagtttttccctaacgctgtctaaacagcaacaacaaaaaatcattacccatagtatttcagtaatgtgttgtattgaatgcattgttttcgagggcgttttcaaaaaataagttgattgaatctcttttttttgcttgaagaatgacccacattcagaaagtatacagatgaaacatgttcagctcaatgcaattatcacaaaatgaatacacctatgttcgccatctaggacagtaaataaaacattatcagtagccctaaaccagattacacacacacacacacacacacacacacacacacacacacactaaaccagactacacacacacacacacacacacacacacaccgggttgggggagtggtgagagagagagagagaaagcgaatattatgttaacagttggggagtctaagtgaatggtttatgggtgttcttttaacatttcaattggtttaaaattttcaaaatgaaaagcttgaggagaaacatagaatataaccactacctcagaaatcaccaccctacctcacccacattccctctcccaatcactattcctccctcatcttaaaggtaactgctactctgccttataacactatggttgagttttgcctgtttatttgaactctataaaaatggaattgtacagtatataaccttttgtatctaggactcaacattgtgtttatgagattaactcatgttgttgcatgaatctgtcatacattttcattgcaatttgatatcccatttaaaatgtatactataatttatccattctattgttggggaacattttggttctttccagtttgaagacattatgaataaggcctcctatgaacattctttaatgcgttttttggcacacacgtgtgtacaactgtgtttggtatatactttgcagtaaaattgcctatgttgagggtaggcatatgctgagctttagtagatactcctggttttccaaagtggttgtaccagtttacaccatcattagcagtatatgaaagttctagtagctccacatctcaacaatacttgatacttgttagtctttaaaattttcgccattgcagtgagtgtgtgagtagaatctcattgttattttaatttgcaattgtctgattacttatgaggttgaatatttttacgtgtatttattgaccattttggatatcctgttgtgtgaagtatctattcagtctcttgcctattttttttattgattcatccttctttttcttattgatctgtaggagttttttttacatattctagtttgtagccctttgtaaattgtatgtgttgcaaatatcttctcccattttatagctttccttttaattaaattgtttttttgattgatagttcttaactttaatatagtccaatatgtaaatttttccttagggttaattcttttgtgtcctctttaagaaatctttcctaatacaagataatgaatgtatcctcttttattatcttctagaaacttactattttttaacttttccatttagatatatagtacacctggaattgaccttttgtgtaatatgtgagatagagattgagttttatttttcataatatggatatctagttggcccagtacttgatgctaaacattcatttagaattcatttgatagtatttcctttagagttattgcatctgtgtttattagttatattggtctgccattcttgtcaaggtttggtatgtggattattgctggtttcataaaggcaagtagggaagcattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatgactgtctcacccctaaggcaatttctgtattggatgagaggatataattcattaacctttaggtcacttgtgaatctaatgttttgatattttcggaattaatcagaagggaactgacagcatgacctgaatctgtcctatatttatgtaaacatcctgtgtgatgcacctcattctttgtgcagttgtatgcatttttgaatgttaaatttgattttagggcaaacgcttttttaaaaaaattttaaaataaactttattaaataaaaatttacacacagtaaactgcctccatttaaagtggttcagcgatttttggcagatgtgtacttgtgaaaccaccactgcactccaatgacagaacgttcttactcccccaaaagcctccttgtgcccctttgcaggtcatttttcctttcacccctgattctaggcaaccactgatcgtctttcggggggctgtgtattactttgcattttcaagaattttctataaatagaatcatacagtatttttgtatgtatctggtctcttatattcagcataatgattttgtgtccagcttgaggatattatgaataagactgctaaaaattgtatacttgtttttctaaataccccttataaaatcttacttttgagaagcatattactaaaataacttcccaggttatatgtgtatttgttctttctgttcatttcagcattatcttattaacaagcaactggaggacatgcaccaaggataaattgactaggtgctaactgaatttgtgagaaaggcctagtttctaacgttctttcttgggagcagatgtgtaacagctacttttgctgtataacagaccaaccccaaaacttactggcttaacactgaggtcagcaaacattttctgtaaaggacaacatagtaaacactataggctttgtggagcactttgcatctttgttgcacattctttttctttttacaactctaaaaatgtagtcatacttagctgagaggctgtacagaagcaggccatagaccaaatttgaacaatagttcataaactctataacacaatggccagccatttacttagctcactatttgatgggtggattgggccatttatgtggtgtgaccagttgtactactgtttgccaggcatgcttatgcatctgtagtcagctggcagctggataagctatcgtgacctgactcatatgtctgatggttgacaggctgtcatctaggaacagatgcaactaggtttgtgtgtatctcatcatccaacatgctagttcaggctagttcacatggaaacttctcaggtttctgcttgtgtcatgtttggtagtgtccattagccgaagcaagtcatgtcatagggccatcccagatgtaaggagtggggaaagactccacctgttggtgggaagagatacaaaggcacactgcaagagctggacaccaaggagagggctagaacttttggccatgttgcaagatatcacaaaatattcaagaaaagttacaggaaggttcctctgtggactaaattctcttctgaatttagatgtaggtaaaatggagtgtgctgttaaaattcatgctttgtgagtaatcattgctaggctaaactgtttgtggcttcacagccaatggtagacatacagcatccataatctagtgcttttaaaaatataagaaatactgattacaaacatagttaaccacttattagtactgggaatttaatgaaagctgctgtgattaaatactgaaaaaagaaagattgtgggtttccttctggtaactttcaaagctggtcactcttttgaaaggaattttattcttaaagctgttatttttactcataatatgcttaatacccccatggctgcagactgtctaaaatgttcctacaattatatgagaatacttttaaaaatcatgataattatcagtcttcatggacacttattcagattaatttccccaagcacttaataggatgaatttataagcattaaatagaatggggaccatccagccctaaaatgtgaccattctgtcaggcacacacttgccaatttgttggcgtggacctgagcacactagcaaggactttgaattaggtctcactgcaagatggaagcagaagggcatttctcagtttatgttttgaagtgttttgttcagacaggcaacgtgcagttgtgtatagtagtgtgagctacctgttactccccttaacaatacttttagcagcaatgtttttcctcctgcaatgtgacaatatcaccatgccatttggaagaaaacaaaaaggctgagtgattcctggtatactcccaaacagccacccaaacgaacagctggcagagaagacaccccctaaaacttggagcagattctcagcccctgcagcatctcatgtggttagaacttcagacttgatgaacgcctccccaacttgctccccctcctgaatcttttaatcctcctccagtctcttgtaatgttccagcccttaccagggaataagactgcaaactgtcttccgtcaacttctttccaaatcctagtctagagaaattataatgatgcatgattgtccagtgggcatgtatagtttgtccatttctttatgtagtaaagcctgtagctttcatcttttttgccaatccactataaaaattaattttatatgtcatcctggtacacacacacacgcacacacgcatctatatctgtaaatctttttctgtctattcatgcttgtatgattgaaagaaaagtttcacaaaacattacttacccataccaaatagtacactttcatattttctttttttttttttaatttcaacttctattttagatacaggaggtacatgtacaggtttgttacatgggaacattgcatgatgctaaggtgtggggctcatgacctgttacccagattgtgagcatagtacccaataggtagttttataacccattttccccactccaacctctacactgtcatattttctattcttttctgtttcattaagaacaatactggtaatgatccactatatagatttcatgacgtactaagggttcatgacctgcagtttgaaaaacactgtagttagttttatctccacctcaggccaggtcatcagaaagctgcattcttagaccactttgccttggcccccataagattgcctcaactcaggtgtacctcggcatcatgttcctggcttatgtcgaggggcactgaaaactgctgaagggatttttctgaaagtcgacaccatgcagtgtctcccaccttagatcccatgcagatctgtttattcaatctaagtcattccagacttggattttcctttgtttcacttacactctttcctccttatcaataatccaaataataaaatcgatcatatttccttttatattttttcttttgctttgacatctacaaaggccacaaccaaattatacccaccttttaaaacacttttttactgaaatatattaggcatgtagaaaataagggagatgctggttaaaggatatgaaacttcggttaggaggaataagttcaagagctctattgtacaccatggtgactataggtaatgaaaatctagtatagtcttgaaaattgctaagagagtagatttaagtattatcaccataagaaatgataagtatatgaggtaatgcatatgttacttagcttggtttagccattccacagtgtatacatatttcaaaacatgttatacatgataaagatatacaatttttatttgtcaattaaaaaaaaagaaaaaatggcttaaacttatacagttcagtgaattttcacaatctgaacacactcatttaaccagcatccaaataaagaaacagaacattaccaacctttagaaggccctttgtgtgcccttctgatagttacctgtcctccaagggtaaccacaatcttgattttgaacaccattaaatattctggcctgttcttgtcctttatataaatgaaattgcacagcatgtactcttttgtgtctgacttctttaaacctggattcatccatgctgttgtatgaagtggtggattgttcattctaattgctatgtaatatcccattgtgtcaatatcctgcagtatattatatactctactgtggatgggcatttggtagaaaaaaatgatgttataaacattctaagacatgccatttgatgaatatatgtatgcattcctttgaggactatatcaaggggtagaatttctgggttatagggtctgtgtgtgttcagcttctgtacattcttccaaacagttttccaatgtggttgtaccagtttgcactcctactaacagagcatgagagttgtagttgctccacatcctttctaaccctgtgttgtttgtcttgctcattctggtgggtatgcatagcaaaattttcataaccacatcatgcactgtgatcttcaaagctgtgttctggctgggcatggtggctcacacctgtaatccctacactttgggaggccaaggtgggctgatcactagaggtcaggagttcgacaccagcccggccaacatggtgaaaccccgtctctaccaaaaatacaaaaaaattagccgggcgtggtggcaggcacctgtaatcccagctacttgggaggctgaggcacgagaattgcttgaagctgggaggcagagtttgcagtgagccgagatcgtgccactgctctccgacctgggtgacagagtgagactccgtctcaaaacaaaaaacaaaaaacaaatctgtgttctaaattttcctcgcttcttaaagttttatgctatttatatttccttagtgctgggttttattaatttttaagagttatacattgttataagttgccctaaagcctttacagaacaatgcacagtataaatatgtacatagtatatacacaaatatgaatccatgaatgcacagctaatagggccattatcaaaaatcctacacttttccttttcctctagccctcacattcaattggctcaaaagtagcattgattttattctataacctgtcatgaattcagcctctccacaaattcccagtgctcctttcttagttcagactttcatccactcttaactgggctgttgtcatcatctacttggcatacatttccattctgatccctaccctcttttccacccttgtttcttcccacctcaaatttaattctattttaaaaagaaagatattcaaaagtacaggtggtgccaattttttcttctctatccatcatatgcaaagaggcttccaattctttgtcgacctgtttctaagggatgagagtaggtcaagctgtgaggacttcaattcccacgtgaaggtcttgttcatattaactcaataatgtgctttgatgtcctaatggggaaagtagtattttctgccagttagccttcccaagatatcaaatccaatattggccaaatacatttttgaattcctaaaaagcctaaactgatgtcgtaacacagctgtatattaacataaaaactctgtaccttagtaaattattaatatgagcgattagctcacagagtcaatgtaagaaacttgtttcaactcttcatattctagcaaaaagaacacacacacacacacacacacacacacacacacacacaaaacctgatttaagaactaactaggtgattaaagcctacttagtttttaattgaagtgcatattctctaatcccaagaggccaaactaatcacctttccctttttgctgctttttttctctctatttctgtaattattataatctgtctgatactgtgtttagctatatatgggtctatcttctctcattagatcataagctccttaaggaaaaggccatatttccttgggatcccacttaaaaaaaaactggattacaatgttgaaatttttatatatttccatgtcattctccaaacactccccagtttttaccaaccataaagaaaaaatgagaagagtttaaatgataagcaaatacatatgtaagtgttccataaatacactatgtttgaagttatttaaagaacttaatataggataatatttaatagagaaacttagtctagatagagcacataaaaaacattcttggaaatttgtggataaataaaagttccttgcatctgtattttcctttcatcttgaaaacatgccttgacaaaagtaagccagagctggagtacaagattcagacattggtagatcattaattggttaaactggattttatcttatttccccttttatggatccctgtctttgtgtggaattcctgccacatgctggctgttcaaggcttgccaccaggagactttctccatcaagctaggggatatttctccctcactgtcccccaccaaatcaatattcacttgctctctgactactccaggtttctgctgtctgagaatatgaacatggatataccttttaacatgcgtgaatactattcatattttaatctcggccccactgaatgatagcaaacgctgtgaattttatgcctatctcaggctacagctagtgccttatcttgcacacacacaaaaaaaatcttacttttcctacttgcttccttcttaagtgtaaaaagcaaaaagaggaaaggtgccttttgtaaactgctaaagagcagtttacagaagagcagtttactaaactcagacctctcattttccctcacacgacaatctaaaacagaatgttaaagtgaatttatttggttctgtatacctaactattcctgaacatactgagttctcttttaagaaatcatacctgcctgacaggctgctttgcatgaacacagcattccccagccttcaaattgctgtcagagccgttgtgtcattttgacccacaatatggcagtattatccacattctatagatgagttaacaaaagcttccaagtggttaagtgacttgcctgtaaagggttaagtgacccacctctaaggggtagaattggtctggacactctgcccctctatcttcatgcctttgctataatacacagctacgcttgctgaagattaaggaagctgcttttgataaagcgtgattcttgtagatattcatctcaggaaaaaaaaaaagaaaaacgctggtgtcttcatctgtagcatttgattattacattttccttatctgtttcaacttaggatgacttccttgttcgcttaattgactggtaattcctttgtttacttttttccaaatctcaagaagcaagtctagagtattaacaatggttacattagcatttaaaatttttttttgaaatttgagtatttcagaaaggggtaatttaggcaggcatgtatgtagaactttgcattttaattaaaaagactcaaaatgaaatgaacctctgacagtaacagatgactacttctaaaagctgcattactacttgatatatgctcagtattttcttgtgggtaagtcctacgacttgtttcaagaaaagtgacaggactaaaacaattaaaaaagacaaagctgctgttttttaatcatatgttcataaataaaactaggttgtgaattgtttccagagaagcaattgacaaagtatgagtaaatcactctaagaactaaagctgcgttgattttttttaatgttcaaccaaacatctatccttgtccaatgatgaattttctttgacaaataaatatttacaaagtatgaaatatagactctgtgcctttcctaaggccaaagcatactgtttaaactaaaatttaattttttttctcacctcaaatacaccaaaataagaacataactaaaaattaattctctcttgtagtagactgtccattaatcttttgttagataatattagcattgtgagtgtcaggtagaaagaaaaactgtaatttctagattgatcagaaaatgtgagtatttatggatttgaagaaaacaataaagtctgataaaatagaattttctgtaacctcccttatggagtcaagaaggaggaatctttcaacatcctcccattttgcagtgaaaagtcttcatgcagtaaatagtttgcttgggtagatcaaagggttaatttacttctgatttgagaagagacgcagacttccctgatttttttacaaaaatgtgttgtgtgggaggaaggtagaggcctcagaatgaattcactaattggggttttcacctgctgtgagtctaatcgaatacaaagccttatttgtagctgaagaggaagagagattatgcagagtgtaagaatttctgcccagttttgaaattccgcttatttggcacaatcggtggggaaaggcagacaaatagttacaagtttgagctgttaaggtagaccaggaatgctgtagtcagatatacttgaaccacattaaccagtgatccatttttagcaggaggtggtgtgggtcatatacatgggttatcgctatagctggcaggctaataggtactccaaattctttcccatgaagcaaccgtcggcctgtgaggttaatgaagtatggctttattttagtgaagatgctaaaattcacatctttttagatgttcggcttgatataggtggctctgtgaagctttgagaaatcttattaaaagaaaactgtgtgagagtgaagcagagctcgactttatctggaacctgtctggtgaaatctctggtttagatggcagctggctcacagagaactttcctgagtctggcttactctgcctccctaaagagacagggcctggaaaaataggcttttgtgtgggtgtgaagtgctctgtgtctgaacttagaggcctcttcatttgctggttaatgtgacctggctggatattcttacatccagaagatgttggtttcagattgatactagggggattgttatatatatttcaattagtatgctgtaatatttgccctaaccagcaatgattcaccatacgccaacccatttgttagatgtctgagtcactgttcatggttagtacttgtactatgcaaagaggaatatggaattcttatgtctttattgtatacccaaatgctgacattttactatagaatatgtattcgagttaattgaagtgatacctatactctaaatgaatttttataaagtgatgcaggttatactaaaacttagggcgcactatagatagagagaagctgaaccctaggagttggtgaagtctctcgggaccatccctccaggcaagtacccagttcaaaccattccttgtctttgtcctttcctatgccactctgcatttttacacagctagcatcaggccaacattgaaaccacatgcaacccagaaaggaaaaagatgtgtttgtggaaggtaggaacagcctagtttcagctgttggcccttcacagcctccactagatgggctcattcgaacccaagacccttccaacagtacactgcaaatccatagctccaattcagacatcttccctctgagctcaagactcagatgtccaactgtctcttggatacctgcacttttacatcaccacctccaattcattatgttcaagactggattcatcatctctttcctaaccctcttctgccccctcctcctgaaattcctagctcggagaatgctactcatccaatctttgttgtcactcaaggacaatggtccttaaccttcactgcatattagaatcacttggagagtcttagaaatcctaatgtccaagaccaattaaattagaatctcagggtggtgagacccaaacatctaaatttattaacaatccctgcagtgattccaaagggcggccaagcttgaggactattgctttacttcttccctctcttccattcatacatccagtcagtcaagactcctgtagttggaaccttattgtatcatttctccacctcctctgccactgctgtaattcagatcctcctcatactgcaatctccttgtacctgatgtctgaatttcagactcttgtcttctgatcaagcccccataccattgcctgagtgatttttctaaaagacaaaccggacagagccacactcatgctttaattctttcttccttaaaaagctccctcatacctttcaggatacaagtcaaactccagattgtcacactaagccctttccagtttgcccatttctctaacccttatcttgacattctctccaaaagatcaagcagaccgttgaagctcttgtaaagaacaagctggttgcatcctttttaccctcacatctgctgttgtcaccatcataattgttgatatgcctttaccctcaaaaggccagaagctctttgtgggcctacagaggaggcttctctgaatatttatccaatgactgagtctcatctgctttttagccccagagtggggggatctgactttctcctctatcagtagtccccactcagcatcaagtctattgccccagagggtggctttggctggatgggtctcagtttggtcagggtcctgggagaaacagatggtacattcaaacggaacacttgaagagagtataatgaaaaggctatttacaaggctctaggcaggctaggagaaaaaaaaaaaaacaaggaatggtaaacttttgcccaaagggataaagggaggaatggtttgcgtaactggtggaatgctattgctgtaggaaaggactggccaacaagacttgtggctgcaggtcaaggaactcagcagctgccaggccagagatcagtaggagggaacctgaagaataaatacccaaacatcaccttcctcctgtcctttcctctccttctgtaggcctttcatcactgcctcccaattggctgaaagcaaaaggaagccaaacggcaggaaagcctgattgatgtccccacagaggtccaacctcctgggccacagagcagaatggagaaggacaaagaatagagatggatgggagaatggggaagcatcctgcacagtcccttaggtcagagatgcccttattctctaaagataccctcaaagtttaagtggttcaaagaccagagttttggctacgggaaaatgtactgggtcgccttctttgacctcatcccatttcatttcttctttatctctatttctagcaaatttactcttctctgctctgagccatcagtgagattgtctatgagtatactagaaaaaacacagacctttctcacaggaaaagaagccatgtctcttcatggcagcatagcagaatagctaagcgcatgagtcttcgagctggattccccaattccaatccttgcaccattctagacagtggtactgggaacaagtaggtcatggctgattctgaagtcaaaattttagctgaagtttgttctggtagcagagcttcaggctcttttcatgtccgtggttcatatcaaaacagtaataataataataataatataatcagaaggaggagaagaagaaacatctactataaacaaacaatatattatcatacatggcatcactacataatttacatatgacacgaaggtatatcaattatgttcttttccaaatgctttcctctaataagcaaaattcataatctgactgcaattgaacaacaaaacagtctctgtgatgcccgcgtcatttcttaatactttcagtatttaattataatatgacgtcaagatttgggaacaagtcttcaagtgcctataactccagtctaaaaaagaacttaaagatgtatttttgaggattgccatctgtcaatttttttaaaaagtctgaatagtgatttcttattccattcttttttcttgtcaacagattattcttagtagttttctaattggacactgagaaaagagacttaagcatttatagagaagcgtgtcagaactcctgaattttgagcaggtaatttaaaagtgtaaaacaaacaaacaaaaaacaggaaaggaagagagtgacaaatgtcttactatccaggtgttacaaatccttagtttatcgatttgtaatatttacaaatgtccatgctctgaggcttctgtcttttcgttgaaataaacataaacagtagttaagtgatttgccacactgacacagagattggtgtctctgatttactgcaaagggcactacttcctcattacaggacactaatccctcttccccaaggatcggagcagacctagaatatactattagaccaagggacaacttcagccaaagcaaatcttagtgtgcccccctcagaccgtaatagcagctgcctccacaactcactagcttaaaattgctaaagggcaacactaagtaatctcagtgtatgagccagaatgccagaagaagtgccatatttgcttaaaaatagcaataccgatcatacttacatgcacatatctttagtgataacatttacctttatatttggtttgttaaaggtaataaagaatcctggcattcccttttgcttttgtccagatactttatttttgcctcctttgccatgctatagcattagataaagcaaaacgggtgtgcttccacctaaaacattctagggggaaaaatgttgagcagaaaaggattatttcaaaagaagccggatatggtggcatgcacctgtcatcgcaggcacttggaggctgaagtgggaggattgcttgagcccaggagttgggagaccagcctgggcaacacagtgagacccccatcccttaagaaataaattttaaaaaggggaccacatttaaactgtagaccgaagtggaatgaatcaatcggaaaggagagtggaaagcaaatgtttgaaagaaaataaaaagaaaagcaagccaacaaaataaatggacaaagaagggcagtgaaaatatcactaacagtttatcgtaagatgctctttggatgctaatctaaggtgttatgtgaagtttgcagaaaattcttgtgctaatgaaggctttcttcttcttttgagtatttccaagcttgaaataattgtgtgtagttaacttctatcatcatactgcaaactctaaaattagaattatttgaactgttcaggccctgtaacttttccaataaaatattctattagaaacaagttccttctagatcttcctaaaagaatactaaaggaccaaaccgtgcaacagcactggtggtattgtcttaatttagagagtccataccagtgattctcaaacattagtatgctcagagtttctggttcaataggtctgggccgggcccagggaattttcatttctaagaagttcgcaggtgatactgataactgctgttcccagggtctacattttgagatccgctgttatgtcacaaatccaaatccaaagtctttttaacaatcccttttagcccaggatgagcctaacggcaatttcacgtccttatcgccggccactttaatcttcaactgaggaggaagggagagtgagaattatgtatataatttttttcttttattttttaaaaagaaaactccaagcccacactcttaattatctgggatgaggtcatttgcacctgggtcatttatttagacaacaagtagtcttgctagaggctttaaggaggtgttagcagagcggtgtgtggcttccaggttcctgggtctaccttaaatccccatcctctttctttctttctttctttctttctcttttctttttcctttccgttttgaaagccccaactgcccagtctctgggtgtccgggttcccaggtccctaggtgggggcggagcccgacacggccccgccccgtctgcccgcagcgccccctccccggcccgcccgcgccggctcctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaagggtaagtggatcgcggccccggccccgtctgatggccgcaatccgtgcacttgtggcgcgagcagggggcaagctgaggcggtcaaaacttggacaggcgcggcggctggacccggggcgccgggcggctgggcgtctaggaacctctcccgcgggttcccgcggcgcggctgcaggtgcgcccccggggtttctccccaggcgccgggctagtgggggaacctcttccctcggctttgggacgggctcggagagaaaaagctgatttctccccgtccccagaggggataacgcgttcctcacgcggggattggggccgggggagcttttcactcctttccaggctgccagtgtggacgtgagcaaggctggctgttcctaaatcgtcgctcttactcgtagaaggaaggggcgcacgcggcgctaccttccattgcactgcaagtgccaaaaggtcaactttctgcctgatttcttccgaggattccaactgacatttccctcgctgcattttctaccgtgctcattccatgccccaagacctgcagaaatcaggaaagaaagaacaaacaactaaagcccagaagtcaaagatttcagcggggggggatttttgtttgtttgggctttttttttttttttttttttttttttttttgcccttcgggattgggtgtggagtcatttctagggtgttctctcgcatttctccaggtgtctgtgctcatcttcaagcaaagtttgtcactcccaatcccagcacggcaataaaaagggcagaacactttgcttatattagtcaaatttgaagttaagtttgaagctttaaattgaaggggtttagttgctcgagggaggcataatattaattataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttagaactgatttgcaattgaagtgaaactaagactgcaaaggtgaaatctaaatctgttttcatagttctttgcatttgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttgaagtccattccagatggtggcttttcaccgtggttccctgtctctgtctgatcaggcttatcagctcagctaaatgtttttctgcagacctatagaagatgctacggtccttacaaatatcctggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaaagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcagggggcttgctttaaatttcacccgccaaagtagggcgcagagcctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaaggcagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatatttgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagttctgttttctttcccctcataacttgaattattttgaatgggtacagagcatacaaataagggtttgaaaacaccagtctttttacactggacaaatgtccagatgtctggtttgtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaaggttttattaaannnnnnnnnnnnnnnnnnnngaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaataatctaggatcttcaaaaatgtctttctatacatatatttttatagaagttgaatcattctgtcttataacttgcttttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcaccttcagagttaatatttccaatagttttgtaacaatcaaacattcgttgggcttttatccaagtggtgattcatcagataacatctcccatttattgcgggcctattgtatgttttccacatgggatgtgccagcaaccaaccctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccaccttggcctcccaaattgttaggattacaagcgtaagccacagcgcccagcctgcctacatccttgagatcccatataagattaactaccagcactgcctttccccctctccaaaattacagtgtttcagagtcgaaacataagcataaaatactgaaaagaaacttttcattgattttagtttttacttattagtttatatttttcttcttcaagaggtatccctttaggtccaaattgctctttgagctggatgaaatggtcggaagccttcaactacagtcagttggtgaaaggtatcttgaaagcagaaatggtgttgtggtctggcgtgtcaaatgtttaagaccacatctagccccctctcctaatcgaacctgaacctcatgtctctggtgaggtgctgaaaatatcaagatgttgctttttccctctgtacccccactccaggcatactctaccgtggaagctacagtggttcacagtatgcatggtaggttacacattcctagagacgcccacttctaaggagatttccattctctaatttgccaaagttcccaagcagcctgttcaacacatgtttatgttacctgccttgccctcaaaagcattcaggtgttcccctgcacccagggtttgaacacaataggattagaaggtgaaaacattttgttagaactgaaaaagtagcaagtatttactgatgaaaagctataatattgcttgagatattaccattggagctctctaatacattctgggtggttttctttttcattccttttccactgattttctacaatgaatttatattatttacagttagatgtttggtaaaaaagtttcttcgtcgatacccccattccatttcttacttagtgtctctatagctacaattcattaactaatgagaacttatgacagaaaagcagcagtagccacacacacacacacacacacacacacacacgccccacatatatgtagataatttatacttaaggaccctgattctcatggactttgtcaggtaactttaaactcaaagagatcatctcatgtatttttagtctgtatgtccagttgtgaaaaatgcagatgtagacattttagtggtagagaaaatagaacttttttgattaaaaaatagataaaaaacaatataagataattaattttagattatttccaacagatctaaaatggctttgcagaggaggtttccatcaagtgttagaaatattgtgtttccctcatttatcggctgtgtacctacacaaaaaattgagagaaaatattgccagagtcctacacaaacaaagcaagacatagtaaagaaataatttaaaggttcactatgatgactgaacagtcattaggaatttgagtccccagaaaattttttacatcacattaatggtttgacaaaagcattgtcttggattttcacagggaataaatcactaaaagcaactggaaatcagttttctttcagcatttgtctgtgactacccccaatagtcatagaatggtagtagagaatagtagtggagtaagtgggatataagagaccaagtgtctcatgtctattttttgtagaccttggtgctttatctttaaaatgtgaggatattggggctgggcacggtggctcacgcctgtaatcccagcactttgggaggtcgaggtgggcggatcacctgagtcaggagatcaagaccttcctggctaacatggtgaaaccccatctttactaaaaaaacaaaaaattagccaggtgtggtggcacatgcctgtaatcccagctactcaagaggccgaggctgaagaatcacttgaacccaggagtcggaggttgcaatgagctgagatcacgctgtagcactccctcctgggcaacaagagtgaaactccatctcaaaaaaaaaaaaaaaaaaaaaaagtaacgatattggacaagtgtctaagatttttgtttttcttttactttgggctgagggtggggcaggctgtttctaaacttgctgtgatcattatttttcaagaggtacctttcggctaactctgcagacaagtggatttctaaaaatgtaatcattcctatgttttaaaatgtacattctgagaaaacaaacaacaggagaagattatgccacccatccgtgtcttacaggctgagtgaggcaagctgttgtcaaatagagaggctcttgagatatttcccattagactcctctgggtcattcatttgttattgagagggtacattcttcgtcactccctagaagtaataatatgtttgattcatgaggtgagttttagatttctattagcatttttacaaatgtaatggaaagactgttccaataggttagcttggtgatttaaaactctgagctcttcaaggctccagaaagcatttacaacatcagtagatgttagatagtaatatgctctggaatttattttgaaatactaatataatattgatttacatgaagtgcaattatgtggttaaaagcctgtccttttctcacaatttatgtctaggtccctaagttcattactgaaattttaagaaaatattttttaaaaagctcaccctgcccccacacacataatatatgctgcttagagatacttttattggggtttttttttttttttttgacagcatcttgctctgtcacatagactggagtgcagtggcctgatcatggctcactgcagctttgaacacccaggctcaagtgaccctcccacctcagccttccaagtagctgggactatagccgtgtgccaccgtgtctggctaatctttttttaaattttttgtagagatggaggtcttaccatgttgcccagcctggtctcaaactcttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagtagttcatcaaaaaaactaaaaagctttcatgaggagttctgaggtgacatagataagataccagaaggccacccctgggttcaaaggaaactgatcttaaaggagaggaggtagcaattaaaacaaattatctgcagagaagtccaaacactaaggataagcttcccatgcatttgatgaaagtacttgcgacgtttacaggtgtttatgctcatgactctcaagactaaatacagacataccttggagattttgcaggttcagttccagaacacttcagtaaagcaaatatcacaataaagtaagtcacacaagtgttttggttttctagtacatataagttatgtttactctataatgtagtctagtaagtgtgcaacagcattatgtcttaaaaaacaatgtacataccttaatttaaaatactttattgttaaaaaagctaacgatcacctgagccttcagccagtaatgatccttttgctggtggagggtcttgcctcgatgttgatggctgcacagcatggtggttgctgaaggttggggtggctgtggcaatttcttaaaataagacaacaatgaagactgccactcagttgactcttccttttgtgaaagatttctctgtagaatgtgatactatctcatgaaaccacttactttgctcatccataagtagcaactccctatccattaaagtttgatcatgaaattgcagcaattcagccatatcttcacgccccacttgtgatttcaattttcttcctgtttccactacatctgcagttacatcctccactgaagtcttgaacccctgacagtcatccatgagggttggaatcaacgtcttccaaactcctggtaatgttgatattttgacgacctcctatcaatcacaaatgttcttaatggcatcaagaatcacttccagagattttttttttttttttttttgagacacagtcttgctatgttgtccaggctggagtgcagtggcgtgatctaggctcactgcaacctctgccttcctgggttcaagtgattcttctgcctcagcttcccgagtagctgggactacaggcgtgtgccactacgcccggctaatttttgtatttttagtagagacggggtttcaccattttggccaggctggtctcaaactcctgacctcatgatccacctgcctcggcctcccaaagtgctgggattacagccgtgagccaccacacctgacttccagagattttccatttactttgcccagatccatcagaggaatcactgtctatgtcaagctatagccttacaaaatatttctcaactaataagagttgaaagtcacaattttttcttaatccttgggctacagaatggatgttgtgtaagcgggcatgaaaacgtgaatctctttgtacatctccatccaagcttttgggtgacaaggtgcattgtcagtgagcagttatattttgaaaggaaacctattttgaacactaggtcttacagtgagcttgaaatattcagtaaaccatgccgtaaacagatacgctgtcatccaagctttgtttttccatttatacagcacaggcaaagtagatttcacataattccttttttttttttccttccaagacggagtcttgctctgtcacccaggctggagtgcagtggtacgatcttggctcactgcaacctccacctcccgggttcaagcaattctcctgcctcagcctcctgagtagctgggattacaggcgtctgccaccacacctggttaatttttgtatttttagtggagacggggtttcaccatgttggccaggctggtctccaactcctgacctcgtgatctgcccgcctcagcctcccaaagtgctgggattacaggcatgagccactgtgcccggcctgatttcacataattcttaagggccctgtgatttcagaatggtagatgagcattggcttcaacttagtcaccagctgcattaggccctactaagagatacagcctgtccattgaagctttgaaggcagtcattgatttctcctctagagctatgaaagtcctagatagtatcacctttaaatagaaggctgtttcatctatgttgaaaatctgttgttcgttgtagccaccttcatccatgaccttagcttcatctggaaaacttggctgcagcttctgcatcaatgcttgctgcttcatcttgcaccttaatgttatggatatggcttgtttccttaagcttcttgaagcaacctctactagcttccaacttttcttctgcagcttcctcatctcttttagccttcatagaattgaagggagttaaggttttgctctggattaggctttggcttaaagaaatgttgtggctagtttgatcttctattcagagcactcaaactttctccatatcaggaataaggctgttttactttcttatcatttgtgtgctcgcagggtagtacttttaatttccttcattaacttttcctttgcattcacaacttgactgtttggcatgagaggcctagctttcagtctgtctcatctttcaacatgctttcctcactaagctcaatcattaatagcttctgatgtaaagtgacagaggtatggctctttcttcccttgaacacttagaggccattgtagggttattaattaccctgattttaatattgttgtgtctcagaacaggaaggccagaggagagggaaagagatgggggaacagctggtcggtggagcagtcagaacacgtatgacgttgatcaattaagtttgccatcttatgtgggtgtggttagttgcaccccaaaacaatttcagtagtaacatcaacgattactgatcacgattcaccataatagatataaaaataatgacaaatttgaaatattgagggaattttcaaaacgagacacagacccaaagtgagcacatgctgnnnnnnnnnnnnnnnnnnnntgctgatggcctcgttcgttcattggtttcctgcttcagtaaacatttaagagcgtgccatgtattttcaaactttagggcaacaggctaaaaatatcaaggagaaaaacgtttactgagggtatagaagtttttatgatcttacttttattgaacattaaaacatggatgttcattctagaaattttagaaggtgaagtgcaaaaacaaaatgaaaatcacctcacatctcagtacccagaaatagccactatttacattttaaaagattgcttccggtcttctttcctatgcatttttatatagttgtttgagataatagaatgtttaaagtgttgtatcctactgtaatcataagtcttctcttattcttagttcctcagagatgttatttttcgctagttgcagtttattggggtaccacttttgtaaaaaaatatttcccaatttttgaaaattgtgacaaagaaaagtcaaattcgtgttgaatttatggaaggaaatctttaagaatctggaggcttattactaacaagcttctgagaagaaagccaagtaaagtgttataataccttctgtccaacaagctacttatgtataagtgatgttacagaataaagtcagtgtggtcaaaaacagacagtcagttatcagaaagttgataagtaacatttatcctatgaaaaatatagctatgaatttaaatcaatagttttctaccacaaatatcttaatggataaaatcttctttaccaaatatgtatgatgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcagttattaacagaaaaggaagattgcttcctgcctcttgggtgaggaagactcatgtataccatagatatggtcagtttacatttacagttttctgtgaggcattgatttttttcccccataaatatggagtacttagaatgttcaaaacctttctctgggtaatagaatgcacaaaagtataaggcatgatccctgttcattgcccaagctggcgtgactctggtcatgcagcggacttcatgatgtgatagaattccttgcctatgagagtgaaggagatggtaccaggtctacttgtggccggtggtggaacacttacattattctaagtcctttctgtctgtagaacccaaatgacaaccatattattttatcttctcttattgctagtggtatcgtttattaatgccaacgtatacccattttgcttttcaaggttactttagatgtcttaggttggaatgactgaaggcttatacattcaaatttatatatgacacacacacacacacacacacacacacacacacatatcttattgttgcctgctatctttctacctgttgtataagaaatcctttgaaaaaagcctatgtcagcttcacaaaagatgttactgtgttttgggggaaataaaattgggaagtaataaaacagttaataaatgttacaagaccgtgtacaccaacttaaataagattaaggtcaaacgtatggtaccttatataggtaggaagagcagtattaattagaataattagggagagttgtttggagagtggaaaaaaacattgttctaggaagaaattttgtaatactcaggtaaagtaaaatgtagggccaagatattccagatagtgtagcagcataaacaaaggtatgaaagactggcttgtttgcgagtcagtgaagacattgttctctgagaatctactccagatttttttttttttttttttttttttttttgctttttgagacagggtctcactttgtcgcccaggctggggtgcagtggtgcgaacatggctcactggtgccacaacctcctgggctcaagtgattctcctgcctcagccccccaggcagctgggactacaggcacacaccgccatacctggctaatttttgtatttttggtagagacagggttttgccatgttatccaggctgttctcaactcttgagctcaagccatctgcccatctcggcttcctaaagtgctgggattacaagaatgagccaccgcgcctggccactccagatttttaaaagggaaatctgattcagtgcccctggggtgaactaagtgccttaaattatagagtgagaaatttacattgcatttgattggcaatgggaaaaacattgttaaatcttcagaaaagagaaataatgaagtccgtcttctgtgttttggaataggaatttggtgggtgagtttaaggacagttagagaggggagagattatttcgttttgttttgaggtaattgacatgatgagggtcttaggatagcaatgggggaaggaaaagggaacgtgactccagaggtttttcttaacaaggtagaattgccagaaggtaatcacagattggacaggttttaaagaaaaagggagttatatgtcttcaaaatttgaaggcgtggtgacacagagaatggtgataccattgaggaaaagaggaaattgcaaactgagcggagcaacagggaatagatatgaatttgattgaattacatacttatgggtttatttacaatttctcttcttagaaaaatttatttttggtggctcatataaatgtatgtgcttccataccataagcatatatttctcattaatcctttcaaaaaccctgtaaaagatatttgtatctccattgtgcagatgaggctcagagaaaataggtaattttctcacattgcaaagcagggatttacgtgtacttttaactcctaaaccagcgatttagcccctcagctatactttcttcctgagaggggacagtggcattttgaagaggaaatactctaaagccatttgaaaaggggaaccgaagaaagagtttggtccacagcatgataaaaatattacttgcacttttattatactttataacaagaagtacggggcagagaaaggttcctaacttttactgagcaagtatatatccaagatacatctcctctttggagcttttgagatacactatctctcttagttttgcaacagccctaggaataggtactattactgttccctttaaaaatgaacaaaaaaaaaatgaagcttaggaaagttaaggttactagaccaagcttattgggagaccatagtgatgaagaggaagggctttagggtcaaatggatttgaattttacttcttaggcctttggtttccttatttataaaatgggattgaaataatgatatcacagttgaaggtaattatatgagaatttatgttatttattgcaaacatagggtaagcacctaataaatgataacctgagaatttatgttatttattgcaaacatagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttcgaattgggagcaattgggagcccttaagctgaatgagtagacttgaagtcccacttagaatgagcctttatatttttgttctgtggcttgctcagggaagggatacacacttggggagaaaaagacttggattctagttgatgtttttctcctagctgactagggaattcagaacaagttactaagagctttctagtccttagttctctcatttggaaaatgaaaattttaaattagagattctatttctaaggcaccatgtatttcattttcttaataaaaagtatatatattcccctaaagaatactcataagaaaaaggtagagttaaaatttcccaaattatttaattcctggttgcccagtaaccattaaatttctcagcagtcaggcaagaaccacattcccaccttgagacaagatttaggcctttccaaacttaccctcgggctctgttccaagtttatttgtaagtcagttgcatacaatttggaatgaaatgtgttataaatggtggttaggtccctaagtcacagaatcttagttaaccctcagagtgcctgatatactgcaccatgtaaatagaaagcagctgtatgtttctatgggagcaaaaaacttttgtaggaaaaatggtagaaactcgtactgcaggtgttgattattcagcaaacttctctagataaggaggactgggaacttcatcattattggtctagttacattcctggtcactccctcatcccattgactggtcagtttccctccctgtggtccttgtgcaagggtttctgcctcaccccataccctctgctccttgcccggtatcatggttcttctgagggtactactgcccattcacccttgtgctaattaggattacactgggtaaggaaagacatttgttctgtagcagagaagcggggaaggccatcagaggctttgagtgtcagaaagatttggtcttgaatgcaggctctgggatgcaaccgtagggaagttaccaaacatttgtgagcctcattttatctttaacaaagctgataatacagaactcagggccttgtaaggactcgatggtatcaggtacacacgacatttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttggattgaatcttcaaattggtaaagctttatatcaagcaactcccaaatgcagcatagttttgaggtgataaagaagagtcttttcaaggctgggcacaatagttcacgcctgtaatctcagcactttgggaggccaaggcaggcagatcacttgaggtcgggagttcgagaccagcctggccagcatggtgaaacctcatctctactaaaaatatgaaaattagctgggcgtggtggtgggcacctgtaataccagctacttgggaggctgaggcacaagcatcacttgaacccaggaggcagaggttgcagtgagccgagatcatgccactgcattccagcctgggcgagagaatgagactccgtctaaaaaaaataaaaataaaataaaaagagtattttcccggagtaccggtaatattggttccagattcaaatgtattgtccagatacacagagggtaaacaggaacgcttcaggcatcctttattaaaagcacctcagtctatgtcagagggccaggcagtccattatctaatgaaaatctcctaccattgatttattttatcataactgcagctgctaagtaattttgtttaaggaatgatttacatattagtgtcttcagcaggatctcatcattagcatctagtctccagaaaagttaacacataacagtgaaaagaaaacattctctatcacatgcttctgcatgcatgggcaatttgagtcataccacctgttcccctcttctgttatgctagagtatacaaaaagcagagatacgcatagtttactatgatcctagatgcttaaatatcttgaattgtgttctatcttggactcattattcatgcataaagactcaacagattctcttcttgcacctctcaaacagcaacatcaacaaaacccaaacaatgtatctttcctaatgaggtgaaagcatgcataccagcctaagacagaaatgttgcaaaaatgttttttgcaagaaggtcagtttgcttttcccatggtaactaaggttaatttctactgtggttaattttggcatccattttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactttcaaaacatatgattagttgaagttaccaaaactatttttttaaataacatttatcttaagagctataaataaagaggaaattttgcactagagatgaagttatgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctcacgtcatttctccaccgcaaggaggattgcgggggtggacgatgctccctatttagtcttctgcattttgttgcttacagttcaattaacatgtcagttagagatgacttttggttgcagttaataaaatatctgaccaattgtatcttaaacacagaggagttgatattttttgtagaacaagaagtctggaggcaggtagttgagagctatggaagagttccgtgatgtcatcagagacctgggccatggtttattctgctgtaccatttttaacgagtgactttggtcctgatggttccaagacgactgctgcttctcaggcaggaagaaagagaaaggacgttcagcctcagagtctctttgtctttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccaccttcctcttatgtatctgatcaggttcctcatcctccaccatcccccatgtgacgtctgatcaccctggcctgtgtcttcagcaaggttcctgttaagttttttttagctagaatcccccttacccccatgctttctcttagtagttttccatccaccaaaccccaccctgctccttggctatcaattcccacttgtccatgctgtattcagagttgagcccagttctatactgaggtctctttcccactattgcaatattcctgaataaaatctgtttttaccactttaccgtccatctctggtttttctttgacactcacataaccagagttttgtatgtgtgtgttgcttgacacatcacaaatacctgggatacgtgtactgattttttacagggtgaataatctttttgttttccccaatatcttagaaacctgaatctttaacccctgggcttagtacacagttaggcatataataggtgcttaagtaagcgtcaactgatgattttaaatgcagaagtaattgtcacttaatgaaatatagtcaggagactcatggattttggcctgtcttcctacctgttcttgtactgcaacagtaagtgtattaaggcaatatttttggcagcacaatcatttagtttgaatgcattagtaaaaggtggagtccaaagaattaatcgctggaaagttttgggaaaacccagtaacaactgtttccatagagtaatttgagtgacagccaggtaatagctacttattggagggactccacagtcagagccttgacagggacctgaaaaagagtgtaactgaagggtaaatgtaaaagcttttgggagaacaagggagtggtcaggctgaggcaaagatctgaaaagaaatgcctcctggggccaagctggtaatttgaatgactgaaggtgactgggtgggaactggggcaacctgaaaagcttctgttagggtaacagagcctccgttgcagctgactgttctatgagaatgtgagtctctattgtcaggtcttcaggttcttccagagaagcaagacaacgggaaatcaccagatttttaactaatggcgtatcattcaacaatttcaaaaaccattatgtgagcccaaactgaccaacgaatcaaacacacacacacacaaaaaaagagtctgcagactaaattcaaccagttggtgacctctggtctgtggttaccagagaagtaattgaaatggagttttgggagaaagatcatatgttgaaatcttgggagataagggcagagaaataagtaagccgagacggcggtaaggccaaggtagaaaaggtagcctttaggaaaattaagttaagactttttaaaacaggaaggggcaaaagatgaggttaaagcagatgaggaaatttactgttatttattttcatcattaaaatacgctttccacaaatttttcaactgtaagagagagtgataaattcaaaataggtaatgtcaaccatattatgaagagtatgtttttgcaatccaaaaaagctaaggcacaacattaaaaaaaaaatctgtgaatttggctttgcaaaggtataagaattaagtcacatctgatcatttttagagtcttaccttttataacaaagaggaaaatttaattaaactggctctgccctggcgaatctgggatgtgtgttcacttatgaagagagactgttaagattcgttaattaatgaggttgagaatagagttgaaggagattggggtaaatttataagtttgtgtcattctgagagttctgtaagtagctgagttacccatgttgtgactgagaaaaacaggagagagcagtgactgaaggttctgagccaaaggaagagaatagtattgtttattccagcagccagagtggcctgtgtgactgtaagtcgcctgtcaagagggagactgcaaggaaagtgcattgatttgatttggagtagttgtaactgcagcatgaagaatatgatatataaggatgataattgaggaacaatttaatggctgcataccttgctgaagttgaagttccttctggagatgaaggtggcaaaaaagaaagtgcttaggtagaagagctttttaaaatgagttaacagaaaacagcagactaaatatggaattgaggagtaggaaatgaaggaaatgaatttgaagatttactttctttcaggatgcagagctggtatgtaatccctctgtttccagtgccttctcccacttccaaatttcactgctcctcatgcgccctggtgtgtggtgcagcttcgagattgagcctccagccttctgtcaggatgaagcagcaggtggctgagatgctaggctccaagtgggggaggtgtttagggctctaaagactttcaaccagtccttgtattttcagccacatttcagtcttcagaggaacctggagcctttcatttctgagacttcttggctacataaactggcatgcgtcttgttagttcctcccactccctgccccaatctccttgtctccccaacatcattaattgagcttgggatttctctggtctcctaagttggttaccagcaggtcattttctaagccaccaaaatactggagctctgatctgttctcatctcctctcctgttttgttaattttcttttgggtaaatgccattttttattcctcttctatcaacctggtagagtttcagggataaagagagacaaatgagtctgctccatctgctgtgtttaactagaagtcccaacacccaaaatccttcacacgatgtgcagggctctgcagtgggcctccccctgcctacctgtcaggccttatctgtgcccactcttcctccttcctctctgagatttcagcaatattggccttctaaggattcttaaagccccaccttcttctctgcttcagagcttttttttttttttttttttaacatgtgctgacctattacgctgctgtgttcttacctggcacgctcccatcatccttcaagtctttgcttcaatgtcaccttctccaagaagcctctcggacctatgtttccctatgtatacagtctcatcacttcctgtgtgtttccttcaccattttaccacagtacatatgaatatttgtttgttagtttgtttgagacggagttttgctcttgttgcccaggctggagtgcaacggcacaatctcggctcactgcagcctccacctcccaggttcaagcgattctcctgcctcagcctcccaggtagtagctgggattacaggtgcctgccgccgcatccagctaattttttgtatttttagtagagacggggtttcgccatgttggcccaggtggtctcgaacttctgacctcaggtgatctgcctgccttggcctcccaaaggctgggattacaggcgcgagccaccgcacctggcctacatatgaatatttgattattatccatctccttcgctacactgcaaagtcaataaaggcagagatttattttggttaccagtgtattccatgtacttggcatggttcttggcttatagtacatgcacaataaatattgaaaggatagatgaaaggattatggatagatgaatgtcttttaagcagttataaaacagttctgcctaaagagtcttttttaatcagtagtattacttcaaatacatatttaaatacacatatgttataaatatataaaatatgtatttaaatatgtcatttgtactattttaaatgtatttaaaataatatatgttatatattaaaataatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctgcacctcctgggttcaagcaattatcctgcttcagcctcctgagtagctaggattacaggtgtgcacccaccatgcctggctaattgttgtgtgtttttagtagagacaggtttcaccgtgttagccagaatagtctcaatctcctgacctcgtgatccacctgcctcggcctcccaaagtgctgggattacaggcgtgagccaccacgcccaggctcatctctttttaagaatcgaaatcagacatcacatatgtgcatgagtagaagtgaatcaactcattgaaaaatgcttaatgcctaatattttctgtgtcagaatatattgtaaaagttaaaacagctaaatgaaacctgaagttaaagtaataccattgtaatatttgatactaacccagatttttaaaatgccttttaaaaaccacaaaagtttaaaaacagtaagattcatttatttattcaaatatttattaaaatccaactatatatgccaggcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtttactgagaaatgatgatttccaatttcatcccatgtccctacaaaggacatgaaactcatcccttttttatggctgcatagtattcccatggtgtatatgtgccacattttcttaatccagtctatcattgttggacatttgggttggttccaagtctttgctattgtgaataatgccacaatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcatcgccaagtcagtcctaagccaaaagaacaaagctggaggcattccctgctactttcttctggtatgcctgaatcactgtttgagaatggattggactttggtgcgtggaaaactggtagcagaaggcttattcactgcagtgggttgggggtaggctgaaaagatgtcagggaggattaactagaggcagaatgtgtcatagttagaagtatttagaagggaagaaagtttgaactctgatactgttccacactaatattcatgccctgaaagaatcagatcattcttgcctctcccacttggatctctagctactggaatttgccaattcttgatatgaacgctaagatttggatggagcttgtgacctcatttagaccatttgttctaaatgctgaatagaaccaggaaaataggaaaagagggtagaattggggtcataagagaggaatcgtcgttctttgaaagaagaaagatgataggaaactaggcacatgagttacgaggcagtggagaaggaggattagaaagggaaaaaaagaagagaaactttatgccaatatcttctacaagatgtttggctggcacaaaactaacactcaatacttttgcataagtaaaggaatgagagaaaatttgggattggatgcttatcccctggaaactgctacaggctggtgttaatgggaaagggatctgtatttgaccaaaagtgcatttccacgtctctacatttctttttataaagagtcaaagggactcaatgatgagtgtgtgtgtaagggaactccacactagcaagtacaggaaaaatttgatggtactggtgaaggatgttgcaccaatctggaggggaggacaggaattggtttctcatggattgatgccgcaagacaattcataccatgagttggctgagaccacttaaaaaagtaagcagtgatgactgggcaaaagagacaaaggaagaaccacatcttttaggggagagagagagaaggacaattaaagggactcaactagatcaagttctgctcactaaaggacagcgtccaggcaaatgttaattatcttcaagaagcaatctgtatatatagcatttcaagatactccgagatgcttttaatttattgaatactttttattggtatttatcataaacaagagactcacaaatatatcccagaggggaggttttggtgtagttgactatagtagttattaaataatctattaataaaagcccacaaaatggaagatagaaagatagaaaaacaaaagacaacacaggatggtgttggtatacagaatttatacttgaagtttaacaacacggaacaagaaactttattaaaatattcatttaaagaacttccatatgaatcaccagaggctcttagtaaaatattgattcggattcacagatctgggtggggcctgagattctacatttctcataagctccaagcagatactgatgctattcttcctcaaatcacactttgactaacaaggactcacacaggttctctgtaattggtgttggtagtcattcatggttagatgtagttgaggactgccctcttaactacctctcggctgccaggttataaagaaagcaagtctcagtacaagttctgtcacttaggagcatttattagccaatgggtacaaaacaatcttacagcctgtgccagagacacagtgaagtcacagttctgtcttttggggtgcttggtgtgagaggctcacagtctacacaggccacagtcctctattagagtggttctcaaagtgtggtccctggaccagcagcatcagcatcacctggaaacttgctagaaattcagattcccaggcccttcccatacctactgaattagaaaatctggaggtggggcctaggaaatctgcatctttaaactatccactccaggtgattctgatgtttgctcaagtctgaaaaccattgttctagcagcaggattccctcaaccatctaactgaattctggcaactaagaatccggtgaaccacagctggacattttggaattcagcctagggcaccatttctaaagatggagaacctactggattcttcttaaactcaatttaaaggcagggagtgtttctaaatgtttttcaacaatcttcatattttgcaaaccactaatatcactacacaggcccgtctaactattaattaggaaaattaatgaaacccctggtgtaataagagctaaatataactgaatcacttacagtggccgcctgtggcatgaggctttttgattaattgctagccaaccaccccttggagttcactcctgattaagacaactgaccacctctgcagtgtagcttaagctaacacacacatacatcacagtgtactgttcatgtgagggtttttaaagactcttaaaatttaccttatcagggcataatttaaacactataacatgtttccattttaagtgttcaggttagattttggcaaatgtatacactcgtgtaaccaccatgccaatcaagatataacatttcgatcacctagaaaacacccttgtgttcctttgaggtcagttacctactcccaccacaccccaggctaccatctggcatagtagctaagttttgcctgttctagaagttgatataagtgaaatcaaacagtatgtactgttttgtgcctggcttcttttacccagcttagtgtttttcagatcagttcacattgttgcattatcagtagttagttcctttttattgcactttgcacagtagtatcccactgaatgactttaccacaacttgtttatccattaccttactggttggtttccggtttttgactattatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgtttctttcccctagttgaaattcaggcttttatgtttggtctctgcgatggccataaagctgaaaatgttgacccaagtgacttggatatggattgaattatttccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctatgtggcgtgagtcagggcttgatagcccggtgattcagaaaccactagtaacatatattgttgttaaccttgctgaacattagaatgattgtgccttagaatataggagccaaatgtttattttattcctaattatatttttagatgcatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagattactttctagaaaaaaataatgcctgtccatctctttcctcttgggaacaggactacatgaatgcccttcaggctataccactttagtcttcacagaacttagccttcctggttgtcaaagggcaaaaggaattattttttcttttccccacgttaacagaattttcacctccgaaagcttggcgtatacacactatatgttttctaggctatttttgtggtggttgtagttattggcaaatcactgggcgtcgggggtgggttgtctgttatttctgatggaataacaaatgctctttgttttccctcttttcagctgacctgaataatgtcagattctcagcttataggactgccatgaaactccgaagactgcagaaggccctttgctgtaagtattggccagtatttgaagatcttgatactatgtctttgcttagaataaaaagtaggttgggtacatttttacttagagaggggagaaacagctgtcacaattcctgttgcaatgtataattcattctttaatgtatccttggcctagagtttgcctagaatgttttgttttatttttagaatcattcctgtcaccattcctcagctactgatgttgaattaagatattgagaatttttattttccaactactggcattggcatcggcatccataattacctttgtgaaacttgcacaatccttgttctacctttgtttttttttctttttacaaaatgtacttagtattagaagactatgactatctgatctaaaccaaacttcatagacatgtgtggtttattagcttgaatgctaacgtgcagatgaatgaagtggtagaggaaaaatgacagaattgctttcctccttttttatcatacatctgtggaaaaatcctgaagtgttacacagctctatcatgtcatcaaatagtttatgtataactctactattgtctgagggtctgtgtgcattgatgatatgcccatgaaacaggcacagtttctttttctttttttctgtttttttttttttttttttttttttgagatggagtcttgctctgttgcccaggctggagtgcagtggagtggcgcaatatgggctcactgcaacctccacctcccaggttcaagtgattctcctgcgtcagcctcccaggtagctgggattacaggcatgccccaccatgcccggctaatttttgttttttgtttgtttgtttgtttgttttgttttttttgagacagagtctcgctctgtcaccctggctggagtgcagtggcgcgttctaggctcactgcagactccacctcccgggttcacgccattctcctggctcagcctccggagtagctgggactacaggcgcccaccaccacgcctggctaattttgtttttgtaattttagtagaggcggggtttcaccgtgttagccaggatggtctcgatctcctgacctcgtgatccgccctcctcggcctcccaaagtgctgggattacaggcatgagccaccacgcccggcctaatttttgtattttttaatagagacggggtttcaccatgttggtcaggctggtctcgaactcctgacctcaggtgattcacccgcctcagcctcccaaagtgctgggattacaggcgtgagccaatgcgcccggcccaacaggcacagtttctgctctgatggaacttacagtctaacaagggataaccaggcatgttcatgaaatttgtagacataagcaaatatatgtataatgtattaagaatgtctacagttggttaaaaaaataaagtgatcttgtctctatttccaagaccatttcaatgtcatatatttagttgtgcaacagtgggacaatggggtactatgtgaacagctaactgtgtggaatgagattcaaagaatgtttgtttgaagaggtgatgtctaagctaggtaactctagaagagtaagcagctctctctctaggaagagcgttctagtcagaaagaagagcatgtgctgaagggcccagagaaagcatgacacattcaggaactgaaaatatgtcagtatggctaaagcacagaattccaggggaaagatctattgtgaaataataggctggagagagaagcaggaagcagattgtgcaaggtttttaaaacccaagttaaggaatttagaggtcaggggatttggcctgggggtgacataatcagattgtcgcttagaaagatgattcttgctgtggaacagagtatggattggtgcgatgtgggagtgacaggagaaaaacctgttgcagtaatttaaaccagcaatgtggtggcttgaattagcagagtagtaagggagataagtggagagaatttagaaatatttaggaagtggatttgacaggcctcagtgattcatttgatgtggtgcagggatgtccaatcttttggcttctccgggccccagtggaagaagaattgtcttggaccccccataaaatacactaacgctaacggtagctgatgagctaaaaaaaaaaaaaaaaaaaaaaaatcgcaaaaaaaaaaaaaatgttttaggaaagtttacgaattcatttgggcctcattcaaagccatcctgggccacaggttggacaagcttgatgtggtgggtgaaagggagtcaaggaagacacttaggtgcttggcttggaatatcaggtgaatgtgggacttgtctggtaaggttagacacggagctgtggtgctcaggagaaatatacaaacaacgtttagggatcatgagcctgtaggtgctgcttgtaacgggggagaggattggatagctccaggaaagtgtagcgtgagaagggaagttatttaggacacaggataagcaacctacagaagggactgcaaaggaatggccaggaggaaagaaggaaaattccaagaggttatgatgccacatgctccatgggaagaaagaaagaacccgttaccagggtcagatgttgctgggatgtcagcataaagttgcggaaaatgcccattggacttagcaacaggaaggtccctagtaactttggtgagattttagaggcacagtggaagtggtgtggtgagttcaaaagtgaaccaaaagtggagaattagagaaggtatgaatgattcttggagaaatttacttatgaaggggagaagagtggggtggtagctagttggagggggctgaggagttaatggaaatgtatgtacagtcacgtgttgcttaacaatggggatatgttctaagtaaatgtgttgttaggcaactttgttgttatgtcaatataggagagtactacccaaacttagatggtatannnnnnnnnnnnnnnnnnnntacacacctaggctgtatgggatagcctattgctcctaggctatacacctgtacagcatgtgactgttctgaatactgtaggcagttggaacacaatagtaagtattgtgtatcgaaacgtatttaaacatagaaagatacagtaaaaatatataatagtgtaatctcatgggctcgctgtcatataggcagtccattgttgactgaaatgtcattatgtggcacaatatgtgtatataagtgtgtgtgtgtgtgtgtgtgtgtgtgtgtgtgtgtgtgtatacattgatccttgaacaacatgggtttgaactgcttgggtcaacttacgtggatttttttcaatcaaatgcaggccaaacatatagtattcgtgggaatgtatttatatgagtatgagaagacagggtgagattacaattattggcccaagaggagatgataaataatgggagttctcagagaatatgggcaggtaatccagagcccaagggagggaagagatacctctcttccactgtaatgggtggggtagagggaaggatctgggcaggtccaggtaactaagaaaccaggtagcagcaaggtgaaggatgtcttactataaaggcttccattttttgtatggagtggagagtccctgcaacgcagttaacagcaggagatgatgaagttgggcttatctttgtggagaataagagagagggcggagttgaaaaccagctgtgtgaacccagaggcggctgagtgtttcacggtagctccaatctgcaggggtgtggtatttccccaggcacacttagcacttgggagccagatgcttctgtcctggggtagggagggaacagctgggcaagagaagtgaggatttgggcaaaagattgattaaaatgatactgacaagtccctgttgggtaggagaagctgtgaacgcatatggaaactggtaattaggaggtagagggatgaaaatgctaactcttcagggaggtaggggaagaagtagtaaaggaactgaaggtcaagaagttgtggtcagagagaatcatagatgaacattattttgaaggtggaacagtttcaggtgattagatctaggatatagccatttgagtaggtggcagaggtagagtggatgtgaatttccatggaggtgaaatagcaagttaaggaactgagaggctagaatgatgcatgagtcccccatgccaatgttgaaatcatgcagaattggagcgagaactgggcaaaagagaaggaccgtgaaccctggctgccaggtcttcagaaataaaggggttcaaccagaggatctgcagaggctagcaataagatagtcaaggagtcacttggcatatggttcttacacagagatagagaagaaatgccttagaagtggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaaaaaaaaaaaaagaaacccagaaatagaccagatggaaaaaccttataatgactgttcctttctataatgtccattttcaccctggatttaggcattattcgattttcctgctcaaaaaaaattccattcacatatgtgttttattgtctgtcatttcaacttataatttccaataaacattgggaaaatgggggaatttcataatatacaaaattttgtccatttgaggtgataaccttgtaataaaggtaagctccgaatgtagaataatttctttaaattttcacttttaaatcaatttgaaattctctgcatttcctttctgagcatggcttttctaatatgtgaaaaagattcaagtatgccaaaattaaggtgtatgtatctaaattaagtattgaattctcattaatgctaggagggtgccatatatagtaaaactatagaatgaagagttcaccccatccttttattgaacatatgtgtggtcacattacttactttcaatatatgatttaagaattttctcctaattttatatttgcttagatttagcttccaggcttttgtcatttctaagcctgcaaagccatgataaagagctattgtctgcggtacaggcaaataaaacttgccctggctagctttccctaccaaaggccacttctaccaactctaactttaaggaaaattaatgatgttatctcagtgatttcctggtgccagtgaagagtttgaattacagatgccttggaaatatgcacttccacctctattaagcacttgatcttatttttttttcacttccctatcaatgtttccgtattgcagaaagccaaataacccaattgtatccactatagagaattcactatttaagtggagagcatcaccgttggcctataatgtccccagtttgtaatcagttaagtgttgcatgactccttactgcctctcaacacattggaaatgaaaatgaaacttggtagaaaagcaggaacaaagataaaatcttggtaagaaggatttataaactgtttcatatagctgatactccattgaaagttatgaagaaggtaatttaagcattttctttctccctttgtagttctgatgacattctacaggtgtgaggcttctaaaattaaaaagccaacttgtaagagcagaaataaaaacgcacttaacaaagcaagtgtatttagtttattaataatgtgtggtgggttggagagagcccaaaccatagggctaaatatactgcagttgataagtgtgacaaatattctgcaaacagtaagaaatagagaacattttgcctctattcagcaactaaagcacacattatagagatttggtacaggctggagttgtgtgaatagtcacagtttctggactcgccctcaccatgacaaaccaggtgaaaaatgcaccgccttctctgtaaatgcacctcaccttttgatggtgcgctaagggtgacattagataggcttcagttgctaaagaagactctcaggacccacaataacatggcttacaaatccgcgctctattgccagaaaaggctacattacaagagcattactgtcaggatatggatccacagccacaggctgcctccacagcaagggggtctcgagaggccagtgtaattattttgccactctcctacaaaaatctactttttctatataccatgtattatttttcacataggttagaggccatgtctctgttagttctgagtttaagacgtcttgaggacatggccaaactaattttctcagtttatatggtttgacagatattagtgcccaagagaggtctcataacatgacccatctatctcccaggggaaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttttcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttccctttaaaaaaaaaaaaaagtatcggctgggctcggtggctcacgcctgtaatcccagcacttcgggaggccgaggcaggcagatcacgaggtcaggagttcgaggccatcctggctaacacggtgaaaccccatctctactaaaaatacaaaaaattagccaggcgtgatggcgagcgactgtagtcccagctactcgggagtctgaggcaggagaatggcgtgaacctgggaggcggagcttgcagcgagccgagatcgcgccactgtcctccagcctgggtgacagagcaagactcggtctcaaaaaaaaaaaaaaaaaaaaaaaaaaaggaaataaaaaagtatctttggtggtttccttccccttgcaacaatctcacctttttccttttatcattaattttaagccaaacctcttccccagctacacacacacaccacacaatgcagacagtccccaacttgtgaagtttcaacttaacaattttttgatttcacagtgatgcaaagtgatatgcattcaatagaaactctacttctagatttgaattttgatcttttccgaggctagtaatatgcggtatgatactctctccccttgctgggcagcagcactgaacctcagctcccagtcagccacaagatcatgaggctaaacaactgacactttactgtgtaaggtgttgctagacagttttgcccaactgtaggccgatgtaagtgttgggagcacattgaaggtaggctaggctaagctgtgagtttcagttagttaggtgtattaaatgcatttgtgacttaagatattttcaacctatgatggggttgtgtgatagcttcaattaggcaaggcacaaggaaggagtaatccattccattgatccttgtggaatgcttgtgcttaagtaccaactaatagccatagtatcttattttggaatattaccagcctttgaaactcttaattgtagccccagttcagggactactaggtctggcatcaaaaaagaaacctgtagtgacatagggaatacctgtaagtgccccacttgaattatctttttaattgtaactggtctcacaggtgtagcccatttctcaaaaatgatagttgcttcagctttttggttgggactccacctgcaggccagagagggtgaagcccagtggaaagaaattctgaacttaacattagcttttgccaacccagccaaggaattggattttttttagcagccttgccatcagtttgcaattgcctcctaatccattttgttagctccttaggttcaagttctctcacttccagattccactagaaagttacaccatcagtaaccaatttcaaagcctgtgttacttttcaaccaagcgtagcttgttgagcaacttcaaaggttctttttcatcccttttatcagaatcttctttttttctttctaaataatgcctcagtcatacttttagctaagaatgagttggaggtgttctaaacaatcttgcttctgacactcactgccctgacagtggaagttaaacagggttcaattgctaaagaggactcacaggaaccaaatgacagtgcttacgaatctagagttccttgcagaaaaaggatgcaatatacccacaacattaaaacaagaataagtgtcacagccacagcctgcctcacagcatagggtccagagaggacaggtgcaagctataattgccctctgtctacaagagccacaccacgatgcattttctctcttggaacaagagctactgatgtgagcacagaacaccttggaaaccagggagcacaaattggagtttcagccagggtttcttatatcccgtgggtaacctaggcatactgttcctatgtaaccagcctcaaactcagtggcttccgttggtctgactgtgcccgggtaaaaatggtcaatgttactgttagcaataaacaatggtgataacctgcaacccatggctacacttcaacacagtaagtcactttgaaaagcaagtgctttgaccagggctctgcactgtgtagatattttagcaagtcatctcgtgccaactccagcctctctggaattaacccttactgcacagacaactacatcaaagtgcattgactttcttgaagtgcaaagatttgcttgggaggtccctcagccataagtgtaagttgcctgtagagtggcatgcctgggcaagaaaaatcagcaaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctggatatcctgccataacacccagagtgagtctccatatactctggtctcagttgtctcaactgcaaaatgattttaaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtgggatccctgtgttgaagtcctgcctgctcgccgccccccacccgccactgtctgcttttcctgcacagcatagaggatcctggagagtcagccatttcttttatcctgtccccaccctctctcacccccacagccctcatgcataggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacatatatatatatatatatatatataatatatttaatggaaattcctagcttaaggaaacaatggttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcatggattgtgtatacctaaatggaaattttttcaaaatagctccatgaaagttgaattctgtttgacatgtttgtttagggaaatgtgctcttcagtcttctgtgatggattgttcttgtgtttaaccacatccagttttagcagagcacactgcacagtatttctctcctaactgtgtcatcttctgctcctgtaatttcagagcaattgctttgctcccctctggagctatttctactcaacatttgctgttctatgtgttacccattcacctgtacagagataagagcaggccccataaaatgaaatgcatgcagtttttctctgttcatttccatcacacggctaaataagactcttaatacaaaagtgattcgaaaaattttcactagttacttcttaaatgcctggatcagaggcaaaatatttatgatgactaaagcagagtaacaaaaaagaaaataattgaaaaacttcaaaccacccatagcttccttcagtatataaggaaacatgttgggaatattggtgtttggaagaaatccattcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaactggatagattatgcaattactttagtttgcctatagaaaattttagtggagagtatttttttcacctaatattagggtagcagagagatgctgaggtgactgatatttcaaggagaaaagcgcttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttctcaaactgagaacatttttcgttttcttttgttttttaataagattttatgaagtttcagtttggcgcctccattcatcactctctcttagagaacaattgtttgttttggattgcacacaagggagatatccccagttctgatttttttttttcttgagcttaatgaagacaattgaagaagggagcagaaggaattggtcttaattttgcctaaattcttcttagatctcaaaattattacatgcctcatttcaccaatcaagaacatactcccatttggaaatctgggaaggttttctgaaaagagttgcaaaacaactgttttgccttttacctttgttgtagacttctactaccttttgaactaaaatttatacctttttttctttcttattttgataaggtattgctttttaaaatttcaggaccacctgactattacattcatcatagtcatctaccaagtccttgaacatgtcggatttcaattgtgaactacgttcacattagttttgataagagtttgtattcaggtttcccctcaaatatattttggcactgttttctttgcagatgacatgtgaatgcattctgaatgtataacttccttctacctgactgaaaagtatttggtgacaattttaactccttgaaggcctgagttgctgtataaagtggatttgttaaattttgatctaccttttcttaagagggagaaagataagaaaattttccagtgataggaatttggttagtccattagtgcccaggatttctttttgactgagggatttaataaattttagcagctggaagttgagcatattgttcaccgaaaataaccgccattgggacctatcctttgtgattttgaagtgctaataggcgaattattctgaaatattttctcctttttctttttaccaatatctaagggccagtagctttccgtaataaaataagaagccaaaaaactattgaaagacactttttaactttaattttaggtttcggggtattatgtgaaggtctgttacataggtaaactcacgtcacgggggtttgttgtacagattatttcatcactcaggtattaacccatttatgcctagtgttccattattggaacactaagcttgtgggaattattcctatcctactgctcaaggtcatcgccaaggtctgattttcacaaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttttcttaatttacgtagaacttttgcagttcaaataagggtttttaggaattgaaacttggtaaacattcagtggtcaagttggttgaacttccattgcattgtaggtcatcagtcaaagagataatgaatttggaaaagttcaaaacaatcttaataaaacagtggtcaatagagttcacacatcattgagcactttactcttttatttttccttttcaaggctttattcttaactagaagtgtttaccctctaggaaagggtcagtaattgttttctgctttgattcttcataataggggacgaacagggaggatccgtgtcctgtcttttaaaactggcatcatttccctgtgtaaagcacatttggaagacaagtacagatgtaagtcgtgtatactaatgctgtattcttttattaatgttggctaattaccctagttctagatgggaaatgacagactgttcttatttgacagcagattcctcatgtaagatgtagaactgcttttagagtgtcataaaatttggtttgtgccattccttgtcaaacattaaattgcaggcatttaagtagagaatgaggattagcttttccagtccaggtattattttacattacattgactgtgtctgaataaaacacatgttcctaggggataaagtctgattttctaacctctttctgtaagtcggaaaaataagtgtgaagatttaatctctgcacttgtctagtctttgggttcttatttaaagaataccatgtgacattcatgttcaagaaacattgtttattttataatcatcttactgcaagttgtactgacacatccaattccgtgacgtgactaacattttattatttgagagacagatagcttgctgtttcttaaaggatagatacgtaccaccctacagaatttccttttgattacgcattgggttcttctgcttaaaaactgtaaaaccaaattaaaagccaatgctagaggagtgatggttcagatgaccaagtgaccatccattcatattgtgaaaggctgcagttggttttccccttgaaatgcttataagcaatcttttcagtaggaatattaaacaaattcagcctagcttgtcttttctctcttcccctgaggcctagccacacatgtgaggagatgtgctaagcttcaggacaggcaggagataaaagccactctgtctcctactgatcatttctccttcaggagtaagccacaaaatacacaaaccattttggccctcacttttatgtagtttccacttgagttttctcatcctcagaacgagagaaaaataactgaacagcttttgttaaccattttaaaatgtatttcggatgagatgggatacctgtgtgcttttctcctttaaatattgtagttacttagtataggttaggttctaatctaccgtatatatggtatagtgacagcacattgtaaatataatattaaattgaataattgaggaagctttgagttggtgtttcgaataactactaagagggaacatgtttttaggttggtgaaacaaaaatattaaatgcaaaatgagatgtttgaaagtaactcataactttgaaaataaacacctaggtatgtatatcggagagcagataaaaagctgtgcgtacaatctcaatttttagtgccatcttaggtatcctgttaaaacatttaatttcctagagtttaaagtgtgcttatgggtacagaaagctttcttggatttactttttttgaggggcaacttctaggtgaatataaggtatgattaaaattttatatctgagaacaaaacataacattgcaagcattcagtatgttcattcattctgttacatatattgggcacctactatccaccgggtactgccattctactgtagatacttctggcacacaactgaccaagatatggttccttccctcaaggggatataagtctcctgccaaaaacgatagacacatattgaatcaatgccagcataacatgatgtgagctattaattagaaatacgcagccaggcgcagtagctcacacctgtaatcccagcacttagggaggccgaggtaggaggatcacttgaggtcaggagttcaagaccagcctggccatcatggtgaaacacgtctccagtaaaaatacaaaaattagctgggtgtgatggcatgtgcctgtaatcgcagctactcaggcggctgaggcaggagaatggcttgaacccgggaggcagaggttgcggtgagcagagatcgcaccactgcactgcagcctgggcgacagagcaagactccgtctcaaaaaacaacaacaacaacaacaaactatgcacagtatcctgtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacagctgtccttttttttaaaactgtcctttgtagctttgacattcccctattattccaaagtctagaggtgtatactctctgctaatgtccatcactgactgaacacactcttgtccgttctctttcctatcctgtcccattgctttttctctgtcgtagtcagtgccccagaaacaccctcttcttcccaaatgcctgagcactccactggtagacattcatcttgttctaatttttttttctctttccttttttttttttttttcttttttgagtgcagtctcgctctgtcacccaggctggagtgcagtgagtgagatctctgctcactgcaacctccacctcccgggttcaagtgattctgctacctcagcctcccgagtagctgggattacaggcgcccaccgccaccccaagctaatttttgtatttttagtagagacagggtttcaccaggttggccaggctggtctcaaactcctgacctcaggtgatccacctgcctcgaactcccaaagtgctcggattacaggcgtaagccaccgtgcctggcctctaatttttattaggtagatagtgctacaatgaacatccttatcgtttagcttttgtctttgaagctttctttataggatcaattctcaggcgtgtgattgccagacaaaataatataaacattttttgtggcctttcttcaaaagttgttctaattgtaacgctatcagtattgaaggagtaagatgctttcggtatcacattattcacagtgttcttatgtttttgtttttggttttttcaagtgctaagagctgtttttcttatgtagggtttctcaatccattctaattctattaacaatggctgagatttacaaaatggaactagctgtagaactaactgggttatatctgaagtctttgaccacagactaggatgaaactatagaaggtttcctgggcagatcactgtgaatatttaggtgtttaaagcagtttgagtatttatttaatagttggacagatttaccggatgcacacataataagttcatttatgtaaagtgggatatactgtttgaattattttgccaaaattatggcaaattagttgtaaatgtaaaatgcatgtggagaaataaatatcttttcctcctcatacccaaaccttccaaaatgcagatagatgatcaatccaatcaatcatcaaaatgtagacacaagtaacttccatacaatgaatattaatggccacaggcaatctaggttcattttgattttttaaaatccaattataaaacaacttgccataaacgcgagttatttcctaatcttttggttgtgtgttttttttgttttgttttgttttgagatggagtctccctctgtcgcccaggctggagtgcaatggcgcgatctcggctcactgcaacctccgcctccctggttcaagcaattgtcatgcctcagcctcccgagtagctgggattacagggtgcctgccaccatgcctggctaattttttgtggagacagggtttcaccatgttggccaggctgagctcaaactcctgatctcaagcaatccacctgcctcggcctcccaaagtgctgggattacaggtcctaatcatttttcccctttagtcaagtctcagttactctttgagttctagtgaaacacacacacgtgttcatatatagggatatataaacatatgtgtgtgcattgtgacttgggttaaaggtaaggctcagtgatggtccctgctgcaaagtaaactaggctgtattcagggccagctggattctttgttttctcgcccgagtactgactcatcaggaagccaccaccatcctcactgcagcctctggccctcttggatttggttgtcaggataagcggtggccatacagaagctctgctttccctgggctgccccccttatcaggagaccaacctattccatttctgcctgctacatccttttgctggataacctcctactcccctaagcccatgtctctggtttggttacatttctgtctctgtaataacaactctgtattctcagtctcaaagctttgaattcagtccatccttgcatatttgttgaatgcctcctggttggccagccagtctccaagctctttgaaatgtgaaatgtgttttgttttgttttcagaaggggtctaacttcgtcacccaggctggagtgcagtggcacgatcacagctcattgcagcctcgacctctgggctcaagtgatcctcccacctcagcctcctgagtagctgggactacaggcatggaccgccacgcctggcatttttttggtgtatgtgtgtgtgtgtgcgtgtgtgtgtgtgtgtgtgtgtgtgtgtgtgtacagggtctctcgccatgttgcctaggctggtctcgagctcttgggctcaagctgtccacccacctcagcctcccaaaatgttgggagtacaggcgtgagccacggcatccagccttgaaatgttttctatgagactggggggaaatcagtcaagatatgaatggtggtaacaggtggcttttgattttctctgtactatttttattttctgagttttcttctttgaacatttataattagaaaaaaaattagtaaagtgctgcctctttttttagggaaagaaacatgttttgtttgattgctttccattgccattcttacattgtttccaggccttctcatcattgcactggcttcctagcaagcctccacttcacactccagtccttttcattggtcttattgccctcatactagttttagagaaaagcatttcccatatgatgccgtccttgaaaatgtcagtatctttctgttgtctagtgaacaaatcctaattcctctatttaactctcagacctttcctactctggtttcataaccacccatagtttgctttcactatcatgaaacagcttctccttaccatttgtacctattatgcttataaataatattgttaccattgctactaacaaaactttgttcacatgaattctctcatttaatcctcaccaagtctttgaggggaacagaatagtcaggctttggagattttgcttttattattgtttaagtggatgaataatttatttgcgcccttaaagtccctcagctggtggaagggtttgattcctagtccagtatgcccaccgccacatttactacctcattcccaaatatgtagtttctgatacttctgctctccagcttcccaaggccaaacaacagctacttttcctgagtcctggatagaataagaaaaggtataacaagacaggggacccttgagggggaagaggaattagtttgaagtgctggcaaatgtagtatttctaatcagatgctagtaaattccatatgtatggcgaggctttcattacttagatttggggagcctctcagcattttagcaatttgcaatcaggttgaatggatccattgtaaatacttaggaatacttaggaatccacgtcctggccctggcatgcttttcctcggccaggtgcactggcggtcaccttgcctttcattgtgccacgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacatacatgcacacacacccatctttattgaaaatactctaatcccaacatagctgtttagtctatcttcagataaaaccaagtatcacttttaggtgggaaaactatacagtcatgtgctgaagaatgacgttttggtcaatgacaggccatatatactatggtggtcccataagatcaacgtaagaagagattataatggaactgaaaaattcgcattactttgtgacactgtagccattgtaacatcatagcacgaagaattatttcacaaacctgcactgccagtcatttaacaggtaaaaaagtatgttttaaaatatttttaattattatggacacataatagtactcatttatgggttacatgtgatattttgatacaagcatacaatgtgtagggtaacacaatcagagtaattggggtgtccatcatctcaaacattcatcatttctctggtaggaacattcccatttcactcttttagttattttgaaatatacaataaattattgttgccatgcatggtagcacgcacctgtaggaccagcgtttcaggaggctgaggtgggaggatcacttgcgcccaggaattcaaggctgtaatgcacaacaattgcacctgtgaatagtcactacactccaacatggacagcatagtgagaccctatctgtaaaaagatttaaaaatatattgattactatagtggccttattgtgctaccaaacactagatcatatttcttcttactgtatttttgtacccattaaccatcccttttttatcccccgatcttcactacatttcccagactctggtagtcatgattttactctatctccatgagttcaatttttttttttttttttttttttagctcccacacatgagtgagaacatgggatacttgtctttctgtgtgtggctgatctcaacataacgtcttccggttccgtacatgttgctgcaaataatgggatttcattttttatggctgaataatattccattatgtgtttatagtacattttctttatgcattcatccactgatgggcgcttaggttgattctatatcttggctattgtgaacaatgctgcagtcaacatgggagtgcagatatctttttgtggtttcgattttgtagtatcttcttcagtaaacattttaaggactttattgtttagataacgtcaagtataccaactttatattcaatatgcttcacctatgagagctggagtgtcaaaatctgtttattttacatctgttttctgcctcctgttgtacttagtattccaaatgagtaagttgcttttccatctatcttctgaatttctctatttgtatgacaaaaatgaataccatctatgcacagttgttgtaataatgtagaatgatatgaaaatgagaataaattacagtctcaactgttgagaacaagtatttctctgtgttagaaacattcccaattctactcttttagttattttgaaatatacaatgtattattgttgccatgcatggtggcatgcccctgtagtcccagctactcaggagactgaggtgggaggatcagtaacacataaatgagaaagcattccagaatatctggagaagtgactggcagagtggttaagtgcataggctttgaaaccgaactgtgcctgagtccaaatctgagctctgctatttgctggctgtgtgactgtggacacatttcttaaccttcctggcccctgaactcctggaggtgattgtgaggattaaatgaaccaatagaagcaaagcacttaagagctgtagtggatacatagaaggtgcccagtgaatgttagctatgattatctaaagtgtgttgtggcatgaaaatatcctgccaatgttaacagttgcttttatctataacaaaacatcatctgtggattgcattttagagattctggagattctgtttctctgcaaatgttaaaatgccatatcaggagacttttggctggttagacagcattccccgggtcaactgattactttttttttttttttttttttttttttttgagacagagtctcgctctgttgccaggctggagtccagtggtgccatctcggcacactgcaacctccacctcccaggttcaagtgattcttctgcctcagcctcccaagtagctgggactacaggcacgtgccaccacgcccagctaatttttgtatttttaatagagaaggtttcaccatgttggccaggatggtctcaatctcttgaccttgtgatccgcccacctcagcctcccaaagtgctgggattacaggcatgagccatcgcacctggccgattccattttattaatagattttccatcctgaaagtaactcctaaaaaccctccttcacttaggtttcctttggctttttgtgtattaatcagactgtgggccctttggttccatagacattccttttacaccccttttggacggatgaatactcactagtaactaagtaattagtaagagttactacaatttggtatttataaagaggtggcctttcccagaattgaaggtagaccctaatagtccaatcagccttccatagagatagctggctgccatgaaaagctgagagatatcaccgacctcttactgggcctgctcatgaacagttagttaaaattcctgcaattttcagaaaagacccttatcagagtattatcagtattgtcttaagtttaatattggtttccagttgttatttttaaaaattttaagctaccgtgggttaagctttatgatgatctgtttaagtggtttgtttgattaacttctctattggagtaatggatgttttcttcaccagaattttgaagataggtttgtgttgtagttgaaacctgttttgtttatacacttactgctaaggaaaagcacatgtcattttgttttccatcttcatccttctaaagtagcacttcattgttatgaccaaatctttctttcttccttccttcctctcaccctgtcttttccttccttccttcctgccctccctcccgcctctcttcctttcctctcctctcctttcctttctttctttcttttctcttttctttcgttctctctctctccctccctccctctctctctccccttctccttccctccttccttcctttcttccttccgtttctatcacccctaaaattccatcatgctgtatcatctcactaagtcccaatctctggaaaccacagctctgttttctgttcctataattttgccttttcctgaactggattttaaaggattgtaggaggcagtagtggaagagctaactttatatcttgttcttttacataatgcgccctgatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggtagttatgggaagccttttacttcttcttgtctcacaaagacaactcttgacctctcaatccttaaacaaaaagttctgcttctgcgcatgtggggactcttaaactcattttcatgcctggagattcacatttagggatctaggaaaagcacatctaggcagagtcgatgaggagatgctttaagaaccgtgacaaggacaggaaggaaatcaattttgcgttaggtttgtatttttagagaaaacgaatcctggggaacttttcacactcattactattgacattaataccattgtcctgtccctttcacagttactaaaatcactcttgcccaccctcctgccttgcccacaacctattcccatgaaggggtgacttgggagaaataacggtttccaaccaacgttttattttggaaacatttcaagcacaaagagtagttgaaaggatagtctaaagaacactcatctgtgtcatacatctgttcaatccatggttgcttttcgctctacttacctcctccaccctctcagctctgtttatgtatgtgtctgtctgtgtacatacacacacaaacacattttcccctatgccatttaaaagtaaaggagcatcacaacataaacccctaaacacttcaccatacaccattttcttaaaggatgacattctctaacataactgcaatgctatcgttacacacaaatttaacagcaatccagcaataccctctgatatgcagtccacactgaactttccccagtgccccagaattgttccttatagccactgttttcttccagcatctagtcaaggtttttgtctgtcatgtctctgtaccttcatttagttttgaacagtctcccagcattttgttttcctttcatgacattgacttttttggtagggggacagagtctcgctctgtcacccaggctggagtgcagtggcgcgatctcggctcactgcaacctctgcttcccgagttcatgtgactctccacctcagcctcaggagtagctgggattacaggcatgcaccaccacacccggctgatttttgtatttttagtagagacagggtttcaccacgttggccaggctggtcttgaactcctgacctcaggtgatccacctgcctcggcctcccaaagtactggaattacaggtatcagccaccacgccgggctgacgttgacatttttgaagagttcagaccagttctcttgaagaatgtcccatactctgggcttttctgatggtttccttgtgattagattaatgttaacattttttggccaaaagacgataagatgatgctctgtacctaccactgtatcacaatctggaggaacaaaataacattttgttcctattggtatcactaagaatgttaaggtggtgtctacaagatactttccttgtaaaatatccttttccctttgtaatgagaaagtaattttttgatattttgacatattataatatccattccttaaccttttaccctatggttttagcatttatggatgatccttgtctaattcagttataatattggtggttgcataatggtggctttctaattctaccatactttctgcatgtattagaccattttcttatgtaaagaagagcttctacctctcccccgtctattcatgaatatcactgtggacatccaaggtggttctgagtgtacaaagaatgatatctctctttactgaactgccattggatactatttttgtcttggaattgtttaaaatggcagtgtatggaattgaaagtcctttctccagagagccacataaacagatgtctaataaatacatttccatattaaccaatccttttatgggaacaacacattgacataattaaaacacgtaacatgaaaactgtgctgaattgagaagctcatagagttttgtttcttttttttcctttttgccacttcaatatatatggacccgcacctgtcaatccaggtagctcatacatgccgtagcatctaatggtacgagggacatgtaatgctgaaaagaagggggaaaggagttgatcagatgagatataagtatgcatttatcagtgttgtggggtattcacttgcaccttccattggctctcgcagccatgttatcggcatataattcagttgaagatttatattcacctggaaattgtcctaagtgggccttgcttacttagctatcagactctagtactttcaaacaaattaaagattcaaaagattttggggatcgccttgctttttcccataggaaatcacttttgtcctgtctttttaagactattttaagcatatatttcagtattaaaatcgtagataatcttaagctgtttccttaacctctttgggccttttcttatctgtaacgtaaagttaaaacaggttatctcaaaagttacttatccctaagtgtctttgattctatgctaaatgttataaaggccgaaagggaaatggattattgtacttatttcaaagcttggccatgatcagcaaagtcttacctgatcttccgggtaacaactcttgtatcagagctgtaagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacctgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcacttctaaccgccaataccccccccccgcccagttgtgacaaccaaaaatgtctcccgtaaaagataccaggatgaaatcactttttgtcagtcccaaactaactagagccagggcagcatgaaaggaggagggttcatggttacatgcctgagataaagactgtctcaaggactttctaaaatcgccccacaagaaattcctctgttaggactgcagcagtgcacgtaatatgctctcaaaagaacatctgcccagtaatggcatccccactaataaactgacaccagttctggcgttgagcatctgaaacgaactatgtttccaagcagcttatgtaaacttctgtttttaccaataaaagtttccctctacagtctcctcttcagatgcatcttgggttgtaatcctcatttctaattccaaaataaatttaacatatttggcgatgtttttctctgatgttttttggtcgacactccaaacattgttatatttcctctggggtacggcatcatttccggttgagaaccaccgacctagagaaaagctatctgcctgtgcagttcctttcaagggccccaagtgtgaattttgtgtatacctatattttaagccagatcattctgtacataccttctaagtccagatgaagtctgttagccttttatgtgtgataccatcacatagaaaccaacacaaggacatttactgtaatcgataaaggaaattttggacagtttgagaaagtaacttattttgtcttctgctctttataaaatctttacaagtgtatgtttttgctcttcaggatgactaggcagctttttaaaattctgacttcatacagattttataatcttccttttatttcttgcgatcatattgcagttgaattcccacccactgttcaattcagcagattttaacagagactccagaagtatagttcctgtctttaattaatctgcaatttaggaaagaaattaaggaggtatcgttctgtattgtttccaggatggtggtttcttgttatctgagaattactgggcacagtctcttgcccaatgtttacttctctatatagagttgacccttgaaaaacatagatttgaactgtgtgggtccacttataagtggatcgttttcaaccaaatgcgtatcgaaaatgcagtactcaagagatgtgaaacctgcggatatgcgttcagctgggcctactgtgggacttgcgtatgcgtggattttgctgtatctcaacagcaaaatccccgtgggagtggggctgcggcgggccaggaagcaacccctagcatatactgagggatgactgtactaattattgtagtttattaagtgttcacatggttttcacaaacctcacaattgaaatgccaattgccttctcctaaaaaatacaatgtacgtgttcatggtagctgggatgcagggcttgctgagaaatacttaattgcatttcttctgtagccatgaattgattttattaccttgagagaaaaatgagtattcaggtggacctcctggcaggcggttggcccttcagtgtccaaggatttatagaaagcacaacatcaaagaaatccaaaagttcttcggaaccccagcaactctcctacctccaaacttgccatgtaatgcccttttaaacttattatattgataggtaaatcggtttgctagaaattccagatattgagaattctttgtctgtgtaccttgttatatttgtataaaggtgatatttgtatgaagccaccctccagtgtgctgtaacagagcaatagtaatgacaactgattccttcccctagcttttctgttatggatagttgctggcaggtgaggaccaacagaaaaagaggagaaacccaacataattccaaactgtgaccatcataatggaaggagctgtgatagctttgctttctgtgtgtgcatgacatagaaggggaaaatggagttattgccaaaacaacagcaaaagcaaaacaaagccaacaaacaaaacaaaacccagggctaaatgacctttccaagagattttgcttgcatggcttgaaactggtgtttagagatgaggacaaggtcacccttgatactgagaggggattatatctgagacttatatgtatctcaacaaataatggtacttacaaagattatctcagtccagtgaatgccatcatacttatcttttgaccttaataacttcctgctattccaatctatccctatatatttttttctggaatgatcgaaatgtaattttagctgggtttaattctagttctgttaggtctttacagaagcttgcctggcttttaattctttccttcttcattgccagacaaaaggagagggaatataccactaggatacagagtagtttgtcataaaaatgaaagattgaaacagaatgagaacgtgaatccccgtaccttgtcttcagtctgtcagttggcgtaggtgagcagttttaaaagagccaacatgatggatcttgcatcttaggggctagaaatttgagaatgttcaacctttaagcatagaagaatctatagttttttgaaagagtagaacattctacagcctcccttggtaattcacactaatgctttaacaactttcagcatcaggaaattcttccatatgagctacagcctaaattcttcatgctgcttaagtctgtttcttcttgttctgtcctcagtggagagatcgaacagctggtcacaggcccctatgcgagagccattcacataattgaaaactgttattaaatcgccccttcagaagtcactcttgcttgttctctctctctctctctctctctctctctctctctctctctctctctctctctctctctctctctctctctgagaatctgggaagattccagagctgattaacatgttgctttactgatgaccttctcagcttttaatatgttaacgtgctctaagaattttaagaggcagatataatgtgcactgtttctttcattaatttgaccttctcgtgaagcattttgctggacgattgatctgctggacatactgggaaacactgactcagagattttagttgagtaggaaccgtgtgtgagcctacggtacagaacaaaagaaagtaatccagttacactgtctggagaaatagaggtacattctccgcaatcatatttgaagaatagttttctaaatgacaatggcaaactaagccgtgtcatatgaagaagaagtaaaaagaataggaatgaagaggcatggacagataagacagctctggtaaaatatttaaagggctgttcaaagaccaagaacttctgggttgctggtcagatggataataataatgacaataacaatagcaaacatgattcttgctatgtgtcagacacggttccaattgcctttcatttgctgactcacgtaatcataaaataactctatgaggtaggcactattaatatttccagtttgtagcagagaaaaagtaagacacagagagataaagttattttcctaaggtcacacagccagtgagtggtgaactccagtggtttaactctggaacttctatatgctgtgctgatggatttcagctcaatgtgatgcagcacttttgacaggggtatctggacacaggtgttcaggatcaccttctaaggatgtttcccagctctctcacatgggtggtgtagtggctgtaagcacacactggcatgggtaagagtttggactcgatgaatgctgagtttggactcagtgaatcctgaaagtcttacagctctgtggtgccatgccaaaaggatgaatggacttgcatgatctttttcatttttagattgcataattctttataaacttttttttccacaaagtacctctgtgatggaactctacacagagaaaagtgctcagcaacagctttttaaaatttaacttgtaagttcaggggtacctgtctaggtttcttatgaggtaaacttgtgtcatgggggtttgttgtacagattattttgtcacccaagtattaagcctaatacccattagttattttcctgatcttctccctcctcccaccctccatcctctgataagccacagtgtgtgtttttcccctctatctgcccatgtgttctcatcatttaactcccacttataagtgaaaacatgcaatacttggttttctgttcctgcattagtttgctaaggataatggcctccagctccatccatgttcctgcaaagaacatgatctcattcttttttctggctccggagtattccagggtgtatatgtaccacgttttctttattcagtcttccattggtgggcatttagattgattctaggtctttggtaaacagtagcatttgatcggaagtttgaactgataccattttgcagctaggaaatccaaagttaaacagtttattatagtgttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaaaaaaaaaaacaaaaaacatattaagcacacaagaaatcaaggtggaaaaagaaagaaatcaaggtgaatgagaaccagaagaaatagcaaaccatagaagcagacctacgataacatcatattccagaattattagacagattattttcttaattgtgtttatgcagttagaaaaataaaaaacaacattgaaaaatatctacagggaaccacaaacctgagaagttaccttaaaaatgaccaagtagtatttctagatgtcaaaagtacaataatcaaaatttaaaactgtatgggtttacagcagaccggcaagagaaatggatacccagacagtaaggcagaaggaattaataagaatgaagcacagaaggatgttttaaaaagatgtggggcagagaggggggaactagggaagtcctgttcagagaaatatagattgaagaagagtaacatttatgtaacagagttctgaaagtagaatggagagggaatggagaagaggcactatttgttgagagaatgacggagaagattccacagctgattaaagactctaaatcacaggtttaagaagtccagtgaatcctaagcagtctaaatcaaatcctagaaacagcacaagatagaaaacagatagattatctttattttttttattttatttttattatactttaagttttagggtacatgtgcacaatgtgcaggttagttacatatgtatacatgtgccatgctggtgtgctgcacccactaactcgtcatctagcattaggtatatctcctaatgctatccctcccccctccccccaccccacaacagtccccagagtgtgatgttccccttcctatgtccatgtgttctcattgttccattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcaaaggagcaacagtcatctttactattgacttctcagcagcaacagagatagacgaaagtggagtaatatttcagtattcaaaaacaaaataaaaacaagaccccaaaacctttcaatcaaaaattttatacttgggccaggcgcagtggctcacgcctgttatcccagcactttgggaggccgaggcgggtggatcattttaagtcaggagttcgagacctgcctagtcaacatggtgaaaccccatctctactaaaaatacaaaaagtagccgggtggggtggcgtgtgcccatggtcccagctacttgggaggctgaggcatgagaatcacttgaacccaggaggcggagattgcaggagccgagatcacgccactgcactccagcctgggcaatagagatagagtcagtctcaaaaaaaaaaaaaattgtatttaatgaagataactatcaggaatatggattttttttttaaaaaaaggaggtattttcagacaaacagagcttgagaaatgcaccaccaacagctaaaggaaattctaagggacatatttcaggcagaactaatcccagatggaagatttgagatgaaagaaagcaatgaagagcaaaaaagtagtcaatatataggtcaatctatctaataatataaaaaattaaaacaatcctatagggttgaaaaaaacaaggtataattaaaattcatgaatatagtaacatataaatcaaatggtggtattttgagattgttgagatcattgtcctgtctgggatgaattgtatttcttacatttagactttgaaagagagagaaatagagaggcagacagaatcaacagggcatcatgaaaacagcgctaagccaggaggtttggattctattatcagctctgctgctagctgtatggcctttgaaaagctccttttctggtctacaaaatcagtttgcttgtctgttagatgaggctttggaaccagatgaattttaaagcccctcattatgattctatgagaaacagattctctagaaaaaaaaatcagttgtccccctcctttgaaattttatcagtaaacacctgcatttcacttctggctaacttttatgtatcagttcaaaaattaaagctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactcttttccagttacgtgtgaactggttttgttactttattttctaataactaccttgtactgttgcgtgctttttattcatagtgcttttttacttttggtgtttattgttccatagtcatgctgtttacaaagaggttttacaaaaacttttagaggtttctgaagcctagatagacaacagtgagtaggtactgcttgcaaaggtcaccttctttccttcccggtttcttggcaggtaaaaatgataccatgggggtggggagtggggaagggaagccacagtgactgcattagatttctaagctaccttttctctgcttccttagctagtgggctttgtatacaagggaaatttttataaaataaagaagaagaatgccttggaggatctgaaagagcactttcaccttcaattcttttgcccttatcatattatattattttaggacccagcacttctcattcctcctgtccccctcttgaaagatggctggaatctaaaaaagatagctttccttcccacttccccatatgtgacataagaaatatgtttatttgaattggctaaggttcttatctgagaaagcaaaaggcaggagagtatgaaacaaagaatatcgcattctgataatggaggaaatgtaccaactagtatttacagattataaattcttccatctaatccaaatttcatgttctcttggggcttcagttatcatttgtaggtaatggggtgagagatttctgaagagatagagataaaagagttcattcgagtaactgtttgaagatgaatcgtatcagtcaattagaaaacattattaaagcgagacttgttttaattgaaagttcttgttcacatttcttttgtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgttcattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgagtttggttgaataattttaatgaggtgtgcggactgtttatcaggttatgccatgctatttgactaatcattatatacaagggtttctaaattttgaactaaactcactttgctctcctctccaagctaaatattcagctcataaacaattatacatttgctctaggaggaaagtatttctttgttattactattggtgtgtattaataatactgaggttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgtccaccagtataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactgaagtctgtgttttctttaatagcagtaattgtatttaaagtatttattcataggattataaatactgtataaaatatattacaaagccatcctattcaggcataagagccaggtcctaacgtgtttcattttgcaagacttgtatctaatgttaacaaatcctatgatgattacaatatttgatccatttgatatggatcacagaatttgaaagtttccagagatacagactgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatatagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactgccttttggctcattttctgggttaataaatgtctcttnnnnnnnnnnnnnnnnnnnnaaaaataccatggaattatccttgaggcaaagaattaaagctctgtataagattttctgtataaaatggtattaaagtattttggatttatatgcctactttttcttggtgtacttatgctccaaggtcttaggctttcattcttgtacacacttccaggatagcaactattacaagggaaaacactactaatgtattttccctgatggtaggctttttgcttattaaaaaaatatgtaattgaaagactggtctgttccaaaagatagttcttataatacaaataatccaagtattaatttatcttgatctgcagtgaagatttcaaaacagaccttagcatttttctaataatgggctatgccagggttctagaagattaacagattaactctccaaaactatagtgaagattcacatggaaatctttggatctgcttattaaattgagtagtcatcgttttgtttcctcttgacaatttaaacgtctttataactcatttcaatttgattatgattacacttgacctagatgacattggtttcataaataagacctttctctctcagggaagaattccatttccctagttatttgctatagtgtgtcgtaattatcttactgtagtatattaagaaatatgaatttctggcacattttctaatgcaagcttagctactggtaactgcatctttttcttttttaatgtaagaagaaacaaacacattctccttagtgtttcaaccaagtccttcaacgctacttggacactgggctaaaccagggtcctctctgaattacattatcgttgacttttggatttatgcctttacctaagggctttctgtgtcagcagagaaatggaagagaccttttgtgctattccaattaaaagaaaaagtccaagcctaaactggttttcagaacagatggttttttttcctaaggttaatccaaaagatactataaaaacttcaaggataattaatagatcagatatgaaaggatgaaaaaatgttaaccctaccagaattctagcctatggagataagaaaagataggtgtttatatacaaaaagcatatagactattcctgctaatgatctcctcttattttctcacctatgttttagcacacagtatctctaagaaatatttcagatatcatgacgttctatgaaatttagtcattcttttttaaaacctcacaatataatccagggtcattctattttgtgctagaaattagtggtatagtcttgctgctgaattggaagatacatttcttctttacaaaattgcatagatcaagacatcttgatacatggagttttaagaagtcttgtactagagtagcctctttgaagctaaaataattgtaagtatctaggcagatatacagctttgattcaataagaagatagcctataaatggcgcaggtgtaaactatttaaaattttaaaccacatagggctaacacaatttcggaattataggatgtgagaaattacaaagtaggaggacaaaatgcttcctagaaactgtctcccccaaccttttctacgatgggaattttccagagaagattttggcctctcttcatggcttttaataaaagcagaagtatgagaaatcatctctcaatcctggattttaaaatacttgataatatttaagatataggagcaactaaatgtatacattatccatagaattagaataaaagcattctaggccatgtgtataacataactgtgtggtgggttttttctccattaatggatggtatctgtgactaatcacattttctgccttataggcctgcctcgtcccctcagctttcacacgatgatactcattcacgcattgaacattatgctagcaggtatgagactagttgtatgccaggcaaatattgattgaaataactaaccaaggaaagctaacctataatattttaaacaaatcttttctttttttccccaaacttgtctgattcctactaatcaacttgccctctaacgtgcatgccgttccactgcatgttgtttttggtcaccaacaagagcattagtccagaataatcttccctaaccctggcttttaaacatttccggtagccttgctatgtttttttatactgagcacatttactaaattggcttacaaatagtttaacctccttagaaaactgctagaccagacattcatatatgaaaaaatgatactatattatatggagaatatgaaagcatcagctttctgtttgtgtatttattttacatgatatgctgtaaagaagagaataattaattttcctaatccttggacttttctgtctcaccttctttgtgtttgagatgatttttatacctaaaaactgaattactaattttaaaatattttatgcttgttaaatccgtaagagtttggttaacttttttagttgtaaaaaaacaaacaaacaaacaaacaaaaaaccccctgtataattgcctgaggtgaagaagattttaaaggtaaaaattggtggcagaatgtttagagagcttactgtgcatccatcctttgtcaatattctaactgctggacatgtttaccaatcgtgaaaagcattagctagctgtgtaagtctgtcatcagtggaaagtagtaattgtcttaaaagacaaggggtagtgtaaggtagggagtgcacttattgttagggaagcttttcttctgaaaacaaagacctgttctcagtgaaagcaagactgatctgtagggggaaaacagtgaaatataactttccttagaatttctatcataaatgtagtgctactaactagctgtggtctaccacacactgcctcaaatggttaagccaacacacacatcctttaatttgaaggattcctttctcttcttgccatgatttatcctttagttttcaggaatgttcgattaggtcttgaatagattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactttaaggacggagatagagcggtgctaagagcagcagggaacacagctatggcagggaaacaggcttcattatagagtgagggcagtgttcacaatacagagcacaaaggaacattgccatgaaccaagtaaatgctgaccggggcttgaggtagagagagcagacattgaagcaaatatgaaggaaaaaataaggatttgccaagtgaataaataacataaagagaagaaatctagtcaaagtattacgatgcctttttagtttgataaagtaaggatatctcacccatcttggagaatatagacaaagggaagaatggtaaatttatcatatgtagttggtgtggcaacacaaagtcatgctcagatgagaaaagaaccttcataaggattaggccaaaagaaatagtatcaaagtggcatatatataactagttattgaagacatgagaataaataatctcatctggtacataaacgatcaagctaataataaagaatcaagtcaaccctcagtcatttgtatatgacttagttccttcaaacaaacaaacaaaaaagcctttccccaaccataactgtgatgccttatctttcttagctatgggaaaaagtattaatggtactaatatataagatacttcaacagtaaaatgtgtggccaaagaatcagccaaatgtaaatagcttgtgcttctttggctcactgattttggtattagaagctctagcacattcagattaattcgagttgtatctacgtaacagtggctgtcattcattgactgcctaagagaacaggaagaaaagtgtagttacaactctaggttataattaaacatgggaagttctagcagtacaacttcagaatttggaatgagtgtgataaattaggtggtaaaactgcttttgttttattttaaaataagctttagcttattctgaggacataaaatccattttgactcaatgttggatggcaaaaactcatggcattttaggggcaggtttggggaagtggtttggtggattggttgacttcacttaaatgtgtgtttttaatacccaataattatttttagtcagcttttcacatctaaaccaggtaactggcttgataaacaaaaataattcaaatgagaaggactttttcctaaatttctgatatttttcaacttaagtgggtatggagaggagaatattagcgtatcatcttaatgatatctaaccagaaacaatgagctttagcctgtcattacggacagaagaaaattcttataacttggaggtaaacaggcctttccggagcttggagcaatgcattcagaaaaaagtttgtcctgtgtattagagagttcctagtttccaggaaagattgtagctgcctccccaaatagaagcctttttgcctccttttcccgcaagattagtccttaaaaccattatgtataaatttaaaaataaataaaacttgtatttaaaaaaactctgccccgaggaatgagatgttcagtcttcttttaatcagtcaccttaatgtcttttttccccttaattttcgttcttctgtctaaacaataactgaatgaaacaatcatgtatctccagtttaattgttgttgtcattctgcctcaatgacttatataagttaaaactgacttactgaagcaatactttttggttacattgccttccacttaataaaatatttcctctgttacttttagagctgcaaggtattttttcctactcagtacaacaatagcgtgggttagtgaacagattatcttgacaggcttggtggccaaagcattatacagccattattatatcttttaatattttttagctattgactaacatcaacgtagagtcccagtatttctgtaattctgcctttcatttatccgtgtaaataggccaatcaatttcatttgaaaatctgagcaagaaaacactttgaattggtaccagtagaatggtagatcacaacctcagcagtatcaaaaggtctttagaagcaggaaaaaaggtctaattaattgttaagagcaaataaatgtttctattttcaaatacactcctgagtccctaacccccaaagcaaaataagggggggaaaaaaccaaaacctttgattttattttccagagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggtgagttttctttctagctttgtcattggtatgcagagtgcatacacttgcacacatagaaaagtgccaggaatcttcacttagagtcattttatgtctaattgttttctaaaataatctgtttagctccatttgcagattctctctctcttttttttttttgttatctgaaagaagacaatggatgcaatagtatgatgaagaactcatattttaggtgtgaaggagttaatgctgatggtggtatttgacttgttgcatgtgtctccaaggctttgattttatatttcagaatagaatttaagaaaaaagtaggttatttaattttatgattatatgattttttttacatgtgtttggccatattatctacctcaaacatttaagaaagtagggttattggcttggtcatattgggaaaccaattgtttcatcttatttttcatcatcaaatgcagaaattattatttatgctcaccatcatagcaggttagtgagacaattccaattgtcagccatcacctgtaaaagacagtcatgtaaaaatagcagaaattgtagaagagaaaaaggctaaagaactctcataatgactgcagggaggacaaagatgtaaacatctggggtactgtattgtgtcaggataatgcaaatcattggactttcagttctgtattacatttattatgtcacaggtcccttggtttaaaaagtcttctcacatgatcacttctaactcacaatgtgccttcttcagacagatgccaccaagcaaggatttaaagtagatgttgctcagatttgtgggtcttaagtactttcatctctttggttgagcccaaggcaccaaaagctcttaacgtaggcaacgcagtgtgtctgagatcagtgccctcgggagtatgccacttcaggatgaaaaaacaaactgccactcttccattgcttcctgctgccactgcgagccttctagctcttaacaccttttacctatggccatagctccttatctggttggcttccctttagtctctttcccacccttgcaataaatcctccatactgactctacttgtacatcttgccagaaccaagacccatcatggcattcccctttcactggatttctgcatgtagaaaaaaatcaagcttcttagtggggcgttcaaacccttccacaatattctcttgacttgctttttctatgccatcttcttttgttctccctgtgttctggctatgctgttgtagctagtatttctgaatacatcctgctctcatctacctttggggtcaagctcaagcttgagtctcagcctaactgctaacctctaacccaccactgccgtatctgacaaaggaatcccacctatcctccatcacactgctcaaaataactttccccatggagccctgctagatccctgcagttggaagaaatctgtcttttgcctctattcccagagcactttggacctttctcagaaaattccttgacagtttgcctttttatcagttattaccagtgcctctctttaatgagctagtgtgtgtctttggggcatggactgtatcttaatcatcttcatatcctccagagtacttagcatggtttgaatatttaatggctactcaggaaatgtttgctaaaaacctgaaaatacagcaagaacatcacatgagtaccatccacgagataatattgaactttttttgttgttttaatgatagctttatttttggccgtacttttgagatcatttgtcagtgaagaccatggtagagaaaacatttctactttattgagaataatcagtaatatccatttatgttaaatctgtaattattgtaggggtcaaagtcaaatcggaataaaaagttggaactgacactgtaaatagaatttgatgttaccaaggagtaaatatatttttgaagtatatgatcgtgtaatatatcttttgagctcattggtcaagagccctgcctcgtttgtggttagcatagtctttctccgtaccattgcacccgggtcaaagaatgtttgtaaagagtactgataactatcatttatttatcattttatcattttgagtgcacttttacatattttagatcatttaatcttcttacaaacgctatggagaagagactgtcgcctttctgtgaatgagacacaggttcttagaggttcacacagcttgccccagatttcccagtcagccagtggtagaactgaattgaaatccagatttttctgactctaaataggcaactctgccttcaaccagataataaagaagagtaagtctctgtgaatgtcatttacatagaattgcggcatattccccagaatgtgccttaacttgagggactatctatgaggactgagtgtcccggaataaacctgttcatctacttgtggcacagcgataaccgctttaccctggaagatatccaagaccattctccaagaatgggatggtttgttctctaaaagaacaaaaaacataacaccaggcctacttagagctccaaaatgaggactctggggttgatgcaaatctttgtgtaagttaccttgaccttcacgaaatgatcaggatgagcttccttcattgtcccttcattttgtcctatttgaccttctaccaaattccaaagaaatgtctccacagagttcccttcctgaaaacagcccgtgtgttttctttgatctgccctgtcctgtcttcttgcagttctgcgcaaggagcttcagagccctagatttgccttcgctacccttgaattcagtgttgcttaaggagcctttaatttgccatttcctgttgagaaaacccaggaattctttagatgccctctctgtgcatgtctagctggctatgtcctaagtcagcattgggctacgcaatctgacaaatacgagcatacttttagagaaaataagaaagtatatttaaaattgagattgccccaagtcctttggatgtgtacttattgatctgttaatatatatattttatgttcctttagctgtgatttatctccaaataacagcaaaagagagaggcctggagagccccattcctgactagatatttattaaattccattaattgttcttattcatgacacctccctacaaccccctagaaaaacagaggatggctgtttgagaagtgtctcagaggtatcttatctctgcctttagaattccatttctcctggttgttgcacatagtattcaataaatatttgttgaatgcattaatgaataaatgaattgaagctgaatttattttaattgtagcatacatgcatgcacttttgactaaagttcttttacaaacctaatttcgtagagaaaagcctttcaaaggctttgttttctgcttgcttttcaaaattctcccctttttcaaactgccttgattagcaccaggcatggctttgtcataaatttagaatgttaagaacccgttttccaaatcacaggcactgtatgtatcccacattggtgttctctgattcttggttgatgccacagagataaggctaaagctctgagtaaaagctaaatctgactgagtttttcccatagtgcctcccataagtttggatgactaatggtgttagtgagatatctaatctttaatatttcgcttctgcatcatatttctccctcattaccacatataattcagatacatctttatttggcaaagagccactggatcttgggtttttgccccattgtgtgtccttagcattgcagactcaaggtttacttttttttcttgcgttgattaaagccttcagtctcctgacttaagcctgtagtgttcaaatacagagatgtatttgtctctgcactgtctaaataaaccaagacttgctctgaaattcaaggtatgatcctagcaatgaaaaggtagcctttctgagagacaaagacattgtcgttctactacctgcagagcaaattgattagattgttctcaagtcaacaaggtggctaaatattaacctaattcaccataaagtctaaagttaaagttgttagtagatgttatataacacgagggaactctgtagattcttaatacctactcaggacctttcatatgtcttgttgggcagtaagaccttatgaagccaaaatttgagttttctctttttcctttaaattcctccagtgattgtgcaagattattattgttacagtcaaagaagttctagatcagttactgataccactgaattaaagtagctggaaatcatgatcccgttgctttactttgtaattgacttgatgactttggacctagtctagtagctatcaatcttcatagctacgggaaatctttattcaatgttctttcattaggtctttgtgcaagtctccaatgatggtgaaaagatggccaaaatgaagggaatctgaagaggttaggaatgggcattcctatggaatataaacaaaggtgtcagggtgaggaatggcagagtttgtttgagggaaactgcagttgtattaccttttttaagaaggcaaagaatgagaggagatgaggctgaccaggtcagcaagggcaggtcgggaagggtgtggtacccactgcagagttgctgcctccgtgcctagtctagggagcaactcaagggtgtgatccaggagtcaggccatgatattgacatgaatatacgccacacaggcagctgtgcggagggtaactttgaaaagagcgatgctggaacgaggaaatcaagctggggggagtcacatgggagcccaggaaagagatgattagagccttaagtaaggtgatagaaatgaagtagacaggctgatctgagtgatatttcgggggaggatagagctgtttgattcggtagttctgtgggactagggtatgaaggaatgattcccagggctggtaactacaaaacaagatgatagtagttatttgcagctgggactgataattcaggaggagttgcagcaggtccatcctttaatgcagcagtgtttattagaggtccttcctgaagggctgagtagctggaaggtgataaatgaggtatggaagaggtcgagttgaggtcctggtgacatctccatgtgtaaatgtctgacagtctgagagatagaactctgatgcttgtagaaaggatataagcctgagatattaggactgtgagtcgccagctcacaggtggtagttgaaaccgtgagaatgaatttatatatcccgggagcatgtagcagaaggagaacactggatttggtagaactccggaagatgtgaacattaaagtgtgtatttaattacttttatttttagtagagaatacatgtatattattatacaaaatccaaagggttcaaaaagacatatagagaaaagtgaatccttctccaaccttctcccctggctgtggtgtttccagctctggaggctgccatctttcttggtttcttgtgtttccttccaaacatgctctctacatatgcaaatatttgcaaacatatttatggttgttggggttacttcacacagtgtcgtgcagtgttcactctggttttctctttttacttaaaaatctctaattttcacatgctggagaaatgtgccagaagaagaggagggcagagcttgggaatgatgggagcattttcccacaggaggcaggagagagaagggttagggaactaaagtatgggaggaggcgtgaccttgaatgagaggaaggactgcctctgaagacaaagtggtaggtaaggaatttagggtaaggaagggaggaaagaagcataatggaatgaatgttaaaatgtccagtagacatcactggaaataattcaagactgattcctacggctgttcccacatgtttttaaagttggagtggagaggaaagcgtggtatatgatacatttaacgaaactaggcattcaagttacttggtgtattagtccattttcatacggggcaatttacaaagaaaaagaggtttaatggactcacagttccgtgtggctgggaaggcctcacaatcatggcagaaggtgaaggaggaggaaaggcatgtcttacacggtggcaggcaagagagcatgtgcaggagaactgccctttttaaaaccatcagatctcatgagagttactatcacaaaaacagcatgggaaaaccccacccccatgattcagttacctcccactgggttcctcccatgatatgtgcggattatgagagctataattcaagatcagatttgggtggagatccagccaaactatatcatttggtgacatgggccccaaaacaaagggctacagagcccttcttgagacaaagggagctagtttgatcacagaaatcagaaagccaagaccttttatggcaaggatgaataagagctgaagggcatacatgccacatttaagaagctgtgtaagaatggggtcaaccatctcagctctactcaggcagggaggacaggaacatggtagaagtggaatcaccattattcacagactcagtttctaactagcagggccagtgtaactaaatttccttcagtttatccaaagttaattgaagtctgaggggactgattcatagtatgcagttcatggcagtgaatggataacccagaatgaaagtttatttctccctttatcctaattatctctctttttaactgccttgtattaaaatgttatcaaggttgccttaaagcttttttaggaggagacagcatctggtttaagtgcaaatactagatctattaaaatgaggaatatattcattttttcggcacacagcatcctgtgtcttagaatccagtgtcttaggaatcacaataaaaatcaaattgtgttctggtgagcctagaatcttggcatctaaaattggatgtttgtgaggactgcttcatactacaaaaaaattgaagcacccctctggcgattagaatattcacatcttacaagtacagctgccatctccctagaacatgctggataagagtttatgttcttacaatccaatttcccttttttttttttttttttttttagatttttcatgaagaccctcatcctcctgttggccttcatttgccaattgtccctctacagtagaattgattatggtcatgagtttctttagctactttccaggcctgaggatgtaattctgttcaattctgcagatagttactgagtgcttaatgtaattttaaaattatgagactacaaagatgaataagccttggttcttaccctcatggagctcaaaatttattttaaaaaagttaaaatagaaacaactacttatatcctgctgttacaagtgctctgggggcacagaggtgaatgatttattctatcagagggagtagagaggcctttacaaagagagtttaagagttgaagactgaatgggagttttccagtctgagagatgggggaaggatgagttttccagactggtggaccagtgagtaatgtgtggcttggaatgaggagaataagagggcagtgggatggtaggtggggactactgtttaaaggactttgtgcatcatactaaggagtttgggttttatcctataagcaggtgaacagtgatggctttttgacgggggggaggattgagaaaaataactgacctggcagaaagctaaagccatgaagattggtagaagcacagtggaatagtccattaaaagatgccaggttcttaactaaggatgtcttaggcaagtgaagaaggggatggagaaattagaaggtcactgaatgaatgagaccaagggaaaatggagagggggaggcatctggtgttacggaaagttttaatttgggaactgggaaatgatcattgaaaaacaaacaaaagcaacctagtgcacccaggaaaaactcctgatttgcaaagggttagtgcatggagagaaagagctacgtatcagacatactgaattctatttgcccaaggacatttcaagtggaaatttcctatgttgattttacgtattcagttttcagaaaggattctttaaaaagtcatagcaatacaattcctgcaatataaataatagatcaatgaacatcatagggattagcatagttgatttgactaagcttcagattcagtttgagcttccctgtagccagggagataataggaaacaaagatttgtctgtctcttaatattgaattaaagaagcacgcagcatcctaaagaaacatcattgttttcctggctctacgtaataataataataacaaaaatagctgtcctttgagtgattgctatggacaggaactgttctgagtacatatgaactcctatttaatccttaaaacaaccctatgaaagagaggctgtttccagaggattacgtggcacagagtattaaggacacttcatatggccagcaagtaataggacctgtattcaaacttgggtggtggtcctgaactcttaagcagcgttacacttgaagtgattattggctagtgtccttatcaacatttttataacaaatcccaagggaaattatatgtggctgtttctcatggcctttgataattgtggaaagcttaacattaaaacaccaaagatagggtgacagttctccaaggataaaggtcactgttgcctaaaatgtattctgcagaataccactgagatactctgagaaaaaaaggattccaaggacagtaaaactttgaaagcactcatactggaaagtcatcattacgttagcatttgcactgaggagtttggaagtgaagaaacctgattagctttgtctaacctcatgttgctcccacttacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatgggaagatatttctccctctttatcttatgacagaaatgcaggtatagctttcatctcaaagtaagattaaggtataagttacaaagatgtgtagctactatatggtcctgtgtaatgctacttgaggaaggctgttcctttcctggcactgaaattttagagcttgcataatcagtatatcaacctcgtgtggcttggtgcttagcaagtttcagcttctagagcccatggctaatggagccatccaggagaatgttggagagataggtctgaagccttagaagagaagtcttgattaaggagtaatgagttgcgggaaggggtcatggttgtggcggagatggaagcctggggagaggacagagacctcctaggaagagagtttgtgtaagaagaagaccaaggacctcctgatgtacttgattgtaattgggcatgagcagcccagttagaaatggtttcctgttggtattacatatgtacatggatggcttctgcagatggctaaactcacccattttatttttttactatcttaatagttaaaatatgaccttttcttgtgtctccaaattctgagttaccttatggtgctagtctgtctgttgtaactacaagtcataagtaaatccatatgattcttttcctgtaatttcctagtaaatcaaggcgataatttcaaagataaaaatctgtatttttagctttagcagtgagcatgattcccagtctttttgccttcgagtaaggtttgttaccatggtggaagtaaacaatatcccacactctagaatgtgagctcttcaagggtaagggacagtgtcctacatatatctttatctccacagcactgggtacataaatgtgtcataaaaatgaatgggtaaatatcctttggagtttttctgttacttgatgggtttttggggttgattttcaggtatctcccttgtttttctcatttcttacattattttctttcccaaaatcccttaatatacctgtttagtttgtgatgtcattttccattagactgaaaccatccaagttgtttaggctaacccagacttaagcattttctgggcttatttttggactctttttaaaactcatcatctgaaaatatttaatgtccacacggataattctgaagacatgtgcataccatttttcttttatgtacatgggttaaaccttgatttttccatagtaggagaaagcattataagattttattgttttcactggggtaatatcttttgtgctataagaaataaaattttgaatctagaacttagttttttataagacctttattgagatataattctcgtaccataggagttacccatttacagtgtattagtcactgattattagttaataggttaaccagtattagtaatcactggttattaattacagagttgtgcaaccatcagcgcacaattttagaacatttttatcaccccccaaaagaaatcccatccccattttcaagtcactcctcgtttctcctgcaactactcttttcagccctagcagtagacaatccctgatctactttctgtctctatggatttgcttattctggactgttaatgtaaatgaaataatacaatataaagtcttttgtgactggcttctttcacatagcgtaatcttttaaaatggtatctatattatagcccgtattagtatttcattctttctttaatgctgagtaacatttcattgtatggatataccacattttttaatctattcattacttgatggacatttgggctatttctacttattgtctgttatggataatgcagctatgaacattcatgtacaagtaccggtaattattttaaagaagttattctgggctgggcatggtggctcacacctgtaaacccaacactttggcaggctgaggtgggaggatcacttgagaccaagaatttgagaccagcctgggcaacatggggagataccgtctctacaatttttttttttaattagccaggcatggtggctcatgcctgtagtcccaactactcaagaggctggggctggaggatcacttgagcccaggaattcaaggttacagtgagctatgattacaccactgcactccagcctgggtgacagagcaaggccctgtctcaaaaaaagaaaaaaaaaaaaaagattctatagtttctgtcattgtaatagaggaggccataggatcatatatggcaagagtatatagcagtgcatgccagggagtgaaaaataggccatcaaattgaagttactgggagaacttaagactaagtctaactacgcatgagggattgaagccgggacacacaaagcttaaaattatgattcttctagagactgttacggctttttgctgaccacagacaatgaaagtttgatattttgctgtatttgtctgaaaatggaaacacacttttcccaatggcagtattcctgaggactagagttcttcacctctaaaacctctccaatcctagtttttccttttggctgatgatgaccagccactgccatttttgtcttaggttttgttagtctgtcttatttccagttataagtggttaaaatttcttatgaattcttcttgtgttgaacttttgattaatacatttagtctatagacagtaatgaattagcatctgatcaggaatttgtgaaaaacatctcagtcattaaagattaagaaactgaagccaattaatattgtcatgttctgtctcttggaacttgagcaagatacagatctacgtgtcaatgacatatccagaaaatagactccacctagatacattaaccctgtacccttggtccacatattttatttcagcaatgatccatggacatattataatttgacagtttcatcacatacctagcgtattgggtcaaatcaaggaaatctcatcctagtgatcttaactcagtgatttcattttgcccagatgttcagctgtgataaactttactaaggcacagatgatggatgatacacaataattccaaaatttgggggtggctacaatgtggctaggggctagaactcaggtatctacaggacaaatactgagtgattagtcactttctaagcgctagatatgcatatgttctgccaagctcagtaggtctaagtagattgcttccatttcagataattaagtgctttctttttataggaagtttttagcacatctgaggttctaaatccaaaaagtaaataatatatagagaaagaagtaataacaataataatagtaaccaacatttattgaacacagtatgggctgggcatggttcaaagaaagtttgacatatagaatgtcgaccatactggcttaataatcctcataactgaattagtgcttaagtcagttgcccagcctcagcaagcagcagaggcaagtaagtcataaatcaagatcttctgaatccaagaccatctctcaagccttgttctaattctctcctcagccatggatggtgaaaggcaccacaaaggcagcgtgtcaaaaagtggcattgttcaacctttcccctgatggggcaaagcttttatttttttcctttacgttctttgacatctgttttaaaatgcagatatcactagaagaaatgacaactttattataaaatcccagtaaaatgtaaatgtcttatataaaacctttatactgagcaaatttcagtaggaaagggcttggaagtaaggctctgaatgttttaaagggggacagtgctaagaaatgattagaaacaagagcctggaggggtcctgccatttttactgttttgcttaaggctgacctaaaatatgcatagtcttacttctcaccctgtgagcttatccttattaatgtctttttccacctagtttaggggtatttttgaatttgtgtttgataaagatgtctaaagctgtactgtaaaattttattgtcacttttttttttaaatggagtctccctctgttacccagcttggagtgcagtggcatgatcatggctcactgcagcctcaacctcccagactcaagcggtcctcccaccccagcctcctcctcctgagtagctgagactacaggcatgtgtcacgacatatggctaatttttttcaatttttttgtaaagatggtgggggtgtctccctatgttgcccaggctggtcttgaactcctgagctcaagtgatcctcccacctcaacctcccaaagtgctgggattacaggtgtgagccattgcactgagctttattgtaatttcaagggctcaatgcaatttccagtttttaaagttcatcttgcttgcagaatttgtctttcatttaaaaaaaaactgctgattggctacatttatagctgctgtaatagttctgtatgatttactacatttgcctgaatttagattggtggatatgatttagctgcttttaatattatatgagggtaaagccagatttctttggatctattccttttagatggcaatctttgtagttgttctactttacaaaataatccctgtgtgtgctcatgctttggtatacagttaaatgtatgatactgttaagaaaacattgatcactggaaagtgaccttcatttctttatttcataaatatcattatacaactatataactacacgtagtagggaagctccatttaaagagtagatgacttacactgaaatcatttgacctttgtaaattagtttaaattacacagagattgttgtaatgttctttatcatacataatagttacgattgctagagaggcactcataaatcattgctaaaagggccagctgctttcatgttttcagcaggttgagttaagggaacaagccttgccaatttgattaatctcttatgtccattagttggttgggaagtttttttgagtgtaaatttgtatgtagacaacagagtttatattctttatgacataaaattaatcagatatatctacatatttgtagaatggggggattcttagctctatagagaataagaaatactggatggaagactttttttaggatgactggctacaggaagaaattgtagtgacagaagccatgtgtattgaatttgaattaatgttccttagggagctaccagagaaatataatttacaagataatcaagaacgtaaatagattctctgtggagtcgttgtctgatcactgacatatattcatctgtattgaaatgacttcatgactacattctaacaattagagaatcattaggggtgagatgtacgtgtataccttcaagaaaagcaaaatatgtattggtaataattgacagctgttaaaacgagtgcattgtgtacttgttaaacattagaggctgggcatgttggctcacacctgtaatcccagcactttgggaggccgaggcaggcggatcacgaggtcaggagatggagaccatcctggctaacacggtgaaaccctgtctctactaaaaatacaaaaaaaaaaagccgggcgtggtggcgggcacctgtagtcccagtgactctggaggctgaggcaggagaatgtgaacccaggaggcagagcttgcagtgagctgagatcgcaccactgcactccagcatgggcgacagagcgagattccgtctcaaaaaataaaaaataaaaaaataaaaaaaaaacattagaataacttaccttggaacagtaactctgagggaaccttgatcatttatgagaatgatctcccctacgttaatactgcatcaaaactaacattatggtatacctcaaaaagtattggcatagatgtttttaaatataagaaaattcaaatgcgtaattgataagggctaaatggctcaatttcccaacccctaacaaaaatatgccctaacacagctctgtgactatgactgcatttattagaaaacatttagtaaaaatcatctctagttcaaaccctccagcatcagttcttcttgataattctcatgaacatttagaaataccttaaaagagaattcagactcaaatcaaaaaaccttatttcatttggttgcaggccaagatacctcttttaaccatttctggcttttagaatccttatcatgacagcttgtcctatctcagagcttcaggaggaaaaactagtccctcaaaatcaagtttgctattgagcttaataagaggtttctgtatgtcatatgtttgtttagaagaaaagcacttgttcgactcatttaatcctggcctgatgaattaaggcttgaattaatactgagggaaccttgactatacatctacaaaatcaatgtgtcctggtaggcttctgattaagataacattagctcttgcttgaaggcatctttctctgctcctaccatttatccagtggtagataatatatggagtgaaaaatgaaaaagacatagctgggctttaaagcaagatgaacatctctgtgaaccagaaatgtgaaagaaaaaaaaaaaagtaagtggggctaaattagtgggctttcagctcgtgctgtagtaacagggattaaaattctccttacaaggtagtggcccaaagccaggattactatttgaaatcagagccccacaaaaacacacctagagagagacacatacacacttacacttaaaagcaacatgaaaagaaacagtttgctgcaagggtctacagcttatatgcagctatggccctaatgcatagagccgagggaagaggcaaagattcgcagttgggaaagagagcatcacagccttgaaaccaggacctgaaccaatctacctactgcctggcaatgaaatgagtgatatctctgtatcactcagtgtaggagctgcaaactaccaacagatgtggctctaaactctaagcccctgggtatggctgggagaagccataaaaccacctgagagagagataatgagtttaaaaagagaggaaaatattaaagtacacacacatgagaataatagaaaacatacacatgcatatgtatgcacatgcaaaacatcccttgcaaaatttgtctccaaatcacgatccaaaatacatgaagaaatgggatagcaccccccacccaagttaaacatcaaaaagtgaattaggctgggaacagtggctcacacctgtaatcctatcactttgggaggccaaggtgggaggactgcttgtgcccaggtgtttgagactagccagggcaatgtagtgaggtgccatctttacaaaaaataatttaaaatatattagccaggagtggtggtacatgcctgtagtcccaactactcaggaggctgagataggaggatcgcttgagcccaggaggatgaggctgcattgagccataattgtgccactgcactccatcctgggcaacagagtgagaccctatctcaaaaaaaaaaaaagatgaattaattctagaagaaagcaaaataatacactagtacaacaaagatttttacttacatttaagatgctcagaccaggtgcagtggctcacgcctgtaatcccagcactctgggaggctgagatgggtggatcacctgaggtcaggagttcaagaacagcctgcccaacatggtgaaaccctgcctctactaaaaatacaaaaattagctgggcatggtggcaggcacctgtaatcccagctactcaggaggctgaggcaggagagtcgcttgaacccaggaggtggtggttgcagtgagcggagatcgtgccactgcaccccagcctccatctcaaaaaaaaaaaaaaagatgcttaaaggcataaataaggggtaccactcgctaaaataacaagaaactaagaaacagagatggatgaaatgtaactaggtctgaaaacaaagatatctttgccaaaaaaactagtcattgaagttactaaactcaatatacaggataaattctagactttgtcctgtcagagaaggcaagggaattagaagatgatgctgagaatgttactgtgtacaacactcacagaaaaagataagaaatataaatgagcaattaggagaaatggagaattgaccacaggctctacaatataccttactagaatttagaggtttgtttaggagtgtatttgagaggtttcagaagaaaatggaggaaatggtagagaagtaatatttgaagctgtcatagctgagaatcttccagaattgaagaaggatgtgagtcttgaaggaaatgtgctcccaagagaaatttcaaacatctgggaaggaaagaaaggcctgcattgagcaattgatattctttacagctcagctttggctgattaaaatgagccttttctgttttcactggaaaccaccaaaacagaaatgtaatgtgttgtatataccaaaccatgcctcttgaacaagggtccttataaataaatcataaaagaagagccctgtggacaactaaacccacaggatcaagataccaaggaagatctctctagaaaaggcagtctcctgtcagcacctttgtgaaaaataggtgggaagacagtaatggcttgttgtaccatcttgaggtccatgtctaaaaactgttttcaaaaggaacaccatggctgccccaatctggtagaaagaaaaatttgaataggattctacataaaaagtgttgccagttagaacattttgttgaagttttcttttaatgaagagggaaaaatagaaagtaattcctatggaatgagaccttgtgaacattggatactgcttcaagttcacagaaacattgaactgattgccagttaagttctcagaaattagatttaattaatgtggacagttacatacatcggtgcacacccagaagacccgtgtgcagaatctgactgaaggtgtacttacttcgatgaatctcttctcatcactgctttgtcaaagcagattgctatgaaataaactatacaaacaactacccttgaaggctgatagcaataggatttcaatcagtacagataggagattctatttctgtagatgaaaaagatcatacattgattttctgtgtgactttaaataaattcctggaaaccttgtaatgttaggtactaggtagaatgaaaaaaatgaagcaaaacaaaacaaagaaaaaaaccagagtagattgggttttctttctgcttccatgtggagatctagccttttgaaactgagcattttggaagacatgccgtcccctgtggaatgttcattccgagtatgggacaacagaaaatatttagcagacctggtgatgagatgatcttgctttctcaaactggacaatgggaaaactcttcttggctactcactacttacatttcatctcttttctcattgatatagatctcccacatttgtggataggaatttctctcacctgatgaaatatcatctgtgaacaacagaaatctgtcatcttattttggtatttatcacaactagaagaaagatgtcaagagttctaatcagtcactggatatcaaatatcagaaatgtcctcaattggaattgtattctcagtaaatcctaaagcatttgggaccttcacatgtgctaatactgtttatatttatttggaaattaaccaaatataaccaaaagacagtggaataaccatagaaacctttaaatggaataaaatttatggcaatcaacattattaggaagaaaaagtatactacctagaaacagtgcaagaacaacgaggatcttctgtgcatctaactatataggtctagaaatatataaagtgaattatgatagaattaaaaggagaaactaacaaatccataattatatctcaacactcatctaacaaaaattgatagctacaaataatcaaaaattaataaagatatggacaattttaacaacaaaatcagcacactatgtatttagagactccatctttccaatggaaaaatacacattatttcaagtactcaatgaacatttttagaaagtgactgtgaactaggtcacaaaaagaagtattgctaaatttcaaaggatcagtatcatacaggggttctctgattgaaacgcaattaaattagaaatgcactaagaagtgaaaatggaaatataaccactgtgctcctaaatgactatgggttaagttaaaagaaatcacagtaagaattacaaaacataaggcactgaattgaatcaggtgatgtatataaaaacttttggtatataattaaagtggtaccaaggaggaaatgtataaccctaaatgtgttcattaaaaataaaaaatcaatgacttattcaacctgtaaagcaagaggaaaaaaaagagtaacaagtaaaacattattaatggacataaaatgagaccatagtaagtaaggagcttcactgcattcttggatgtgaagactcaattattatgaacttagttcttcccagtttaacctatgaattcaatgtaattcaaactcaaaatttcaacaagcattttcataaaatcagaaaaccaaacactaaaatcatggagaagatcaaaggggtcagaatagtcaagacaattttgaggaaaaacaaagtgggctgagaaggcctatcagacatcaattgatttaaagctggagtgtgggatctaccagggatatgcagatagaaccacagactagaatacagagctcagaagcacacctgtatatttatggacacttgatgttttgcggaagcatcgttagagatcagtgggaaatagatggaccatacaatgaatgaggctggcttcatagtttatccatgggggaaaagtaaaattagatcgcatgttcacggcaagcacaaaaatagattctgggtaaattcaagtcctaaatgtgaaaaaccaaattttaaactttaaaatgtaggtgtaagaaaagattttcgtgaacaaaacataaaaagcagagaacatacagggatatgttaaaatttacatcttttataccataggatgccataagcaaagttaaagataagctacactaagataagggtagaagatcatatttgccatgcacataactaacaatggattagcatctagaacatatccaaaggtttaaaaagaaaaagacaatccagcaggaaaatgggtaaaggaagcatgaaaagccagttaacatggaagaagtctaaccttgccagtaatccgggatgtatgtgcaaattaaaatgcacccatcaggttaactaaaacttgaatgtctgataacaccaagtatttggtgaggaggtgggccaaatggaaaacctcattcactactgaagcgagagtaaattggtaaaagcaccgatttgtcacccagagcgattcggtgacatgtagcaatgttgaagatgttgctaagatccaacaattccacatcaaactatattctgtaaagaatctcttcaacaggtatccaaggagataggtataaaaaagaatttcattgtatcattgtttataatagtgaaaagttggaaacaacctaaatgtccatggacaggaaaatgttggcatattcaagcaacagaataataataccttatggcagttaaaatagcaaactattatgtatcgacctggagaaatctccaaaatggtgttgaaggcaaaaagcaactcttagaatggtatgtatattcttaaatgtgaagttcttaaatttaaagtttaaaaacatgcaaaataatgttattagattgaatcacataaaatgggtgtttttgtaggtgaaagaaaaatacaggcaaacatcagcatcttttttaagctcaacctagtatttgttgatacattcatggtaacactgggcatgaaattcagtgtggcattatctccttgagggcagcggggaggagagaatggtatggtgttgaggcgggcatgtgagggagcttctgctttggctgttaacttttctttcttcaaaaaacttttgaagaaaatatggcaaatgataaacttatcaaggggaggtgataggaacatgggtatacttactccattcttatacatttctgttgaaaatatttgctaatgtttagagcaaaccaaagtgttgatagaggtataaaatttttaatctcatgacattataaagaaatatttacaaagtgattaaatcctttgctgcttacttatctgaacataccagtcgcgaggcttttagtgtaacataaaaaattgaaaagcatggctcccttcacacaccaggcaaaagcttcaaattttgttttgttcttttagcactggtaagattgtcatcattaaaaccattcattagtgcctcttttgcttgctgttcttcggtggcagtcagatgcatctatctaccatggtatataaaatttggtgatgatattcaaattactttttttcttctttttctttttctttctttttttttcttttttacttttttgatgccaataggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaagtgaggagagagatgggatttttacaaacattcatttttccctcttaaacaaaactaaacctcagagagcactttttataggtgcaacaagcatcaattcttaagtgcttggtatgtgcctgcaaagtgatagtatcaaaggatagaagtagaggagatagaaaaactagtgtgtcttttttgtatttgtccaatattgtttcctaccaaaatggttttttcttgaccaatttgaaatacatcttggggaaaaaaacgcctaaaggtttccactagttctctaaaagtgaatatttcacttcttgaaatggaactatttcatttacaattagttatattttctggtatacctttgtgttttttttctcctaatccctaacacatagttctttaagcctccatcgaaaacctagcaagatactgcattgtaagaggacctacctggacatagttctggctttctgggaattttaaatttttcaattatgttctctctatcttgttacttaatacttcacaaagatatgaatcttccattacagttttgagatctcacatagtctcatcattcacacatgaccttctaaatcttccagttatttaatgtaatgatgtatagtctcattccagtgtagctctgatttttttctcaaatttataagggagcacaattcagatacaaagacagtttctatggattatatcaacagtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggcgaaaaaagtctaaaaagaaaattctaaaaaggtgtattctggcagctctatctggcccacagaaaacttgtataggtgagaagaccagttaggaggcaattgccaaggccaagattggtgagttctgagggcctgcacttgagagatgtgggaggagaggactgtgagactattctataaaaatagacttgccagggggctgggcgtggaggctcacgcctgtaatcccagcactttgggagggtgaggtgggcggatcacaaggttaggagttgaagaccagcccggccaatatggtgaaaccctgtctctactaaaaatagaaaaattagccaggcatggtggtgggcgcctatagtcccagctactcgggaggatgaggcaggagaatcgcttgagcccaggaggcggaggttgcagtgagccaagatggcaccattgcactccagcctgggcgacagagcaagactgtgtctcaaaaaaaaaaaaaaaaaatagagttcccagggtctggggactgagtgcaaattgtaagaagaggaatgaagggagaggatttggttggaagaagatagtgaaacttctgattgtggacataatgtgtttgagaaattgacaggtcttctaagtcatgtcccaaaagaaattaagatacagatctatacttgaagtaagtgggcaaactggagagatttgagaatgagtttcatagaattgattgctgaagggtgtgagatgagaaatctataaaatctataacacaggtgcttcgatccagtgccttggaaaagacctccatttgggtaatgggatagtaaaggatggataagtagggaggttcaaggaagatgtgacaaaaaggtgaaatgctaaagagagctcaatggaaattaaaataaatcacagtccattgggtcactataaatgcattgggtaattttgagaaaccattttaggccaagagaagggaaggtggaaaacttctgtttcaatgaaatgaaagactaggtaatcttaaaatgaatgaggattaaggaaagtgaagacaattttgaaacattaccaagtaagaaggaagccttaggcaaaagttggatgaatttgttgaggaaatggtccacatgttctgttctcattcttagcaatgttctctgcctaggactaggttctaagaaaggtggagctgatgaggcataaatgatcaaaggtcaaaacaagagtagggcattttacagtggtaatgaatggctaggacaggggttcctagccagctgctcattggtttttcctgctgtgtctggctagacaatagagggttttatgaaggccacaaatacttggtcccccttcctcatttctctttctctgtaaaggcccagtaggagtcagctccatcctctctccttacttttccctgggacctaaactggttatatacttggtcctctcaaatcttacctcacagaatagaaaagacctgtgactccttgattccatacacttacagctctattgcctgatatgatgatgtgttcaggaattcatttcatacttgagctcttccatgagggtagaataaagggaggcaaagtgccttaaccaaaatggataggacagaaaggaaaagtcaggggtgtgggtgagttttatggcgaaaaatttggagatcacagtcgggaaaattcaaaagttggatatcatggaagtaaaatactttcaagcaatttctacatctaacatggtgcctcccagcgagctgctgaagattttacttggagatcactgaggggtagggagtacagttcatggagttgatgagaccaacgttgctgagcttatcagcagaggggtgaggtccagatcctgacgacagtggtagatcaggatggaaaagatgttgaagaagatggacgagggctctgaggagatgaacatttctgaggaaagagacagggtagttgaaataaatgtgatgaagttcaagaacctggagcagtgggaagaggcacatcctcctctggagaagccaaatcttgtaggaaagccaggttttgatttttttgagaaggaaaaggatatgtttgaggttattttcctgaatttactacacctccatgatttaaggcaatctctgtgtcagattatctccctccacctgagatctgaatatagctaataaactgttgggattgtaaatgacaacacactacatgaaaaacaactgtatgcatttgcaaagtctgtaaattctgaaaacaactgagctttagtacctcttatttttttctacttcaggattttcccccttttttaagtaagtaaagcatatgaaactaagttacatattttagtggtgagattcagagccctgggtgcttagaagcattaataattatttaggtcgttgacaatggcgaataggcagcatactcgttaaagcactcaaattaaagtgcacattaggatgtggtcctgatgatctgtggagctaaaaagatcatggtagaactgaataccaggacaaaagtgctatattccaatggctaagctaagagataacttgctggcataaaatggataagctgtgttaaatttgtcctctgaaagaaaagactgaattcaagggtactttttcttgaactgtgtattaatctgttttcacactgctataaagaactacctgagactgggtaatttatgaagaaagaggtttattgactcagttccacaaggctggggaggcctcaggaaacttacaatcatgggggaaggtgaaggggaagcaaggcatgtgctacatagcggcaggagagagaaagcgaggggagaactgccacacttttaaaccatcagatcttatgcgaactcactatcatgagaacagcatgggggaaaccgccgccatgatccagtcacctcccaccggacccctcccgcagcacatggggattacaattcaacatgagatttggatggggacacagaaccaaaccatatcgaactgcataagctaacttcatttaaaaaggaaaaaagccttaccgtcttcttgaaggatgcacacaggtgtttaaataaatgcagtgtatatacttgggctttgaaggtttgagatacaaggctgggatctgctgaaccacattctggatagagctgcattctttaaatatgcaaccccgatgactgattttcttttaagtgaaacatgagacaagtcatattaggtgatgtgtctaaagagtcaacatatttcctcaagccatgaaatacttatcactgagtctctatgtaccatttgtattctgtacagttcttactgagacaatgtgctaatgaaacgtacattctattggaggaagcaaatacagaacaaaatagcaattaacaatgtttatcccctattggctctcatgggctccatatacaaatctgtgatgtccagacaactccttatctctgatgactcctaactttccaccagattactgttttttgaagcattttatattttattgatttaaaaattaaactgttcctttgctttttaaaaaatttatcatgtacatttgaggtttatgacataatggctccctagctttttatttagaacaatttcaaacttatggcaaaactgcaattaattcaacagtttgccacatttgctttatagctatttatttatgtacttttacattcatgtgttgttaaatggattgcatatatttagattaacatgtatatctgtatgttaacatatttttatatactgtatatgtttatattttatgtgcatatttaatcatattcatgcgtgtatatagtttgtggatttttttttcactgatccacccaatggttaggtttcatacataacacttcacccctaaacacttgaacacgtgccttctaaaatgaaagatattcttgcataagcacaattatcatgctcaaaaagaacaatactgttatataatgtagaatttaaattcaaatacctccaattctgccaattaatattcttcatagcgatattttacattcaggatcagtgatgtccctgtagtctcctttaatctgaagcacttttccagcctctttaaatctttcatgacattgatatattagaagaggtcgggctagatgttttgtagaatgtcccccaatttgaatttgtctgcttgtatccaagtgattgggttcgggttaaatgttttatgccagattaccatataggtaaggtatcctcagtacatcacatcaaggttttcctcaagattctccatccccttcaccgttcttcactctccctgggcgctccttccatactttggcttctgctatgctgacaactcttaagtcaagatttccagcccagacctcccacctgagcatcttctggataaaattataaataaaaatatagcctaatctgaaatcatgatcaacctttggagcatctcttccaatttcccaatctatacaaagtcattttctaccccttcttcctttacctgccttccttagctatgttccaccaccatcaatccagtcaccaaggtcagtgtgttttgctacttatgaaaaagagcaaaattcttcaattcagctacttctgcccaaatttagccctcatcatgtgttacctgaacagacaatatgaatactttcctaattggttcctctgcctttggtctctctccctttctaagctatcttccagaaacttcagttcctcttctaccattcaaattatatcatattattcccctctttaagcattttatgccttctgtttgacaacagaataaatgtgctctttggccttgagtacattatgttcttaacctgaaatatagcatcctttcttttcactcagtgagttttcttttggaacttaatcatgcattatatcattctggttttgttgttgttgttgttgttgttgttgttgttgtttcttttgtgtgagacggagtctcgctttattgcccaggctggagtgcagtggtgcgatctcagctcattgcaacctccacctcctgggttcaagcgattctcctgcctcaccctcctgagtagctgggattacaggctcgccaccatgcctggctactttttcttgtatttttagtagagacagggtttcaccatgttggccaggctgttcttgaactcccaacctcaagcaatccacccgcctcagcctcccaaagtgctgggattaaaggcatgagccaccacacccagccatgttttcagccagttactagtacttctttcttctgcctacaactccctagaacttaagctccttaaggacaggatgtaagtcttgctcattgtcgttactgtatgaggatactctgtgcaacaaacaatcagtaaagtgcttgttgagttaatattttagaaatcaagcataatacattcttgtgtacacatggaacagcccacacgtttaggaaatttagctactagtttcagtatctttcaccaccattcacaactgatcagctaataatcagcaacaacattgtacaccataatatgttaaaggtgttacacacagaatttatgtgtgaaattgaaagcatcggtcctatatcatatggaaaaaaattaattgtagccaaatgttgggtattggatacatcagtgtgctttttcttctaaaaaatactggagaaaggcaggaaatacacaagtactaagataataacacatcaagtcggaaactggttaaaatccaaagaaaaatgttggtgggcgtatttgttcatacacagccccctttatgagaaaaaataatttcttgtacacagctcctttttaaaaaaaagagaaaataatttgtttagattcagacaaaaacacaggagtaattcttgtgtctattctgcataggctgcgtaggttctggctaaaatcactttttaagcagatagaaccattatcagcgtttgaatcaaagggaagtgagtcagatgggatatcttcccttcaagaaagggatctgaaaccatcgttatatttcagaagactgaagaatatcttgccatggcaaagcattccttttcttttttctcggattaaattgagtcatcccacttcttttttcttcacttcagcagtgattaaaggagactatcatattttgctatatcacggtactatttaactttgactatgtctttccttattttaaaaaatgtttcagtgatttatttggaccacaatcagacaagccaggaagaccaaatagctaataatccaaaaaacattatttttctctttttattatttcagtagttttcagggaacccaggtggtgtttggttacatgaataagttcttcggtggtgatttctgacatttgggtgcatccatcacctgagcagtgtacactgtacccaacgtgtagtcttttatccttcacccccctcccacccttccccccaagtccccagagtccatggtatcattctcatgcctttgcatccgcatagcttagctcccacttataagtgagaaagtacaatgtttggttgtctattcctgagttactttacttagagtaatggtctccaactccatccaggttgctgtgaatgccattatttcattcctttcatgactaatattccatggcgtgtgtgtgtgtgtgtgtgtgtgtgtgtgtgtgtatataaacaccacgtacatactgcattttctttatccactcgttggttgatgggcatttaagctagttccgtatttctgcaattatgaattgcgctgctataatcttggtatgcaagtatatttttcacataatgacttcctttcctttgggtagatatccagtagtgggactgctggatcaaatggtagttctacattttagttctttaaggagcctccatagtgttttccatagtggttgtcctagtttacattcccaccagcagtgtaaaagtgttctgttttcaccacatccacactgacatctattatttatgcatgtttgtggaaatcaccttggagtagagtcaagtttaagtgttaaagcattgccatcaactaagtttaaaatcccccaaagactagcaatatgctatttgagcaggcaatgaatctgtgaagtagggataagggctgtgcaggtctctagtgtgcaactggaactcagtattttcttgttgaataagtgaaaaaagtgaaaaggtgtttttgtttttggtgatgaggggcttgtgatgacaggtattattgttagagtcagaaatattttgaggttgcctattaatatggtttggctctgtgttcccacctaaatctcatctcaaattgtaatccccacgtgtcaggggagggacctgatgggaggtgactggatcatgaagaagttttcccccatgctgttctcgtgatagtgagtgagttctcaggagagctgatggtttttaaagtgtgtggcacttcccccttctctctctctctctctctctctctctctctctctctctctctctctctctctctctctctctcctgctgccatgtaagaggtgccttgcttcccctttgccttccaccatgattctaaacttataatcatgaggcctcctgaggcctcctcacgcatctggaactgtgagtcaattaaacctctttcctttataaattacccagtctcaggtagtatctctatagcagtgtgaaaatggattaatacacctattatgttgtagctacatagtgtatgattagacaagccataaatattatatctggcttgtttcatgcccataatagtgtatcagtcagctgttgctgcataacaaataaccacaaaattctcaagttgcatatttctcattcacgcatctgttgtttggctgaacttttgctggcaatcagctggacttgacaccaagttgtggtttgggttcaggtctgttcaacatgtctctcatccttcttgggctagcaagctacctgggccatatgcttcttgtgcacataaacacaagcgggcaaccccaaccagtcaaagacattctaagcctctacttttgtcatgcccgcttacattccattttccaaagcaggttatgtggccaaatccgaatccccaggccagggaagtactgttttcccagctcttgttcactctgctttatctacattagacttcttgctgtgcttgaggaagccagtcacactctcctctcagagtctttgcatttgccaatccttctgtctggagcacttttccctcaaatacttgtgcaactcataccctccagttcttaaagcttttgctcaactgcatctcatcaatgaggacttccaagactccactttctgatgactctcattgtcccttgctagccctctcctcagagtgttcatcaccactcaagatacctatatagtttacttatttacttgttaagcctgtgtgcctccttatgaatgcgagtttcacagagagagtgtgtgggtggggtttgtttgcttattgctatatcttcagtgaacaatatgccaggcactgttcaaccatttgaacagtgcctggcatatatagttggattttaataaatatttgaataaataaatgaatcttactgtttttaaacttttgtggtttttaaaaggcattttaaaaatctgggttagtatcaaatattacaatggtattactttaacttcaggtttcatttagctgttttaacttttacaatatattctgacacagaaaatattaggcattaagcatttttcaatgagttgattcacttctactcatgcacatatgtgatgtctgatttcgattcttaaaaagagatgagcctgggcgtggtggctcacgcctgtaatcccagcactttgggaggccgaggcaggtggatcacgaggtcaggagattgagactattctggctaacacggtgaaaccctgtctctactaaaaaatataaaaaattagccaggcgtggtggcacgcgcctgtagtcccagctactcaggaggctgaggcaggagaatcacttgaacccggaaggcagaggttgcagctagccgagattccaccactgcactccagcctgggtgacagagcaagactccatctcaaaaaaaaagaaaaagagaaaaaaagcaatgcattaaaaccatcttgagaaatcatgaaaatatggagaaaagaagaaaacaagattatactctacttgtttttatactacctagaatgtaataggcactcaaaaaaatgtctgaatggatacaattatcactgccttaaaagttttccattaaagcaaagaagccaattttacatttgtattatacttggacactcatattaaagactcacagagagtttatctggaaaaataaacttggctgacatcattaggtttatactttataatttgatctttgaaataattcaggaacaggaatgccagtcacttcattgaactgtacctgaattttaacacagtacaattgagttcctagagctccaatatgatgtaattaaactgtcagaaatattaacatcgatgttcatgagcgtcgttcatgatgttctcttggttctgatttattcagtgaggcatactgtcactgaagtggacttactgccattaaaaatgcctcatgtttcccagttccgcaaaaatttgcatcagtaatgaaacagagagatgtaatcagccctgcagttgtcaggatcttgatcctcttggtagtatttcattcatttcatcttcaccagataatggtagtttaaaaccgcaagaaaaatgaaactaaaaatagtgaatttcacttctttttctaaaggcataaacttaagcaaatagtgcatgtgtgtgaggggggaggaagagagagagaaagaggagagagagagtttgtaactattccttttctgctttgtgaccttaattcttcagcacccatttcctgtacttaatattgcaaagaggtttcctgtggtatgttaccaggagactcatgtagtctgaggctttttatctaccttacgttcttatccctccattctaataaaaatatgaagcctcacatccacctagaatatgattttgtcttaatggttagcattggcaatgattcttttagcttctgctgttaaaaaaaaaaaaaggaataaatgcaggattctaatcaaacatgaaaatccaagtggcatagaccaaagggaatgagaagcatatttaagtcatttagtcactggcttccgaagcagttccaagtcagatgtaaacctgaggttgtccctaattaagttcattatggttgacttgctaaagcaaggtcttgttttagatggaagtgacaatgtgcaaaacaaacagagcttgaatagaagttattttcactattggaagattgtatattatgaaaagttagtttcaaaggacctttaaagtttaattttgtttgcacctaagaaatttccctttaacttgcaaatgctgtttgaagtgtatttctttaacacatgaacaaacaatacagacacagattcacaaaatctacaaggagatttccattcccagtgaatatcatccatccataggtttctttgcttccagatcatcattctctcctcacataaacagtcaaaatgtttgtaatgtcttctttataaaacccaaaacataattatgataaagtagtcccaagtaacagaggaaaggaccataactctccaatatatgccatatctacagtttttagaatattcatatttcattacctatataggatatatactatttttatttctattacattggagtttaaaggtacttgagtttcgtttgtatttttggttaaatgtcaaaacaaagagtgaaaaaaagacctcagtgtctcaactcccttcttaccttcatgaagtgactgcaaagtgttcaattcttactcttttgtgttgaggagacagcactgcaagtgtgcagtaatacttattttattacatagaacaaagtttcacatttgtgaatggggcacaaaagagagcttgtcagttttacctttttcaattgactttttcttttattctttttaacttttaaatttattttttgtttttttgtttttttgtttttaaatagagacagggtctcactatgttgcccaagctgctctcaaattcctggcagcaaacaatcctcccacctcggcttcccaaagggctgggattacaggcatgagcgaccgcacccagcctgttttttactgtagtataatatttgtacatatttatggagtgcatttgatattttgttgcatacacagaatgtgttaatgatcaagtcagggtatttagagtattcattatctcatgtatttatcatttctatgtgcggggcacatttcaagtaactagtcaacttttaaaaagatacgcagtaggctgggcgtgttggctcacgcctgtaatcccagcactttgggaggctgaggtgggcagatcatgaggtcaggagttcgagaccagcctggccaatatggtgaaaccctgtctctactaaaaatacaaaaattagctggacgtgttggcgcatgcctgtagtcccagctactcgggaggctgaggcagaagaatcgtttgaacctgggaggcggaggttgcagtgagccaagatcgtgccactgcactccagcctgggtgacagagcaagactccatctcaaaaaaaaaaaaaaaaaaagatatacagtttttttttctccaagggtaatgatatagataaactactgtatggatttcttcttccctttaaagaattacttcctcattattaagcttgagggttttctttgttatttatgagcaagtgaaatgaatttataatggtgttaaaaatgtaatcatggccctttaatatctgttttctataaatgtaattttccattatttgtttttgcttttattaaggtgaggaagatcttctcagtcctccccaggacacaagcacagggttagaggaggtgatggagcaactcaacaactccttccctagttcaagaggtaagctccaatacctagaagggactcagatttgctgggatcaggccactcgcttccctacccaactggtgtgtgtattttccatatggaagccaacacgcagtatcagaatggcaatttgggtccatggtgaaaagatttgatttttaagtgtgaatttgtggtttagagtactctgaattcaaatacccgtgagggcaacatgtttccaaaaataagaataccaccctctatttgtcaagtattttacttgcttcacacattagtctgaagagttaattatgaggtgccctttactgaagagcaattattatgtgacttttacagatgaggaaattaatgccctgatagtgcctttgccagggacatatggctactacgtgctacagcaaggcctagaacaatgcctactgattggtagtggtagagattctgacttgccatctgatgccctttatatttaaaaattgtatcttactccatcatttaaatatagggacaattaaatcttcatagagtagttggttattttttacttcgatagaggaaatacaggcttagcaaagaaagacattaatatttttctttttcttcatcactttggccttgcgtattttacccccatacaaaaacagcattttaccctgcagaattttcccactggcttgcatgagcttcagatgtcttgcttcatccaagatgatgttttgctgctactgttcgtttctgggggcatttatttggtttattgccctcacataaaacaaagtcactctctcgccttccttcaacgaataaaaaggatggtggcagtcacctgtgatcaaatagaagaaaagcctagagaaacaaaagggagaaaacacaaggctttgtggccagtgattggcacctctaatgggtagcctgggagggacgggcagcaggaaatctgggctgtttgttcctctccataagggcaatgaggagggtgtattgagtagtgtgtttttcctatctttttgttcagtgtcagttaacaatggccatttcctagctatttgatgtgcaagtaaacgttgtgcagtgcacattaaaagcaataatgttctggtagagcgttgctaaggaaccgtcaggggaagctaattttaaatgtctgcaccagccatcttttcactgctgagcgccactgaagtgatgattttaacagataaaaatcttatctgtcttccacccacctccacatcccccaccgccacccgcatccccattctgactatcttaggtatctccttcttctagatgtcataattcataatgagaagatcatacacaggcttgacagaatcaggtgctttcacgtgtctcctcattactttgtcctgcttgcttttactagcacctactacgtaccagtggaggtagtagggatggaaagaagaaatgacaaattccttgccttcaaggtacttatggtcaattgcagatacagaactccaaagaaattcaaatcacagtacaatcattgattactgtatgatcctggccccttgaactggcagcttgcttacctgctctggaaagttgctggctgccctgttggcaccctgggcatttcttccacatctaaacaagaggttagtagagaagaagctacagcaaggctcatgactctgcttcttcataggcagccttgacttcctagactcctttttgtacctgagtttctggtccaccctaattagctgtaaggtgaaatcctttgcaccatctccctgtgtcccgcttttagagtccttaaagctagataccacatgggtgtagaagcttcctggaagacaagaaatatacctcctctgatatggtatttagcagtcagtatctctgatgttgatttacttacttgtatggaaacttgggaaactcaattcaggccacctggatagtgtttactaaattagtgcttacggaagaatttcaggccttaagtgctgatttaagttctcaaatgtgggagaaggaagccttgtccgataccaattccattaacttaagttccggcttactcagtggtacccttgtggcctgagaaaataaattcacattcttaaaaaacaaaacaattaaatacacaaaaaacacaagagagtagctaaggtattggaaaatctggcctatcattctgtaataccatgatcttggcatttcctcacgttttgctactttcagctaactcaggctttcttacaggcctttttctccccaaattcaagtggataaaaagtttcattattgtaaaaattaggctaattattgatgcactcaaaaaagtggtttttggatgctttctttccaactaaaagcacttttgttttttaattttgaaaaatggcatatgtgtgtgtacacacacatataccgtcaagtttggcaggaacatcttaccagttggtagatgtgttcagctgatattaagcagaaattcttgagaatcttaacatcttgggattacaaagtctttcaaatggaagagccttgaaaggtcattttaacacttttgacatccaggacagtgatttctgactctgttttgatggttatccatatcagaggaacattttacatcacaaactggggtaaagatataaaataaattgtacatgtgtttatgtacacacatgtatatatacacccaccatatgtacacacacacatttacagtgtcatatgcatacaaagatcagaaacaaaagtttcatcaagtgatgccttccatactacatacagtgcatgctgtttttctattttatttatttaaaaacaaaatgctggttgcaacccactaaatggattttctgaaccagtggtttaaaaatactaatctatgtgatctcagtttttcttgcctggttgaattatctttcaaaaaaatttaaattttgagatttttgccgtggaagtttctgccaagacgttgctaatgtctcagagacctttatagttttattctaacactaccatccatgttctcattgttgtgttacaaaaaacaaagttcatggttgctacagctgttttggacagctgtttgagtaactcaaaacagatgtgagagccagaggtctgacatttagtggaaatgtgctattaaataccaccgcgtggtttacttaaccctgctagataattgcccacagaggaaaagccgtttttaaaaaacttatgctcttcataaacataaagtatatagataggtaagctattatgtacctcaaatttacaacttttctgttgccccttgccacagagttggtcctgaaggtgtcagctaacctttctttatcttttattttcacaaagagtacctggaagccaagaaaagtcaagtgccttatttatggccattcagcaggttaagttaggcttctaatcttatcttaatggctttgctaaactgttatcaaaattaataaatgagtggcatgcttctccatttagtgataaaccgatggccaacactatcctgcataataggcaatataagcaggagcatattcaagatatgaatgtgtaaacattcagctttgtgattatatctttctggttggtctctagatatacttagttgttcacaaacacttgggagatttgagtggctcagtgtatatttgaacactgaatattagccaatttctatctaatctgtctatctctaatctcttcctttgtaagtatatgtgtagaaattgaattatagtgtaataagtcattatctactttactataaggtactctctaaagctctgccattctataggaaaactacatgggtacaataaacaaacgtaatttaaaaaataaccccattaagtgatttgtccataagtctctgatcatttagcagactaacaaagatatttttatatgtatgtgcattgatgaaagaaacgctctcctagtcagtagtatggtattaggctctctaaaatgtggtaccactttatatagatgaatgaataataggagccaagataagctcttaatgcagtaaaacaatccagaaagcagttagcagtgctactatttctgctacctgtacaatctcttgcctactgacctgtgccacattatctccaccagcccatgccatcctctttttttcataccatcccctctcaaataagcccgcgtacattctatcaaatacccctaaattaccaacccaacagctttgtaaaacctaccgtcttttaaaattaaaatcttattctgtggttcttttatggaagagcaacataaagaacaaaggcagatagaaatatggtgtgccctttttcaggcaccattctgtttcctgtatgctcccacaaaggatttgagcggttatccctttaatccaggactagcaaactacatacagcccaaatgccaaatctggcccaatacctgtttttataaagctttattggaacacagccatacccattcatttacatgttgcctatagttgctttctcattaccagggcagagtagttgcagcagtgctgaatagctggtccagagaccgtgggcttgcaaagcctgaaatatttactatctggccctttatggggaaaatttgccaatccctgctttacgctattatttcgttgtccattctgactcattacatgtatagagtcacaggcttctgtgctgatcaactttcagctgaacaagattattgagctgaaattgaattgatttatagatttatattcatattcaccaaagagcctgcaagtgtggccatttgaatttttttgacttataaaataacagaaatcctaaaaagggacttattcttccttaagtattttaaatagtcagtgaattaatataaaagaggctaaaagcacccagaaacagtactgtcctgcaattccaactctaaaataatgaattacaatcaataatgtcaattttatagtgcccgaggaaattagacttctcgggacctgaccaagccctttatttagactcaggactgccccagcacacttcccttttgtcttgattcatttcctgacaacacatcacattgccagatggacactgtaactgaaggtctacagaaactcatttccaaaaaaaaataaatgtttagaaaatgaaacatatctgaaactttatttatcggtcaagaacttttaaaaatgttgtaatcaagtagcctctgttttgtcagcgtagaactagtccttttacagtagaaaatatcatttgtttttaactttttctaaagtgaaaaaaaggaccttccttttgtaatgtgttaatgagtacgtggggacccaagtgatgagggaggattttagaagagattagagttagcttggctctgggaggtccattttcataaaatatggtttctgaagaaggatctggaacataacacaagtcatttgctgctacatattaagaaataatcaattgataactgagttctgaatatggcttagtgtagaattactaaagatatgtatcattaagcattcaaagaatcatcgttacattctgaagtacataaccataattacattctaaatcacatggctttctaacaacactgtccttcctaaagatctcaagttttcaaaactagaccaaagttacatgccgaaacaagttacccacctttggcatccaaactaaagtgtgccagtgaagggcaagttacttataacacagaaggactcctcttggtcatgacccaactactactttaccaattcacttcagccagtatttatcaaataccaaaagtgtgtatatacggtacagggcattgggcatagagaggtggatgagcaacatgtggaccccgtcctcaagaggcttatagtcttacaggggaagggaattaattctgccaccagacagtattatgaaacataaagatacttttttaaaaaaaccttgctaaaggaatcaaaaagaaggggtgagtgattcatactgggatttcagccatcaaggaaagaatgatgttctcctccccaaatgatgggaacatcatttggtatggatctcccactagtgacacccacagctgaggagctagtacccatttttctccctcttttccctggcttgaggagcatcttaaatacctggcccttacgtggtcaagctgaaaatctgatactcctaagaaatcgctgagtcatgtaggaaattcagaaggaagagaggaagggagagaaggagaaagggagggaagaaagagaaggagagagggaagaaaaacttagaaactatccttaaatgtatactagaagttttgaaccctaaccttgagtgagttttgaaaggtttctattggtgtcgtagctccatacctcttcattccagactagtagttctcaaattgtttcagggagtttttagtcttcttggagccactgagaatgatgggtggaggggaaagggagatgctgtacaggatctctcacagctctgctttgaactgctcaaaatattggaattccatataagattgttttaggagatgtcccattgctatagttaaaacagtttgaaaaccaagattttaaaggaaattgcatgcccaagacaggctattgacatgtatggacagaagtccctacttttctgtccaattatgacttatcatagaacactttctcatcagagtctacttttgaaatacaaataaatgcatacagatgtaggaatctatgaatcaaggccagtgggtctttagccattgcctcgtaaggctcctgatatttgctgaattggggaggaagtggaaagctcattcctggatctggctctgtggcttgcccattactgggacttacctcttcccctcatctgttctttctgttttctcaaatgcctccaatttcatcatggaaatgctcagcttctatcagatagaacaaattctcccaagaggatggagtccagcctctatgtcgggttctaccttgcatttgatgtgcagactttgggcacacagagtcaactactgtttatgtttcaatgtgctgattgtcaagagtgaagagattctgagactttttttaacattaagtttgagttgtccttgaaaacaatgcccaatttgtcagatttctattctgtgccagttttcatccagtttaatgcgtgaactctatggattttacaaatgacgtcttctggatcatgttatctgtttacactgatcttaagtgtatgtaaaggttatttgactagatgtgtcttttgggttttttgtttctgtttttttttttttttttttttccagcagagaataaatggtcatctcaacatttgtttggtaaaagaagcaaattggtatgaaattgtatatttatgcatgttttttttccctttctgatatctctgcctcttcctctctctattattaaaggaagaaatacccctggaaagccaatgagagaggttagtgagattcaggctcacggccatggcttctgtctgtctcatcctgctttttatgtttggcgtttgtgtaagaattgtgtgtgtgcacgcgcatgtgtgtattacacattgtgtcatcatgtaaggatggtagtcacctctccacttgcagctcatgaggaacattcctcaaatgttcattgccgttgtcatcaccatgacgacaagactggggttgggagcaagaatctctttaaaatggcaatcctttgtagtccctaggttggaatcctgccgttcatcatctgttgccatttgcaacactaacaaaatcttcaaaataaatttagccttgaacataactgatgagtcataaagctttcttccacttccaggaccttagcattttctgccagcgcccttagtttttattcttctgggatgacttcattttgcttttgtttccttttttcttggttcctacgctctttctctcccattttagcgaacattttttgagcacttactgtgtgccaagcattgttctcagcacttgccatctttttcatcatgtcatcttcatgacaaacctgtgaggtaggtactcttattaaccccgttttacagataaggagactgagtcaatgagagagtaagcagtgtgtcccaggtgacagagccaaggatttggatccaggcagtctggctccagacccacactcttaactctcatttgaaaggcttacatcatctcaacgtacccttcagaagatgatcttttttatttggtatttgaagccacacagaacaataaccaattcgattaaaaaattaaatattggagttttgagaggtttttaaaatgcctatttatgggttgaaagggatagggtgcagtcttatcactgaatgtggtttcaggttttacggtgaaagatgcttcttactcctattccaccaggaatattgtctgaatatcgaattacctaattaagtgactgttggatgacaaagtgttaactgacagcccaagtaaaatcaaggttgtctttaccaagaatttaatctgaaggaggagagaaggaaagctctcccatgggatgacagtgttctgggagacaggctggatgggtggagagtccttcttaaatgagaagattctggattccttagcaacaggatggactggagagaccactgattcatttaaacacaggagtcgtaatgaaaactctgccaacatcatgccatacaagtctaatcaatttaatgattcttcagtgtgtctgtgccagtgcctccttccaaggctttgggcagtggggccagggagggaatggtaggctgggaggagaaattgaggaaacctgacttggtgaagcattgaatgcccctgacggtttgcctggttcatgtacttcgtatgtgagacttcttgggttcattcttatggtaagtgccccttaaaatttattcattttaactttttgtagaaaaatgcaccataattttgaccaccttaaacatgtttcactcacaaatgaatttcagaaaaggctagcacatgtaattgaagttatataggcatttgcagacttgactacctgaggtgtatggtgttcagacaagtttccagaagccaaagaatcaaaacaataatgaccttttttaatgctatgaaaatatcccaaatgtacgtaaagcagatttttttcagagattaaattatagagaagaaaagataagcaaatttccctgtagtattccggctttcctttggacaactgaatgctaacaatttatttgggaattgtatttttaaaaaatagagcaccagattgctattgaggtcttggatctttgccagaaagtctcaattccaatcgctgtggaaaacaattccctcaggcagtggtgacgtgtgagactaaatgtgttgcagttagcgccaacttgaaaaacatacaactgccctaatgttcaaggcatagtgcctttgtgttcaataatccttaagaatggattaaatcaatactttctatagacatagttttctgtcaccttgtgcctgaaggtgattgcaaatgcctgaatcctggctgcttttcagtacctctcatacttcatagtatgagattgtaattttgactttagaaaaatctgtcaggtaacattaatgacctcccgaatgctctgccttacacacatggataatagaactaggatacaaatctactttctatagtcatgtcacagtgcagtcttacccctccaacggattaaagtatgattctttagggcagtagtttgtaaaaagagattgacttcttttttctggatctaatgaaaaactccatggaaagaaattagaattatttattctggtaaagcaggtatttagtgaagtaaccaaaggcataatatagatgatgaggtgactctaaaagttctttatttttatagcacaaagatggccacaaggtcatttgtgaaaatgcagcagtgtaaaccggttaaaggccacccaactttttgtcggagtgtgcatggcacattaagaataatgaacctgttttccctggcaaatctttaaatagcagatacccctagaacttatgcttcttgagagactcaagaattttccttccagttagtaactgaacaccatttcaaggaagagaagcaccacttggctatataatccataaatgcatttatttgttttattatattttgaactgccatctacatcccctagcacacagcctaaaaagaaagacactttgtgattatcgataagctgacaggaaaaaaaatgagttttctccccttttcgttgatgttttgtaatatgttttctagctactaggtggactacatactatagtcacatgtgggccatgagaaatacttcgaattacattcaggcaccatgttgtaaaggtcctggactttgtttttactgattttgttaaccgtaaagatcgctagtaattaaaaattggcagttagtccatctatcttcaatttatgcatgaataattatgcagatttcccagggttgctggacagccaaaaatagatacaggggaagccctccaacttgatagcagcagttatatatttgtactctgagctctaaggagcagcaaaggccccactgtgtcgtcttcctgtggtttttatggcacagaaagccaaaaatgatttcagttcttcactgagggctgccaaactattggcccactttatgaatagttgcatatgctttgttaaaaaatttttatacttgcagtctcagccaaaatccaaagtgattttctaaaatataattaatactccatgaaattctttgcactaataaagcacaaaaagatagatatacaaacttggtcaccttaatagaaatgcctgaatgacattaaacttttaataagtaagtcttcagttgatctggtgccatcactgtttaagtgcctgcccgtgaatccgcttcattttgtagagaagctatatctcttgaaataaatattaaaacaaaatactctccctagtctatagctttaatttttattgggatatctttaatttttattggtatttttaacaattattatgggaatctgtaaagttgatacatggcaaggtagtaatagcctagtaaagcatttcagttccaaagacaatacttgaatagtggaaggatttaccaatgtgcaataattaaaattagccatgtaaaactatgggacatagacgaaaaggcaagccataaagtaagtctcagattatcttactctaaatctgaattttgctacgaagtacccagggacattgtgctgttctttttctccgtgctgggagattcgtgctaggtcgtgctgcattattagtaaaaggctattgtgatagttaaccctcatttaggaggagctctaagatggattcacaaaatacccaaatgcatacaatacatgtgggtcaccttataattagggtctagagtaatttggaatgtaaagcaatttttattctgaggtttcctaattcaaatgttaatagtgcaccaaaaggtcaattcaagagtttattattattatttttcaacccaagtaaaagcagagagaaaatagccacctccaccatagcctcagaagcaagccaacagcctgaaacagctttgaaatgaaaagttggtgtggcggtgatggtggcagtgataatggtgacgatggttgggtgctggtgatggtagtggtagttgtgaaggtggtgatggtggtttgattgatagtaaaaaaaatgttcgttaatacaagtagagagtaagtaatcaatcaatcactcatagccaaggtggaaaagatgtatcccatcatggaatattcctgttctgatagaaatcttgtgcttatctatggaattcttttgatatatatttacattgggaacctgaatgtagcttgacatttttccatgttaacaccagtagcctgatccaacattaagctgatactaacaaacaacgtgtaatggcttcattaataaggctttgcttcttcctggaaactggtgaaaaatcaaaccttgttgtgtacaccctcgatgcagcttctgtgttgtcttcacccagaaatggggaatgatttcccaaatggcaaagaaacagagtgatgctatctatctgcaccttttgtaaagtctgtctttctttctctttgttttccaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtattgactggactgcagtactttgtttttattttaatttagttgttgttacttacttactttttaaataggtaatacatgcatatgagtaaaaaactataatccagaaagacagtgaaaacactcctaactaccccttcccccatatcaatcaatcatcctcattgctctatgagtagacattattaatttcttatttagtcttccagagggtctttctttattaattattatataagcagttaaaataatatatatgttcctatttatttttttcctattattatttcataggatatagcattctctgcacccagttatgcaccttacttgtttgtttgtttaaatttaaatatggactcaagaaatcttttcatttaaatatataaaatgctttctcattcttttttatagctgtataatatttcattatatgttcataggatattttatttaagcagttccctttggtgggatatgtagtctgttgtcagtctttcttttgctataacaaacaatattgcacatttctcattacatcatttcatttgtgcataaacaaacaaatctgtgggatacttcctagaagtgagattgctggatcaaagggggtaagcatttgtagactgggagatgatacattttgtgcagtgattgattgattgatagtcatagtgtttgtttgtttgttgtgttttttgttttaataatgacaagtatattaattaagtcagtttgcagttcatactttgcttctcaagagaatttcatatcacttctattcttaatgtcaccatctaagaggatgcatgagtgagtagtaagaaagagacacctaaaatgatgtctcacaactggttctggggaagaagaatcccttaccatagtcaaccaccaccatggggagaacctctcctttgcccctgccctgctctgtttcttgccctagctgcaaaggaagctgagaaagtgggtagcaatgtcagcacttcttagggagaggctatctatctttacctattcccaaggttcatggatggggtgggcggggttccccaacagtgttcagatactggtgagccaaaggaataacataagtccaccaggtgcagcctatcctagtgattttggaaataataggagatgagatgatccatctcattagaaatgatgtttgttagtagatgtggcatctctgctgtgaatcaatcacttgctaattttttgaaagtagggtgatgatgctgacctaagtgactaccacattgaaacacttcccttgacatccacacataccaagaaaaattttcatcctatttaaataaacaaatcatttatccttcccaccattacccgaacctacctttgtttgaaacacccagactggctgttttggtgacacttaaggaggtaactgaggaatcttcaatacttcaccacgtctaagacaactgtgtgtggatgactctgaggagggcatttggttttccattccatacttggcacacactagaagagacagaattaattcagttaaaaattaaaatgaatcgagctggcacagattatgcaccggcaagcaaaatgtgtgtttgtttgggagaaagcaccaagactaatggatgtgttctgtagagctgcgatgggatttccctgaatttgtaatgctctaatggtggaatgaatacaaaggcaggcactggcgcacttgcaaagactttgccttcaaattaagtgtaggaaggacacaaatcaaattctttcccacagtagcaaagccattggagtaggaactataaatatgttcttcaatgccccttgcacgtcagtgtactgtgatctcatggacttagctgacaacacaagagtggcagcatgcccaacattccataataaacaatattgtgtgaatgtgtaaagtttggggatgtttgtttgagagtagcttttgtgtacagaaaaggttacctacagtaacttgaggtttaaatgtt

SEQ ID NO: 14547 - DNA, 818128 bp, Human; identical to SEQ ID NO: 14546
  misc_feature (1)...(818128): n = A,T,C or G

SEQ ID NO: 14548 - DNA, 818128 bp, Human; identical to SEQ ID NO: 14546
  misc_feature (1)...(818128): n = A,T,C or G

SEQ ID NO: 14549 - DNA, 818128 bp, Human; identical to SEQ ID NO: 14546
  misc_feature (1)...(818128): n = A,T,C or G

SEQ ID NO: 14550 - DNA, 818128 bp, Human; identical to SEQ ID NO: 14546
  misc_feature (1)...(818128): n = A,T,C or G

SEQ ID NO: 14551 - DNA, 818128 bp, Human; identical to SEQ ID NO: 14546
  misc_feature (1)...(818128): n = A,T,C or G

SEQ ID NO: 14552 - DNA, 818128 bp, Human; identical to SEQ ID NO: 14546
  misc_feature (1)...(818128): n = A,T,C or G

SEQ ID NO: 14553 - DNA, 818128 bp, Human; identical to SEQ ID NO: 14546
  misc_feature (1)...(818128): n = A,T,C or G

SEQ ID NO: 14554 - DNA, 818128 bp, Human; identical to SEQ ID NO: 14546
  misc_feature (1)...(818128): n = A,T,C or G

SEQ ID NO: 14555 - DNA, 818128 bp, Human; identical to SEQ ID NO: 14546
  misc_feature (1)...(818128): n = A,T,C or G

SEQ ID NO: 14556 - DNA, 818128 bp, Human; identical to SEQ ID NO: 14546
  misc_feature (1)...(818128): n = A,T,C or G

SEQ ID NO: 14557 - DNA, 818128 bp, Human; identical to SEQ ID NO: 14546
  misc_feature (1)...(818128): n = A,T,C or G

SEQ ID NO: 14558 - DNA, 818128 bp, Human; identical to SEQ ID NO: 14546
  misc_feature (1)...(818128): n = A,T,C or G

SEQ ID NO: 14559 - DNA, 818128 bp, Human; identical to SEQ ID NO: 14546
  misc_feature (1)...(818128): n = A,T,C or G

SEQ ID NO: 14560 - DNA, 818128 bp, Human; identical to SEQ ID NO: 14546
  misc_feature (1)...(818128): n = A,T,C or G

SEQ ID NO: 14561 - DNA, 818128 bp, Human; identical to SEQ ID NO: 14546
  misc_feature (1)...(818128): n = A,T,C or G

SEQ ID NO: 14562 - DNA, 818128 bp, Human; identical to SEQ ID NO: 14546
  misc_feature (1)...(818128): n = A,T,C or G

SEQ ID NO: 14563 - DNA, 92387 bp, Human
  misc_feature (1)...(92387): n = A,T,C or G
gaagcgtgtcagaactcctgaattttgagcaggtaatttaaaagtgtaaaacaaacaaacaaaaaacaggaaaggaagagagtgacaaatgtcttactatccaggtgttacaaatccttagtttatcgatttgtaatatttacaaatgtccatgctctgaggcttctgtcttttcgttgaaataaacataaacagtagttaagtgatttgccacactgacacagagattggtgtctctgatttactgcaaagggcactacttcctcattacaggacactaatccctcttccccaaggatcggagcagacctagaatatactattagaccaagggacaacttcagccaaagcaaatcttagtgtgcccccctcagaccgtaatagcagctgcctccacaactcactagcttaaaattgctaaagggcaacactaagtaatctcagtgtatgagccagaatgccagaagaagtgccatatttgcttaaaaatagcaataccgatcatacttacatgcacatatctttagtgataacatttacctttatatttggtttgttaaaggtaataaagaatcctggcattcccttttgcttttgtccagatactttatttttgcctcctttgccatgctatagcattagataaagcaaaacgggtgtgcttccacctaaaacattctagggggaaaaatgttgagcagaaaaggattatttcaaaagaagccggatatggtggcatgcacctgtcatcgcaggcacttggaggctgaagtgggaggattgcttgagcccaggagttgggagaccagcctgggcaacacagtgagacccccatcccttaagaaataaattttaaaaaggggaccacatttaaactgtagaccgaagtggaatgaatcaatcggaaaggagagtggaaagcaaatgtttgaaagaaaataaaaagaaaagcaagccaacaaaataaatggacaaagaagggcagtgaaaatatcactaacagtttatcgtaagatgctctttggatgctaatctaaggtgttatgtgaagtttgcagaaaattcttgtgctaatgaaggctttcttcttcttttgagtatttccaagcttgaaataattgtgtgtagttaacttctatcatcatactgcaaactctaaaattagaattatttgaactgttcaggccctgtaacttttccaataaaatattctattagaaacaagttccttctagatcttcctaaaagaatactaaaggaccaaaccgtgcaacagcactggtggtattgtcttaatttagagagtccataccagtgattctcaaacattagtatgctcagagtttctggttcaataggtctgggccgggcccagggaattttcatttctaagaagttcgcaggtgatactgataactgctgttcccagggtctacattttgagatccgctgttatgtcacaaatccaaatccaaagtctttttaacaatcccttttagcccaggatgagcctaacggcaatttcacgtccttatcgccggccactttaatcttcaactgaggaggaagggagagtgagaattatgtatataatttttttcttttattttttaaaaagaaaactccaagcccacactcttaattatctgggatgaggtcatttgcacctgggtcatttatttagacaacaagtagtcttgctagaggctttaaggaggtgttagcagagcggtgtgtggcttccaggttcctgggtctaccttaaatccccatcctctttctttctttctttctttctttctcttttctttttcctttccgttttgaaagccccaactgcccagtctctgggtgtccgggttcccaggtccctaggtgggggcggagcccgacacggccccgccccgtctgcccgcagcgccccctccccggcccgcccgcgccggctcctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaagggtaagtggatcgcggccccggccccgtctgatggccgcaatccgtgcacttgtggcgcgagcagggggcaagctgaggcggtcaaaacttggacaggcgcggcggctggacccggggcgccgggcggctgggcgtctaggaacctctcccgcgggttcccgcggcgcggctgcaggtgcgcccccggggtttctccccaggcgccgggctagtgggggaacctcttccctcggctttgggacgggctcggagagaaaaagctgatttctccccgtccccagaggggataacgcgttcctcacgcggggattggggccgggggagcttttcactcctttccaggctgccagtgtggacgtgagcaaggctggctgttcctaaatcgtcgctcttactcgtagaaggaaggggcgcacgcggcgctaccttccattgcactgcaagtgccaaaaggtcaactttctgcctgatttcttccgaggattccaactgacatttccctcgctgcattttctaccgtgctcattccatgccccaagacctgcagaaatcaggaaagaaagaacaaacaactaaagcccagaagtcaaagatttcagcggggggggatttttgtttgtttgggctttttttttttttttttttttttttttttttgcccttcgggattgggtgtggagtcatttctagggtgttctctcgcatttctccaggtgtctgtgctcatcttcaagcaaagtttgtcactcccaatcccagcacggcaataaaaagggcagaacactttgcttatattagtcaaatttgaagttaagtttgaagctttaaattgaaggggtttagttgctcgagggaggcataatattaattataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttagaactgatttgcaattgaagtgaaactaagactgcaaaggtgaaatctaaatctgttttcatagttctttgcatttgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttgaagtccattccagatggtggcttttcaccgtggttccctgtctctgtctgatcaggcttatcagctcagctaaatgtttttctgcagacctatagaagatgctacggtccttacaaatatcctggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaaagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcagggggcttgctttaaatttcacccgccaaagtagggcgcagagcctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaaggcagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatatttgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagttctgttttctttcccctcataacttgaattattttgaatgggtacagagcatacaaataagggtttgaaaacaccagtctttttacactggacaaatgtccagatgtctggtttgtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaaggttttattaaannnnnnnnnnnnnnnnnnnngaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaataatctaggatcttcaaaaatgtctttctatacatatatttttatagaagttgaatcattctgtcttataacttgcttttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcaccttcagagttaatatttccaatagttttgtaacaatcaaacattcgttgggcttttatccaagtggtgattcatcagataacatctcccatttattgcgggcctattgtatgttttccacatgggatgtgccagcaaccaaccctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccaccttggcctcccaaattgttaggattacaagcgtaagccacagcgcccagcctgcctacatccttgagatcccatataagattaactaccagcactgcctttccccctctccaaaattacagtgtttcagagtcgaaacataagcataaaatactgaaaagaaacttttcattgattttagtttttacttattagtttatatttttcttcttcaagaggtatccctttaggtccaaattgctctttgagctggatgaaatggtcggaagccttcaactacagtcagttggtgaaaggtatcttgaaagcagaaatggtgttgtggtctggcgtgtcaaatgtttaagaccacatctagccccctctcctaatcgaacctgaacctcatgtctctggtgaggtgctgaaaatatcaagatgttgctttttccctctgtacccccactccaggcatactctaccgtggaagctacagtggttcacagtatgcatggtaggttacacattcctagagacgcccacttctaaggagatttccattctctaatttgccaaagttcccaagcagcctgttcaacacatgtttatgttacctgccttgccctcaaaagcattcaggtgttcccctgcacccagggtttgaacacaataggattagaaggtgaaaacattttgttagaactgaaaaagtagcaagtatttactgatgaaaagctataatattgcttgagatattaccattggagctctctaatacattctgggtggttttctttttcattccttttccactgattttctacaatgaatttatattatttacagttagatgtttggtaaaaaagtttcttcgtcgatacccccattccatttcttacttagtgtctctatagctacaattcattaactaatgagaacttatgacagaaaagcagcagtagccacacacacacacacacacacacacacacacgccccacatatatgtagataatttatacttaaggaccctgattctcatggactttgtcaggtaactttaaactcaaagagatcatctcatgtatttttagtctgtatgtccagttgtgaaaaatgcagatgtagacattttagtggtagagaaaatagaacttttttgattaaaaaatagataaaaaacaatataagataattaattttagattatttccaacagatctaaaatggctttgcagaggaggtttccatcaagtgttagaaatattgtgtttccctcatttatcggctgtgtacctacacaaaaaattgagagaaaatattgccagagtcctacacaaacaaagcaagacatagtaaagaaataatttaaaggttcactatgatgactgaacagtcattaggaatttgagtccccagaaaattttttacatcacattaatggtttgacaaaagcattgtcttggattttcacagggaataaatcactaaaagcaactggaaatcagttttctttcagcatttgtctgtgactacccccaatagtcatagaatggtagtagagaatagtagtggagtaagtgggatataagagaccaagtgtctcatgtctattttttgtagaccttggtgctttatctttaaaatgtgaggatattggggctgggcacggtggctcacgcctgtaatcccagcactttgggaggtcgaggtgggcggatcacctgagtcaggagatcaagaccttcctggctaacatggtgaaaccccatctttactaaaaaaacaaaaaattagccaggtgtggtggcacatgcctgtaatcccagctactcaagaggccgaggctgaagaatcacttgaacccaggagtcggaggttgcaatgagctgagatcacgctgtagcactccctcctgggcaacaagagtgaaactccatctcaaaaaaaaaaaaaaaaaaaaaaagtaacgatattggacaagtgtctaagatttttgtttttcttttactttgggctgagggtggggcaggctgtttctaaacttgctgtgatcattatttttcaagaggtacctttcggctaactctgcagacaagtggatttctaaaaatgtaatcattcctatgttttaaaatgtacattctgagaaaacaaacaacaggagaagattatgccacccatccgtgtcttacaggctgagtgaggcaagctgttgtcaaatagagaggctcttgagatatttcccattagactcctctgggtcattcatttgttattgagagggtacattcttcgtcactccctagaagtaataatatgtttgattcatgaggtgagttttagatttctattagcatttttacaaatgtaatggaaagactgttccaataggttagcttggtgatttaaaactctgagctcttcaaggctccagaaagcatttacaacatcagtagatgttagatagtaatatgctctggaatttattttgaaatactaatataatattgatttacatgaagtgcaattatgtggttaaaagcctgtccttttctcacaatttatgtctaggtccctaagttcattactgaaattttaagaaaatattttttaaaaagctcaccctgcccccacacacataatatatgctgcttagagatacttttattggggtttttttttttttttttgacagcatcttgctctgtcacatagactggagtgcagtggcctgatcatggctcactgcagctttgaacacccaggctcaagtgaccctcccacctcagccttccaagtagctgggactatagccgtgtgccaccgtgtctggctaatctttttttaaattttttgtagagatggaggtcttaccatgttgcccagcctggtctcaaactcttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagtagttcatcaaaaaaactaaaaagctttcatgaggagttctgaggtgacatagataagataccagaaggccacccctgggttcaaaggaaactgatcttaaaggagaggaggtagcaattaaaacaaattatctgcagagaagtccaaacactaaggataagcttcccatgcatttgatgaaagtacttgcgacgtttacaggtgtttatgctcatgactctcaagactaaatacagacataccttggagattttgcaggttcagttccagaacacttcagtaaagcaaatatcacaataaagtaagtcacacaagtgttttggttttctagtacatataagttatgtttactctataatgtagtctagtaagtgtgcaacagcattatgtcttaaaaaacaatgtacataccttaatttaaaatactttattgttaaaaaagctaacgatcacctgagccttcagccagtaatgatccttttgctggtggagggtcttgcctcgatgttgatggctgcacagcatggtggttgctgaaggttggggtggctgtggcaatttcttaaaataagacaacaatgaagactgccactcagttgactcttccttttgtgaaagatttctctgtagaatgtgatactatctcatgaaaccacttactttgctcatccataagtagcaactccctatccattaaagtttgatcatgaaattgcagcaattcagccatatcttcacgccccacttgtgatttcaattttcttcctgtttccactacatctgcagttacatcctccactgaagtcttgaacccctgacagtcatccatgagggttggaatcaacgtcttccaaactcctggtaatgttgatattttgacgacctcctatcaatcacaaatgttcttaatggcatcaagaatcacttccagagattttttttttttttttttttgagacacagtcttgctatgttgtccaggctggagtgcagtggcgtgatctaggctcactgcaacctctgccttcctgggttcaagtgattcttctgcctcagcttcccgagtagctgggactacaggcgtgtgccactacgcccggctaatttttgtatttttagtagagacggggtttcaccattttggccaggctggtctcaaactcctgacctcatgatccacctgcctcggcctcccaaagtgctgggattacagccgtgagccaccacacctgacttccagagattttccatttactttgcccagatccatcagaggaatcactgtctatgtcaagctatagccttacaaaatatttctcaactaataagagttgaaagtcacaattttttcttaatccttgggctacagaatggatgttgtgtaagcgggcatgaaaacgtgaatctctttgtacatctccatccaagcttttgggtgacaaggtgcattgtcagtgagcagttatattttgaaaggaaacctattttgaacactaggtcttacagtgagcttgaaatattcagtaaaccatgccgtaaacagatacgctgtcatccaagctttgtttttccatttatacagcacaggcaaagtagatttcacataattccttttttttttttccttccaagacggagtcttgctctgtcacccaggctggagtgcagtggtacgatcttggctcactgcaacctccacctcccgggttcaagcaattctcctgcctcagcctcctgagtagctgggattacaggcgtctgccaccacacctggttaatttttgtatttttagtggagacggggtttcaccatgttggccaggctggtctccaactcctgacctcgtgatctgcccgcctcagcctcccaaagtgctgggattacaggcatgagccactgtgcccggcctgatttcacataattcttaagggccctgtgatttcagaatggtagatgagcattggcttcaacttagtcaccagctgcattaggccctactaagagatacagcctgtccattgaagctttgaaggcagtcattgatttctcctctagagctatgaaagtcctagatagtatcacctttaaatagaaggctgtttcatctatgttgaaaatctgttgttcgttgtagccaccttcatccatgaccttagcttcatctggaaaacttggctgcagcttctgcatcaatgcttgctgcttcatcttgcaccttaatgttatggatatggcttgtttccttaagcttcttgaagcaacctctactagcttccaacttttcttctgcagcttcctcatctcttttagccttcatagaattgaagggagttaaggttttgctctggattaggctttggcttaaagaaatgttgtggctagtttgatcttctattcagagcactcaaactttctccatatcaggaataaggctgttttactttcttatcatttgtgtgctcgcagggtagtacttttaatttccttcattaacttttcctttgcattcacaacttgactgtttggcatgagaggcctagctttcagtctgtctcatctttcaacatgctttcctcactaagctcaatcattaatagcttctgatgtaaagtgacagaggtatggctctttcttcccttgaacacttagaggccattgtagggttattaattaccctgattttaatattgttgtgtctcagaacaggaaggccagaggagagggaaagagatgggggaacagctggtcggtggagcagtcagaacacgtatgacgttgatcaattaagtttgccatcttatgtgggtgtggttagttgcaccccaaaacaatttcagtagtaacatcaacgattactgatcacgattcaccataatagatataaaaataatgacaaatttgaaatattgagggaattttcaaaacgagacacagacccaaagtgagcacatgctgnnnnnnnnnnnnnnnnnnnntgctgatggcctcgttcgttcattggtttcctgcttcagtaaacatttaagagcgtgccatgtattttcaaactttagggcaacaggctaaaaatatcaaggagaaaaacgtttactgagggtatagaagtttttatgatcttacttttattgaacattaaaacatggatgttcattctagaaattttagaaggtgaagtgcaaaaacaaaatgaaaatcacctcacatctcagtacccagaaatagccactatttacattttaaaagattgcttccggtcttctttcctatgcatttttatatagttgtttgagataatagaatgtttaaagtgttgtatcctactgtaatcataagtcttctcttattcttagttcctcagagatgttatttttcgctagttgcagtttattggggtaccacttttgtaaaaaaatatttcccaatttttgaaaattgtgacaaagaaaagtcaaattcgtgttgaatttatggaaggaaatctttaagaatctggaggcttattactaacaagcttctgagaagaaagccaagtaaagtgttataataccttctgtccaacaagctacttatgtataagtgatgttacagaataaagtcagtgtggtcaaaaacagacagtcagttatcagaaagttgataagtaacatttatcctatgaaaaatatagctatgaatttaaatcaatagttttctaccacaaatatcttaatggataaaatcttctttaccaaatatgtatgatgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcagttattaacagaaaaggaagattgcttcctgcctcttgggtgaggaagactcatgtataccatagatatggtcagtttacatttacagttttctgtgaggcattgatttttttcccccataaatatggagtacttagaatgttcaaaacctttctctgggtaatagaatgcacaaaagtataaggcatgatccctgttcattgcccaagctggcgtgactctggtcatgcagcggacttcatgatgtgatagaattccttgcctatgagagtgaaggagatggtaccaggtctacttgtggccggtggtggaacacttacattattctaagtcctttctgtctgtagaacccaaatgacaaccatattattttatcttctcttattgctagtggtatcgtttattaatgccaacgtatacccattttgcttttcaaggttactttagatgtcttaggttggaatgactgaaggcttatacattcaaatttatatatgacacacacacacacacacacacacacacacacacatatcttattgttgcctgctatctttctacctgttgtataagaaatcctttgaaaaaagcctatgtcagcttcacaaaagatgttactgtgttttgggggaaataaaattgggaagtaataaaacagttaataaatgttacaagaccgtgtacaccaacttaaataagattaaggtcaaacgtatggtaccttatataggtaggaagagcagtattaattagaataattagggagagttgtttggagagtggaaaaaaacattgttctaggaagaaattttgtaatactcaggtaaagtaaaatgtagggccaagatattccagatagtgtagcagcataaacaaaggtatgaaagactggcttgtttgcgagtcagtgaagacattgttctctgagaatctactccagatttttttttttttttttttttttttttttgctttttgagacagggtctcactttgtcgcccaggctggggtgcagtggtgcgaacatggctcactggtgccacaacctcctgggctcaagtgattctcctgcctcagccccccaggcagctgggactacaggcacacaccgccatacctggctaatttttgtatttttggtagagacagggttttgccatgttatccaggctgttctcaactcttgagctcaagccatctgcccatctcggcttcctaaagtgctgggattacaagaatgagccaccgcgcctggccactccagatttttaaaagggaaatctgattcagtgcccctggggtgaactaagtgccttaaattatagagtgagaaatttacattgcatttgattggcaatgggaaaaacattgttaaatcttcagaaaagagaaataatgaagtccgtcttctgtgttttggaataggaatttggtgggtgagtttaaggacagttagagaggggagagattatttcgttttgttttgaggtaattgacatgatgagggtcttaggatagcaatgggggaaggaaaagggaacgtgactccagaggtttttcttaacaaggtagaattgccagaaggtaatcacagattggacaggttttaaagaaaaagggagttatatgtcttcaaaatttgaaggcgtggtgacacagagaatggtgataccattgaggaaaagaggaaattgcaaactgagcggagcaacagggaatagatatgaatttgattgaattacatacttatgggtttatttacaatttctcttcttagaaaaatttatttttggtggctcatataaatgtatgtgcttccataccataagcatatatttctcattaatcctttcaaaaaccctgtaaaagatatttgtatctccattgtgcagatgaggctcagagaaaataggtaattttctcacattgcaaagcagggatttacgtgtacttttaactcctaaaccagcgatttagcccctcagctatactttcttcctgagaggggacagtggcattttgaagaggaaatactctaaagccatttgaaaaggggaaccgaagaaagagtttggtccacagcatgataaaaatattacttgcacttttattatactttataacaagaagtacggggcagagaaaggttcctaacttttactgagcaagtatatatccaagatacatctcctctttggagcttttgagatacactatctctcttagttttgcaacagccctaggaataggtactattactgttccctttaaaaatgaacaaaaaaaaaatgaagcttaggaaagttaaggttactagaccaagcttattgggagaccatagtgatgaagaggaagggctttagggtcaaatggatttgaattttacttcttaggcctttggtttccttatttataaaatgggattgaaataatgatatcacagttgaaggtaattatatgagaatttatgttatttattgcaaacatagggtaagcacctaataaatgataacctgagaatttatgttatttattgcaaacatagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttcgaattgggagcaattgggagcccttaagctgaatgagtagacttgaagtcccacttagaatgagcctttatatttttgttctgtggcttgctcagggaagggatacacacttggggagaaaaagacttggattctagttgatgtttttctcctagctgactagggaattcagaacaagttactaagagctttctagtccttagttctctcatttggaaaatgaaaattttaaattagagattctatttctaaggcaccatgtatttcattttcttaataaaaagtatatatattcccctaaagaatactcataagaaaaaggtagagttaaaatttcccaaattatttaattcctggttgcccagtaaccattaaatttctcagcagtcaggcaagaaccacattcccaccttgagacaagatttaggcctttccaaacttaccctcgggctctgttccaagtttatttgtaagtcagttgcatacaatttggaatgaaatgtgttataaatggtggttaggtccctaagtcacagaatcttagttaaccctcagagtgcctgatatactgcaccatgtaaatagaaagcagctgtatgtttctatgggagcaaaaaacttttgtaggaaaaatggtagaaactcgtactgcaggtgttgattattcagcaaacttctctagataaggaggactgggaacttcatcattattggtctagttacattcctggtcactccctcatcccattgactggtcagtttccctccctgtggtccttgtgcaagggtttctgcctcaccccataccctctgctccttgcccggtatcatggttcttctgagggtactactgcccattcacccttgtgctaattaggattacactgggtaaggaaagacatttgttctgtagcagagaagcggggaaggccatcagaggctttgagtgtcagaaagatttggtcttgaatgcaggctctgggatgcaaccgtagggaagttaccaaacatttgtgagcctcattttatctttaacaaagctgataatacagaactcagggccttgtaaggactcgatggtatcaggtacacacgacatttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttggattgaatcttcaaattggtaaagctttatatcaagcaactcccaaatgcagcatagttttgaggtgataaagaagagtcttttcaaggctgggcacaatagttcacgcctgtaatctcagcactttgggaggccaaggcaggcagatcacttgaggtcgggagttcgagaccagcctggccagcatggtgaaacctcatctctactaaaaatatgaaaattagctgggcgtggtggtgggcacctgtaataccagctacttgggaggctgaggcacaagcatcacttgaacccaggaggcagaggttgcagtgagccgagatcatgccactgcattccagcctgggcgagagaatgagactccgtctaaaaaaaataaaaataaaataaaaagagtattttcccggagtaccggtaatattggttccagattcaaatgtattgtccagatacacagagggtaaacaggaacgcttcaggcatcctttattaaaagcacctcagtctatgtcagagggccaggcagtccattatctaatgaaaatctcctaccattgatttattttatcataactgcagctgctaagtaattttgtttaaggaatgatttacatattagtgtcttcagcaggatctcatcattagcatctagtctccagaaaagttaacacataacagtgaaaagaaaacattctctatcacatgcttctgcatgcatgggcaatttgagtcataccacctgttcccctcttctgttatgctagagtatacaaaaagcagagatacgcatagtttactatgatcctagatgcttaaatatcttgaattgtgttctatcttggactcattattcatgcataaagactcaacagattctcttcttgcacctctcaaacagcaacatcaacaaaacccaaacaatgtatctttcctaatgaggtgaaagcatgcataccagcctaagacagaaatgttgcaaaaatgttttttgcaagaaggtcagtttgcttttcccatggtaactaaggttaatttctactgtggttaattttggcatccattttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactttcaaaacatatgattagttgaagttaccaaaactatttttttaaataacatttatcttaagagctataaataaagaggaaattttgcactagagatgaagttatgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctcacgtcatttctccaccgcaaggaggattgcgggggtggacgatgctccctatttagtcttctgcattttgttgcttacagttcaattaacatgtcagttagagatgacttttggttgcagttaataaaatatctgaccaattgtatcttaaacacagaggagttgatattttttgtagaacaagaagtctggaggcaggtagttgagagctatggaagagttccgtgatgtcatcagagacctgggccatggtttattctgctgtaccatttttaacgagtgactttggtcctgatggttccaagacgactgctgcttctcaggcaggaagaaagagaaaggacgttcagcctcagagtctctttgtctttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccaccttcctcttatgtatctgatcaggttcctcatcctccaccatcccccatgtgacgtctgatcaccctggcctgtgtcttcagcaaggttcctgttaagttttttttagctagaatcccccttacccccatgctttctcttagtagttttccatccaccaaaccccaccctgctccttggctatcaattcccacttgtccatgctgtattcagagttgagcccagttctatactgaggtctctttcccactattgcaatattcctgaataaaatctgtttttaccactttaccgtccatctctggtttttctttgacactcacataaccagagttttgtatgtgtgtgttgcttgacacatcacaaatacctgggatacgtgtactgattttttacagggtgaataatctttttgttttccccaatatcttagaaacctgaatctttaacccctgggcttagtacacagttaggcatataataggtgcttaagtaagcgtcaactgatgattttaaatgcagaagtaattgtcacttaatgaaatatagtcaggagactcatggattttggcctgtcttcctacctgttcttgtactgcaacagtaagtgtattaaggcaatatttttggcagcacaatcatttagtttgaatgcattagtaaaaggtggagtccaaagaattaatcgctggaaagttttgggaaaacccagtaacaactgtttccatagagtaatttgagtgacagccaggtaatagctacttattggagggactccacagtcagagccttgacagggacctgaaaaagagtgtaactgaagggtaaatgtaaaagcttttgggagaacaagggagtggtcaggctgaggcaaagatctgaaaagaaatgcctcctggggccaagctggtaatttgaatgactgaaggtgactgggtgggaactggggcaacctgaaaagcttctgttagggtaacagagcctccgttgcagctgactgttctatgagaatgtgagtctctattgtcaggtcttcaggttcttccagagaagcaagacaacgggaaatcaccagatttttaactaatggcgtatcattcaacaatttcaaaaaccattatgtgagcccaaactgaccaacgaatcaaacacacacacacacaaaaaaagagtctgcagactaaattcaaccagttggtgacctctggtctgtggttaccagagaagtaattgaaatggagttttgggagaaagatcatatgttgaaatcttgggagataagggcagagaaataagtaagccgagacggcggtaaggccaaggtagaaaaggtagcctttaggaaaattaagttaagactttttaaaacaggaaggggcaaaagatgaggttaaagcagatgaggaaatttactgttatttattttcatcattaaaatacgctttccacaaatttttcaactgtaagagagagtgataaattcaaaataggtaatgtcaaccatattatgaagagtatgtttttgcaatccaaaaaagctaaggcacaacattaaaaaaaaaatctgtgaatttggctttgcaaaggtataagaattaagtcacatctgatcatttttagagtcttaccttttataacaaagaggaaaatttaattaaactggctctgccctggcgaatctgggatgtgtgttcacttatgaagagagactgttaagattcgttaattaatgaggttgagaatagagttgaaggagattggggtaaatttataagtttgtgtcattctgagagttctgtaagtagctgagttacccatgttgtgactgagaaaaacaggagagagcagtgactgaaggttctgagccaaaggaagagaatagtattgtttattccagcagccagagtggcctgtgtgactgtaagtcgcctgtcaagagggagactgcaaggaaagtgcattgatttgatttggagtagttgtaactgcagcatgaagaatatgatatataaggatgataattgaggaacaatttaatggctgcataccttgctgaagttgaagttccttctggagatgaaggtggcaaaaaagaaagtgcttaggtagaagagctttttaaaatgagttaacagaaaacagcagactaaatatggaattgaggagtaggaaatgaaggaaatgaatttgaagatttactttctttcaggatgcagagctggtatgtaatccctctgtttccagtgccttctcccacttccaaatttcactgctcctcatgcgccctggtgtgtggtgcagcttcgagattgagcctccagccttctgtcaggatgaagcagcaggtggctgagatgctaggctccaagtgggggaggtgtttagggctctaaagactttcaaccagtccttgtattttcagccacatttcagtcttcagaggaacctggagcctttcatttctgagacttcttggctacataaactggcatgcgtcttgttagttcctcccactccctgccccaatctccttgtctccccaacatcattaattgagcttgggatttctctggtctcctaagttggttaccagcaggtcattttctaagccaccaaaatactggagctctgatctgttctcatctcctctcctgttttgttaattttcttttgggtaaatgccattttttattcctcttctatcaacctggtagagtttcagggataaagagagacaaatgagtctgctccatctgctgtgtttaactagaagtcccaacacccaaaatccttcacacgatgtgcagggctctgcagtgggcctccccctgcctacctgtcaggccttatctgtgcccactcttcctccttcctctctgagatttcagcaatattggccttctaaggattcttaaagccccaccttcttctctgcttcagagcttttttttttttttttttttaacatgtgctgacctattacgctgctgtgttcttacctggcacgctcccatcatccttcaagtctttgcttcaatgtcaccttctccaagaagcctctcggacctatgtttccctatgtatacagtctcatcacttcctgtgtgtttccttcaccattttaccacagtacatatgaatatttgtttgttagtttgtttgagacggagttttgctcttgttgcccaggctggagtgcaacggcacaatctcggctcactgcagcctccacctcccaggttcaagcgattctcctgcctcagcctcccaggtagtagctgggattacaggtgcctgccgccgcatccagctaattttttgtatttttagtagagacggggtttcgccatgttggcccaggtggtctcgaacttctgacctcaggtgatctgcctgccttggcctcccaaaggctgggattacaggcgcgagccaccgcacctggcctacatatgaatatttgattattatccatctccttcgctacactgcaaagtcaataaaggcagagatttattttggttaccagtgtattccatgtacttggcatggttcttggcttatagtacatgcacaataaatattgaaaggatagatgaaaggattatggatagatgaatgtcttttaagcagttataaaacagttctgcctaaagagtcttttttaatcagtagtattacttcaaatacatatttaaatacacatatgttataaatatataaaatatgtatttaaatatgtcatttgtactattttaaatgtatttaaaataatatatgttatatattaaaataatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctgcacctcctgggttcaagcaattatcctgcttcagcctcctgagtagctaggattacaggtgtgcacccaccatgcctggctaattgttgtgtgtttttagtagagacaggtttcaccgtgttagccagaatagtctcaatctcctgacctcgtgatccacctgcctcggcctcccaaagtgctgggattacaggcgtgagccaccacgcccaggctcatctctttttaagaatcgaaatcagacatcacatatgtgcatgagtagaagtgaatcaactcattgaaaaatgcttaatgcctaatattttctgtgtcagaatatattgtaaaagttaaaacagctaaatgaaacctgaagttaaagtaataccattgtaatatttgatactaacccagatttttaaaatgccttttaaaaaccacaaaagtttaaaaacagtaagattcatttatttattcaaatatttattaaaatccaactatatatgccaggcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtttactgagaaatgatgatttccaatttcatcccatgtccctacaaaggacatgaaactcatcccttttttatggctgcatagtattcccatggtgtatatgtgccacattttcttaatccagtctatcattgttggacatttgggttggttccaagtctttgctattgtgaataatgccacaatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcatcgccaagtcagtcctaagccaaaagaacaaagctggaggcattccctgctactttcttctggtatgcctgaatcactgtttgagaatggattggactttggtgcgtggaaaactggtagcagaaggcttattcactgcagtgggttgggggtaggctgaaaagatgtcagggaggattaactagaggcagaatgtgtcatagttagaagtatttagaagggaagaaagtttgaactctgatactgttccacactaatattcatgccctgaaagaatcagatcattcttgcctctcccacttggatctctagctactggaatttgccaattcttgatatgaacgctaagatttggatggagcttgtgacctcatttagaccatttgttctaaatgctgaatagaaccaggaaaataggaaaagagggtagaattggggtcataagagaggaatcgtcgttctttgaaagaagaaagatgataggaaactaggcacatgagttacgaggcagtggagaaggaggattagaaagggaaaaaaagaagagaaactttatgccaatatcttctacaagatgtttggctggcacaaaactaacactcaatacttttgcataagtaaaggaatgagagaaaatttgggattggatgcttatcccctggaaactgctacaggctggtgttaatgggaaagggatctgtatttgaccaaaagtgcatttccacgtctctacatttctttttataaagagtcaaagggactcaatgatgagtgtgtgtgtaagggaactccacactagcaagtacaggaaaaatttgatggtactggtgaaggatgttgcaccaatctggaggggaggacaggaattggtttctcatggattgatgccgcaagacaattcataccatgagttggctgagaccacttaaaaaagtaagcagtgatgactgggcaaaagagacaaaggaagaaccacatcttttaggggagagagagagaaggacaattaaagggactcaactagatcaagttctgctcactaaaggacagcgtccaggcaaatgttaattatcttcaagaagcaatctgtatatatagcatttcaagatactccgagatgcttttaatttattgaatactttttattggtatttatcataaacaagagactcacaaatatatcccagaggggaggttttggtgtagttgactatagtagttattaaataatctattaataaaagcccacaaaatggaagatagaaagatagaaaaacaaaagacaacacaggatggtgttggtatacagaatttatacttgaagtttaacaacacggaacaagaaactttattaaaatattcatttaaagaacttccatatgaatcaccagaggctcttagtaaaatattgattcggattcacagatctgggtggggcctgagattctacatttctcataagctccaagcagatactgatgctattcttcctcaaatcacactttgactaacaaggactcacacaggttctctgtaattggtgttggtagtcattcatggttagatgtagttgaggactgccctcttaactacctctcggctgccaggttataaagaaagcaagtctcagtacaagttctgtcacttaggagcatttattagccaatgggtacaaaacaatcttacagcctgtgccagagacacagtgaagtcacagttctgtcttttggggtgcttggtgtgagaggctcacagtctacacaggccacagtcctctattagagtggttctcaaagtgtggtccctggaccagcagcatcagcatcacctggaaacttgctagaaattcagattcccaggcccttcccatacctactgaattagaaaatctggaggtggggcctaggaaatctgcatctttaaactatccactccaggtgattctgatgtttgctcaagtctgaaaaccattgttctagcagcaggattccctcaaccatctaactgaattctggcaactaagaatccggtgaaccacagctggacattttggaattcagcctagggcaccatttctaaagatggagaacctactggattcttcttaaactcaatttaaaggcagggagtgtttctaaatgtttttcaacaatcttcatattttgcaaaccactaatatcactacacaggcccgtctaactattaattaggaaaattaatgaaacccctggtgtaataagagctaaatataactgaatcacttacagtggccgcctgtggcatgaggctttttgattaattgctagccaaccaccccttggagttcactcctgattaagacaactgaccacctctgcagtgtagcttaagctaacacacacatacatcacagtgtactgttcatgtgagggtttttaaagactcttaaaatttaccttatcagggcataatttaaacactataacatgtttccattttaagtgttcaggttagattttggcaaatgtatacactcgtgtaaccaccatgccaatcaagatataacatttcgatcacctagaaaacacccttgtgttcctttgaggtcagttacctactcccaccacaccccaggctaccatctggcatagtagctaagttttgcctgttctagaagttgatataagtgaaatcaaacagtatgtactgttttgtgcctggcttcttttacccagcttagtgtttttcagatcagttcacattgttgcattatcagtagttagttcctttttattgcactttgcacagtagtatcccactgaatgactttaccacaacttgtttatccattaccttactggttggtttccggtttttgactattatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgtttctttcccctagttgaaattcaggcttttatgtttggtctctgcgatggccataaagctgaaaatgttgacccaagtgacttggatatggattgaattatttccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctatgtggcgtgagtcagggcttgatagcccggtgattcagaaaccactagtaacatatattgttgttaaccttgctgaacattagaatgattgtgccttagaatataggagccaaatgtttattttattcctaattatatttttagatgcatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagattactttctagaaaaaaataatgcctgtccatctctttcctcttgggaacaggactacatgaatgcccttcaggctataccactttagtcttcacagaacttagccttcctggttgtcaaagggcaaaaggaattattttttcttttccccacgttaacagaattttcacctccgaaagcttggcgtatacacactatatgttttctaggctatttttgtggtggttgtagttattggcaaatcactgggcgtcgggggtgggttgtctgttatttctgatggaataacaaatgctctttgttttccctcttttcagctgacctgaataatgtcagattctcagcttataggactgccatgaaactccgaagactgcagaaggccctttgctgtaagtattggccagtatttgaagatcttgatactatgtctttgcttagaataaaaagtaggttgggtacatttttacttagagaggggagaaacagctgtcacaattcctgttgcaatgtataattcattctttaatgtatccttggcctagagtttgcctagaatgttttgttttatttttagaatcattcctgtcaccattcctcagctactgatgttgaattaagatattgagaatttttattttccaactactggcattggcatcggcatccataattacctttgtgaaacttgcacaatccttgttctacctttgtttttttttctttttacaaaatgtacttagtattagaagactatgactatctgatctaaaccaaacttcatagacatgtgtggtttattagcttgaatgctaacgtgcagatgaatgaagtggtagaggaaaaatgacagaattgctttcctccttttttatcatacatctgtggaaaaatcctgaagtgttacacagctctatcatgtcatcaaatagtttatgtataactctactattgtctgagggtctgtgtgcattgatgatatgcccatgaaacaggcacagtttctttttctttttttctgtttttttttttttttttttttttttgagatggagtcttgctctgttgcccaggctggagtgcagtggagtggcgcaatatgggctcactgcaacctccacctcccaggttcaagtgattctcctgcgtcagcctcccaggtagctgggattacaggcatgccccaccatgcccggctaatttttgttttttgtttgtttgtttgtttgttttgttttttttgagacagagtctcgctctgtcaccctggctggagtgcagtggcgcgttctaggctcactgcagactccacctcccgggttcacgccattctcctggctcagcctccggagtagctgggactacaggcgcccaccaccacgcctggctaattttgtttttgtaattttagtagaggcggggtttcaccgtgttagccaggatggtctcgatctcctgacctcgtgatccgccctcctcggcctcccaaagtgctgggattacaggcatgagccaccacgcccggcctaatttttgtattttttaatagagacggggtttcaccatgttggtcaggctggtctcgaactcctgacctcaggtgattcacccgcctcagcctcccaaagtgctgggattacaggcgtgagccaatgcgcccggcccaacaggcacagtttctgctctgatggaacttacagtctaacaagggataaccaggcatgttcatgaaatttgtagacataagcaaatatatgtataatgtattaagaatgtctacagttggttaaaaaaataaagtgatcttgtctctatttccaagaccatttcaatgtcatatatttagttgtgcaacagtgggacaatggggtactatgtgaacagctaactgtgtggaatgagattcaaagaatgtttgtttgaagaggtgatgtctaagctaggtaactctagaagagtaagcagctctctctctaggaagagcgttctagtcagaaagaagagcatgtgctgaagggcccagagaaagcatgacacattcaggaactgaaaatatgtcagtatggctaaagcacagaattccaggggaaagatctattgtgaaataataggctggagagagaagcaggaagcagattgtgcaaggtttttaaaacccaagttaaggaatttagaggtcaggggatttggcctgggggtgacataatcagattgtcgcttagaaagatgattcttgctgtggaacagagtatggattggtgcgatgtgggagtgacaggagaaaaacctgttgcagtaatttaaaccagcaatgtggtggcttgaattagcagagtagtaagggagataagtggagagaatttagaaatatttaggaagtggatttgacaggcctcagtgattcatttgatgtggtgcagggatgtccaatcttttggcttctccgggccccagtggaagaagaattgtcttggaccccccataaaatacactaacgctaacggtagctgatgagctaaaaaaaaaaaaaaaaaaaaaaaatcgcaaaaaaaaaaaaaatgttttaggaaagtttacgaattcatttgggcctcattcaaagccatcctgggccacaggttggacaagcttgatgtggtgggtgaaagggagtcaaggaagacacttaggtgcttggcttggaatatcaggtgaatgtgggacttgtctggtaaggttagacacggagctgtggtgctcaggagaaatatacaaacaacgtttagggatcatgagcctgtaggtgctgcttgtaacgggggagaggattggatagctccaggaaagtgtagcgtgagaagggaagttatttaggacacaggataagcaacctacagaagggactgcaaaggaatggccaggaggaaagaaggaaaattccaagaggttatgatgccacatgctccatgggaagaaagaaagaacccgttaccagggtcagatgttgctgggatgtcagcataaagttgcggaaaatgcccattggacttagcaacaggaaggtccctagtaactttggtgagattttagaggcacagtggaagtggtgtggtgagttcaaaagtgaaccaaaagtggagaattagagaaggtatgaatgattcttggagaaatttacttatgaaggggagaagagtggggtggtagctagttggagggggctgaggagttaatggaaatgtatgtacagtcacgtgttgcttaacaatggggatatgttctaagtaaatgtgttgttaggcaactttgttgttatgtcaatataggagagtactacccaaacttagatggtatannnnnnnnnnnnnnnnnnnntacacacctaggctgtatgggatagcctattgctcctaggctatacacctgtacagcatgtgactgttctgaatactgtaggcagttggaacacaatagtaagtattgtgtatcgaaacgtatttaaacatagaaagatacagtaaaaatatataatagtgtaatctcatgggctcgctgtcatataggcagtccattgttgactgaaatgtcattatgtggcacaatatgtgtatataagtgtgtgtgtgtgtgtgtgtgtgtgtgtgtgtgtgtgtgtatacattgatccttgaacaacatgggtttgaactgcttgggtcaacttacgtggatttttttcaatcaaatgcaggccaaacatatagtattcgtgggaatgtatttatatgagtatgagaagacagggtgagattacaattattggcccaagaggagatgataaataatgggagttctcagagaatatgggcaggtaatccagagcccaagggagggaagagatacctctcttccactgtaatgggtggggtagagggaaggatctgggcaggtccaggtaactaagaaaccaggtagcagcaaggtgaaggatgtcttactataaaggcttccattttttgtatggagtggagagtccctgcaacgcagttaacagcaggagatgatgaagttgggcttatctttgtggagaataagagagagggcggagttgaaaaccagctgtgtgaacccagaggcggctgagtgtttcacggtagctccaatctgcaggggtgtggtatttccccaggcacacttagcacttgggagccagatgcttctgtcctggggtagggagggaacagctgggcaagagaagtgaggatttgggcaaaagattgattaaaatgatactgacaagtccctgttgggtaggagaagctgtgaacgcatatggaaactggtaattaggaggtagagggatgaaaatgctaactcttcagggaggtaggggaagaagtagtaaaggaactgaaggtcaagaagttgtggtcagagagaatcatagatgaacattattttgaaggtggaacagtttcaggtgattagatctaggatatagccatttgagtaggtggcagaggtagagtggatgtgaatttccatggaggtgaaatagcaagttaaggaactgagaggctagaatgatgcatgagtcccccatgccaatgttgaaatcatgcagaattggagcgagaactgggcaaaagagaaggaccgtgaaccctggctgccaggtcttcagaaataaaggggttcaaccagaggatctgcagaggctagcaataagatagtcaaggagtcacttggcatatggttcttacacagagatagagaagaaatgccttagaagtggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaaaaaaaaaaaaagaaacccagaaatagaccagatggaaaaaccttataatgactgttcctttctataatgtccattttcaccctggatttaggcattattcgattttcctgctcaaaaaaaattccattcacatatgtgttttattgtctgtcatttcaacttataatttccaataaacattgggaaaatgggggaatttcataatatacaaaattttgtccatttgaggtgataaccttgtaataaaggtaagctccgaatgtagaataatttctttaaattttcacttttaaatcaatttgaaattctctgcatttcctttctgagcatggcttttctaatatgtgaaaaagattcaagtatgccaaaattaaggtgtatgtatctaaattaagtattgaattctcattaatgctaggagggtgccatatatagtaaaactatagaatgaagagttcaccccatccttttattgaacatatgtgtggtcacattacttactttcaatatatgatttaagaattttctcctaattttatatttgcttagatttagcttccaggcttttgtcatttctaagcctgcaaagccatgataaagagctattgtctgcggtacaggcaaataaaacttgccctggctagctttccctaccaaaggccacttctaccaactctaactttaaggaaaattaatgatgttatctcagtgatttcctggtgccagtgaagagtttgaattacagatgccttggaaatatgcacttccacctctattaagcacttgatcttatttttttttcacttccctatcaatgtttccgtattgcagaaagccaaataacccaattgtatccactatagagaattcactatttaagtggagagcatcaccgttggcctataatgtccccagtttgtaatcagttaagtgttgcatgactccttactgcctctcaacacattggaaatgaaaatgaaacttggtagaaaagcaggaacaaagataaaatcttggtaagaaggatttataaactgtttcatatagctgatactccattgaaagttatgaagaaggtaatttaagcattttctttctccctttgtagttctgatgacattctacaggtgtgaggcttctaaaattaaaaagccaacttgtaagagcagaaataaaaacgcacttaacaaagcaagtgtatttagtttattaataatgtgtggtgggttggagagagcccaaaccatagggctaaatatactgcagttgataagtgtgacaaatattctgcaaacagtaagaaatagagaacattttgcctctattcagcaactaaagcacacattatagagatttggtacaggctggagttgtgtgaatagtcacagtttctggactcgccctcaccatgacaaaccaggtgaaaaatgcaccgccttctctgtaaatgcacctcaccttttgatggtgcgctaagggtgacattagataggcttcagttgctaaagaagactctcaggacccacaataacatggcttacaaatccgcgctctattgccagaaaaggctacattacaagagcattactgtcaggatatggatccacagccacaggctgcctccacagcaagggggtctcgagaggccagtgtaattattttgccactctcctacaaaaatctactttttctatataccatgtattatttttcacataggttagaggccatgtctctgttagttctgagtttaagacgtcttgaggacatggccaaactaattttctcagtttatatggtttgacagatattagtgcccaagagaggtctcataacatgacccatctatctcccaggggaaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttttcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttccctttaaaaaaaaaaaaaagtatcggctgggctcggtggctcacgcctgtaatcccagcacttcgggaggccgaggcaggcagatcacgaggtcaggagttcgaggccatcctggctaacacggtgaaaccccatctctactaaaaatacaaaaaattagccaggcgtgatggcgagcgactgtagtcccagctactcgggagtctgaggcaggagaatggcgtgaacctgggaggcggagcttgcagcgagccgagatcgcgccactgtcctccagcctgggtgacagagcaagactcggtctcaaaaaaaaaaaaaaaaaaaaaaaaaaaggaaataaaaaagtatctttggtggtttccttccccttgcaacaatctcacctttttccttttatcattaattttaagccaaacctcttccccagctacacacacacaccacacaatgcagacagtccccaacttgtgaagtttcaacttaacaattttttgatttcacagtgatgcaaagtgatatgcattcaatagaaactctacttctagatttgaattttgatcttttccgaggctagtaatatgcggtatgatactctctccccttgctgggcagcagcactgaacctcagctcccagtcagccacaagatcatgaggctaaacaactgacactttactgtgtaaggtgttgctagacagttttgcccaactgtaggccgatgtaagtgttgggagcacattgaaggtaggctaggctaagctgtgagtttcagttagttaggtgtattaaatgcatttgtgacttaagatattttcaacctatgatggggttgtgtgatagcttcaattaggcaaggcacaaggaaggagtaatccattccattgatccttgtggaatgcttgtgcttaagtaccaactaatagccatagtatcttattttggaatattaccagcctttgaaactcttaattgtagccccagttcagggactactaggtctggcatcaaaaaagaaacctgtagtgacatagggaatacctgtaagtgccccacttgaattatctttttaattgtaactggtctcacaggtgtagcccatttctcaaaaatgatagttgcttcagctttttggttgggactccacctgcaggccagagagggtgaagcccagtggaaagaaattctgaacttaacattagcttttgccaacccagccaaggaattggattttttttagcagccttgccatcagtttgcaattgcctcctaatccattttgttagctccttaggttcaagttctctcacttccagattccactagaaagttacaccatcagtaaccaatttcaaagcctgtgttacttttcaaccaagcgtagcttgttgagcaacttcaaaggttctttttcatcccttttatcagaatcttctttttttctttctaaataatgcctcagtcatacttttagctaagaatgagttggaggtgttctaaacaatcttgcttctgacactcactgccctgacagtggaagttaaacagggttcaattgctaaagaggactcacaggaaccaaatgacagtgcttacgaatctagagttccttgcagaaaaaggatgcaatatacccacaacattaaaacaagaataagtgtcacagccacagcctgcctcacagcatagggtccagagaggacaggtgcaagctataattgccctctgtctacaagagccacaccacgatgcattttctctcttggaacaagagctactgatgtgagcacagaacaccttggaaaccagggagcacaaattggagtttcagccagggtttcttatatcccgtgggtaacctaggcatactgttcctatgtaaccagcctcaaactcagtggcttccgttggtctgactgtgcccgggtaaaaatggtcaatgttactgttagcaataaacaatggtgataacctgcaacccatggctacacttcaacacagtaagtcactttgaaaagcaagtgctttgaccagggctctgcactgtgtagatattttagcaagtcatctcgtgccaactccagcctctctggaattaacccttactgcacagacaactacatcaaagtgcattgactttcttgaagtgcaaagatttgcttgggaggtccctcagccataagtgtaagttgcctgtagagtggcatgcctgggcaagaaaaatcagcaaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctggatatcctgccataacacccagagtgagtctccatatactctggtctcagttgtctcaactgcaaaatgattttaaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtgggatccctgtgttgaagtcctgcctgctcgccgccccccacccgccactgtctgcttttcctgcacagcatagaggatcctggagagtcagccatttcttttatcctgtccccaccctctctcacccccacagccctcatgcataggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacatatatatatatatatatatatataatatatttaatggaaattcctagcttaaggaaacaatggttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcatggattgtgtatacctaaatggaaattttttcaaaatagctccatgaaagttgaattctgtttgacatgtttgtttagggaaatgtgctcttcagtcttctgtgatggattgttcttgtgtttaaccacatccagttttagcagagcacactgcacagtatttctctcctaactgtgtcatcttctgctcctgtaatttcagagcaattgctttgctcccctctggagctatttctactcaacatttgctgttctatgtgttacccattcacctgtacagagataagagcaggccccataaaatgaaatgcatgcagtttttctctgttcatttccatcacacggctaaataagactcttaatacaaaagtgattcgaaaaattttcactagttacttcttaaatgcctggatcagaggcaaaatatttatgatgactaaagcagagtaacaaaaaagaaaataattgaaaaacttcaaaccacccatagcttccttcagtatataaggaaacatgttgggaatattggtgtttggaagaaatccattcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaactggatagattatgcaattactttagtttgcctatagaaaattttagtggagagtatttttttcacctaatattagggtagcagagagatgctgaggtgactgatatttcaaggagaaaagcgcttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttctcaaactgagaacatttttcgttttcttttgttttttaataagattttatgaagtttcagtttggcgcctccattcatcactctctcttagagaacaattgtttgttttggattgcacacaagggagatatccccagttctgatttttttttttcttgagcttaatgaagacaattgaagaagggagcagaaggaattggtcttaattttgcctaaattcttcttagatctcaaaattattacatgcctcatttcaccaatcaagaacatactcccatttggaaatctgggaaggttttctgaaaagagttgcaaaacaactgttttgccttttacctttgttgtagacttctactaccttttgaactaaaatttatacctttttttctttcttattttgataaggtattgctttttaaaatttcaggaccacctgactattacattcatcatagtcatctaccaagtccttgaacatgtcggatttcaattgtgaactacgttcacattagttttgataagagtttgtattcaggtttcccctcaaatatattttggcactgttttctttgcagatgacatgtgaatgcattctgaatgtataacttccttctacctgactgaaaagtatttggtgacaattttaactccttgaaggcctgagttgctgtataaagtggatttgttaaattttgatctaccttttcttaagagggagaaagataagaaaattttccagtgataggaatttggttagtccattagtgcccaggatttctttttgactgagggatttaataaattttagcagctggaagttgagcatattgttcaccgaaaataaccgccattgggacctatcctttgtgattttgaagtgctaataggcgaattattctgaaatattttctcctttttctttttaccaatatctaagggccagtagctttccgtaataaaataagaagccaaaaaactattgaaagacactttttaactttaattttaggtttcggggtattatgtgaaggtctgttacataggtaaactcacgtcacgggggtttgttgtacagattatttcatcactcaggtattaacccatttatgcctagtgttccattattggaacactaagcttgtgggaattattcctatcctactgctcaaggtcatcgccaaggtctgattttcacaaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttttcttaatttacgtagaacttttgcagttcaaataagggtttttaggaattgaaacttggtaaacattcagtggtcaagttggttgaacttccattgcattgtaggtcatcagtcaaagagataatgaatttggaaaagttcaaaacaatcttaataaaacagtggtcaatagagttcacacatcattgagcactttactcttttatttttccttttcaaggctttattcttaactagaagtgtttaccctctaggaaagggtcagtaattgttttctgctttgattcttcataataggggacgaacagggaggatccgtgtcctgtcttttaaaactggcatcatttccctgtgtaaagcacatttggaagacaagtacagatgtaagtcgtgtatactaatgctgtattcttttattaatgttggctaattaccctagttctagatgggaaatgacagactgttcttatttgacagcagattcctcatgtaagatgtagaactgcttttagagtgtcataaaatttggtttgtgccattccttgtcaaacattaaattgcaggcatttaagtagagaatgaggattagcttttccagtccaggtattattttacattacattgactgtgtctgaataaaacacatgttcctaggggataaagtctgattttctaacctctttctgtaagtcggaaaaataagtgtgaagatttaatctctgcacttgtctagtctttgggttcttatttaaagaataccatgtgacattcatgttcaagaaacattgtttattttataatcatcttactgcaagttgtactgacacatccaattccgtgacgtgactaacattttattatttgagagacagatagcttgctgtttcttaaaggatagatacgtaccaccctacagaatttccttttgattacgcattgggttcttctgcttaaaaactgtaaaaccaaattaaaagccaatgctagaggagtgatggttcagatgaccaagtgaccatccattcatattgtgaaaggctgcagttggttttccccttgaaatgcttataagcaatcttttcagtaggaatattaaacaaattcagcctagcttgtcttttctctcttcccctgaggcctagccacacatgtgaggagatgtgctaagcttcaggacaggcaggagataaaagccactctgtctcctactgatcatttctccttcaggagtaagccacaaaatacacaaaccattttggccctcacttttatgtagtttccacttgagttttctcatcctcagaacgagagaaaaataactgaacagcttttgttaaccattttaaaatgtatttcggatgagatgggatacctgtgtgcttttctcctttaaatattgtagttacttagtataggttaggttctaatctaccgtatatatggtatagtgacagcacattgtaaatataatattaaattgaataattgaggaagctttgagttggtgtttcgaataactactaagagggaacatgtttttaggttggtgaaacaaaaatattaaatgcaaaatgagatgtttgaaagtaactcataactttgaaaataaacacctaggtatgtatatcggagagcagataaaaagctgtgcgtacaatctcaatttttagtgccatcttaggtatcctgttaaaacatttaatttcctagagtttaaagtgtgcttatgggtacagaaagctttcttggatttactttttttgaggggcaacttctaggtgaatataaggtatgattaaaattttatatctgagaacaaaacataacattgcaagcattcagtatgttcattcattctgttacatatattgggcacctactatccaccgggtactgccattctactgtagatacttctggcacacaactgaccaagatatggttccttccctcaaggggatataagtctcctgccaaaaacgatagacacatattgaatcaatgccagcataacatgatgtgagctattaattagaaatacgcagccaggcgcagtagctcacacctgtaatcccagcacttagggaggccgaggtaggaggatcacttgaggtcaggagttcaagaccagcctggccatcatggtgaaacacgtctccagtaaaaatacaaaaattagctgggtgtgatggcatgtgcctgtaatcgcagctactcaggcggctgaggcaggagaatggcttgaacccgggaggcagaggttgcggtgagcagagatcgcaccactgcactgcagcctgggcgacagagcaagactccgtctcaaaaaacaacaacaacaacaacaaactatgcacagtatcctgtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacagctgtccttttttttaaaactgtcctttgtagctttgacattcccctattattccaaagtctagaggtgtatactctctgctaatgtccatcactgactgaacacactcttgtccgttctctttcctatcctgtcccattgctttttctctgtcgtagtcagtgccccagaaacaccctcttcttcccaaatgcctgagcactccactggtagacattcatcttgttctaatttttttttctctttccttttttttttttttttcttttttgagtgcagtctcgctctgtcacccaggctggagtgcagtgagtgagatctctgctcactgcaacctccacctcccgggttcaagtgattctgctacctcagcctcccgagtagctgggattacaggcgcccaccgccaccccaagctaatttttgtatttttagtagagacagggtttcaccaggttggccaggctggtctcaaactcctgacctcaggtgatccacctgcctcgaactcccaaagtgctcggattacaggcgtaagccaccgtgcctggcctctaatttttattaggtagatagtgctacaatgaacatccttatcgtttagcttttgtctttgaagctttctttataggatcaattctcaggcgtgtgattgccagacaaaataatataaacattttttgtggcctttcttcaaaagttgttctaattgtaacgctatcagtattgaaggagtaagatgctttcggtatcacattattcacagtgttcttatgtttttgtttttggttttttcaagtgctaagagctgtttttcttatgtagggtttctcaatccattctaattctattaacaatggctgagatttacaaaatggaactagctgtagaactaactgggttatatctgaagtctttgaccacagactaggatgaaactatagaaggtttcctgggcagatcactgtgaatatttaggtgtttaaagcagtttgagtatttatttaatagttggacagatttaccggatgcacacataataagttcatttatgtaaagtgggatatactgtttgaattattttgccaaaattatggcaaattagttgtaaatgtaaaatgcatgtggagaaataaatatcttttcctcctcatacccaaaccttccaaaatgcagatagatgatcaatccaatcaatcatcaaaatgtagacacaagtaacttccatacaatgaatattaatggccacaggcaatctaggttcattttgattttttaaaatccaattataaaacaacttgccataaacgcgagttatttcctaatcttttggttgtgtgttttttttgttttgttttgttttgagatggagtctccctctgtcgcccaggctggagtgcaatggcgcgatctcggctcactgcaacctccgcctccctggttcaagcaattgtcatgcctcagcctcccgagtagctgggattacagggtgcctgccaccatgcctggctaattttttgtggagacagggtttcaccatgttggccaggctgagctcaaactcctgatctcaagcaatccacctgcctcggcctcccaaagtgctgggattacaggtcctaatcatttttcccctttagtcaagtctcagttactctttgagttctagtgaaacacacacacgtgttcatatatagggatatataaacatatgtgtgtgcattgtgacttgggttaaaggtaaggctcagtgatggtccctgctgcaaagtaaactaggctgtattcagggccagctggattctttgttttctcgcccgagtactgactcatcaggaagccaccaccatcctcactgcagcctctggccctcttggatttggttgtcaggataagcggtggccatacagaagctctgctttccctgggctgccccccttatcaggagaccaacctattccatttctgcctgctacatccttttgctggataacctcctactcccctaagcccatgtctctggtttggttacatttctgtctctgtaataacaactctgtattctcagtctcaaagctttgaattcagtccatccttgcatatttgttgaatgcctcctggttggccagccagtctccaagctctttgaaatgtgaaatgtgttttgttttgttttcagaaggggtctaacttcgtcacccaggctggagtgcagtggcacgatcacagctcattgcagcctcgacctctgggctcaagtgatcctcccacctcagcctcctgagtagctgggactacaggcatggaccgccacgcctggcatttttttggtgtatgtgtgtgtgtgtgcgtgtgtgtgtgtgtgtgtgtgtgtgtgtgtgtacagggtctctcgccatgttgcctaggctggtctcgagctcttgggctcaagctgtccacccacctcagcctcccaaaatgttgggagtacaggcgtgagccacggcatccagccttgaaatgttttctatgagactggggggaaatcagtcaagatatgaatggtggtaacaggtggcttttgattttctctgtactatttttattttctgagttttcttctttgaacatttataattagaaaaaaaattagtaaagtgctgcctctttttttagggaaagaaacatgttttgtttgattgctttccattgccattcttacattgtttccaggccttctcatcattgcactggcttcctagcaagcctccacttcacactccagtccttttcattggtcttattgccctcatactagttttagagaaaagcatttcccatatgatgccgtccttgaaaatgtcagtatctttctgttgtctagtgaacaaatcctaattcctctatttaactctcagacctttcctactctggtttcataaccacccatagtttgctttcactatcatgaaacagcttctccttaccatttgtacctattatgcttataaataatattgttaccattgctactaacaaaactttgttcacatgaattctctcatttaatcctcaccaagtctttgaggggaacagaatagtcaggctttggagattttgcttttattattgtttaagtggatgaataatttatttgcgcccttaaagtccctcagctggtggaagggtttgattcctagtccagtatgcccaccgccacatttactacctcattcccaaatatgtagtttctgatacttctgctctccagcttcccaaggccaaacaacagctacttttcctgagtcctggatagaataagaaaaggtataacaagacaggggacccttgagggggaagaggaattagtttgaagtgctggcaaatgtagtatttctaatcagatgctagtaaattccatatgtatggcgaggctttcattacttagatttggggagcctctcagcattttagcaatttgcaatcaggttgaatggatccattgtaaatacttaggaatacttaggaatccacgtcctggccctggcatgcttttcctcggccaggtgcactggcggtcaccttgcctttcattgtgccacgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacatacatgcacacacacccatctttattgaaaatactctaatcccaacatagctgtttagtctatcttcagataaaaccaagtatcacttttaggtgggaaaactatacagtcatgtgctgaagaatgacgttttggtcaatgacaggccatatatactatggtggtcccataagatcaacgtaagaagagattataatggaactgaaaaattcgcattactttgtgacactgtagccattgtaacatcatagcacgaagaattatttcacaaacctgcactgccagtcatttaacaggtaaaaaagtatgttttaaaatatttttaattattatggacacataatagtactcatttatgggttacatgtgatattttgatacaagcatacaatgtgtagggtaacacaatcagagtaattggggtgtccatcatctcaaacattcatcatttctctggtaggaacattcccatttcactcttttagttattttgaaatatacaataaattattgttgccatgcatggtagcacgcacctgtaggaccagcgtttcaggaggctgaggtgggaggatcacttgcgcccaggaattcaaggctgtaatgcacaacaattgcacctgtgaatagtcactacactccaacatggacagcatagtgagaccctatctgtaaaaagatttaaaaatatattgattactatagtggccttattgtgctaccaaacactagatcatatttcttcttactgtatttttgtacccattaaccatcccttttttatcccccgatcttcactacatttcccagactctggtagtcatgattttactctatctccatgagttcaatttttttttttttttttttttttagctcccacacatgagtgagaacatgggatacttgtctttctgtgtgtggctgatctcaacataacgtcttccggttccgtacatgttgctgcaaataatgggatttcattttttatggctgaataatattccattatgtgtttatagtacattttctttatgcattcatccactgatgggcgcttaggttgattctatatcttggctattgtgaacaatgctgcagtcaacatgggagtgcagatatctttttgtggtttcgattttgtagtatcttcttcagtaaacattttaaggactttattgtttagataacgtcaagtataccaactttatattcaatatgcttcacctatgagagctggagtgtcaaaatctgtttattttacatctgttttctgcctcctgttgtacttagtattccaaatgagtaagttgcttttccatctatcttctgaatttctctatttgtatgacaaaaatgaataccatctatgcacagttgttgtaataatgtagaatgatatgaaaatgagaataaattacagtctcaactgttgagaacaagtatttctctgtgttagaaacattcccaattctactcttttagttattttgaaatatacaatgtattattgttgccatgcatggtggcatgcccctgtagtcccagctactcaggagactgaggtgggaggatcagtaacacataaatgagaaagcattccagaatatctggagaagtgactggcagagtggttaagtgcataggctttgaaaccgaactgtgcctgagtccaaatctgagctctgctatttgctggctgtgtgactgtggacacatttcttaaccttcctggcccctgaactcctggaggtgattgtgaggattaaatgaaccaatagaagcaaagcacttaagagctgtagtggatacatagaaggtgcccagtgaatgttagctatgattatctaaagtgtgttgtggcatgaaaatatcctgccaatgttaacagttgcttttatctataacaaaacatcatctgtggattgcattttagagattctggagattctgtttctctgcaaatgttaaaatgccatatcaggagacttttggctggttagacagcattccccgggtcaactgattactttttttttttttttttttttttttttttgagacagagtctcgctctgttgccaggctggagtccagtggtgccatctcggcacactgcaacctccacctcccaggttcaagtgattcttctgcctcagcctcccaagtagctgggactacaggcacgtgccaccacgcccagctaatttttgtatttttaatagagaaggtttcaccatgttggccaggatggtctcaatctcttgaccttgtgatccgcccacctcagcctcccaaagtgctgggattacaggcatgagccatcgcacctggccgattccattttattaatagattttccatcctgaaagtaactcctaaaaaccctccttcacttaggtttcctttggctttttgtgtattaatcagactgtgggccctttggttccatagacattccttttacaccccttttggacggatgaatactcactagtaactaagtaattagtaagagttactacaatttggtatttataaagaggtggcctttcccagaattgaaggtagaccctaatagtccaatcagccttccatagagatagctggctgccatgaaaagctgagagatatcaccgacctcttactgggcctgctcatgaacagttagttaaaattcctgcaattttcagaaaagacccttatcagagtattatcagtattgtcttaagtttaatattggtttccagttgttatttttaaaaattttaagctaccgtgggttaagctttatgatgatctgtttaagtggtttgtttgattaacttctctattggagtaatggatgttttcttcaccagaattttgaagataggtttgtgttgtagttgaaacctgttttgtttatacacttactgctaaggaaaagcacatgtcattttgttttccatcttcatccttctaaagtagcacttcattgttatgaccaaatctttctttcttccttccttcctctcaccctgtcttttccttccttccttcctgccctccctcccgcctctcttcctttcctctcctctcctttcctttctttctttcttttctcttttctttcgttctctctctctccctccctccctctctctctccccttctccttccctccttccttcctttcttccttccgtttctatcacccctaaaattccatcatgctgtatcatctcactaagtcccaatctctggaaaccacagctctgttttctgttcctataattttgccttttcctgaactggattttaaaggattgtaggaggcagtagtggaagagctaactttatatcttgttcttttacataatgcgccctgatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggtagttatgggaagccttttacttcttcttgtctcacaaagacaactcttgacctctcaatccttaaacaaaaagttctgcttctgcgcatgtggggactcttaaactcattttcatgcctggagattcacatttagggatctaggaaaagcacatctaggcagagtcgatgaggagatgctttaagaaccgtgacaaggacaggaaggaaatcaattttgcgttaggtttgtatttttagagaaaacgaatcctggggaacttttcacactcattactattgacattaataccattgtcctgtccctttcacagttactaaaatcactcttgcccaccctcctgccttgcccacaacctattcccatgaaggggtgacttgggagaaataacggtttccaaccaacgttttattttggaaacatttcaagcacaaagagtagttgaaaggatagtctaaagaacactcatctgtgtcatacatctgttcaatccatggttgcttttcgctctacttacctcctccaccctctcagctctgtttatgtatgtgtctgtctgtgtacatacacacacaaacacattttcccctatgccatttaaaagtaaaggagcatcacaacataaacccctaaacacttcaccatacaccattttcttaaaggatgacattctctaacataactgcaatgctatcgttacacacaaatttaacagcaatccagcaataccctctgatatgcagtccacactgaactttccccagtgccccagaattgttccttatagccactgttttcttccagcatctagtcaaggtttttgtctgtcatgtctctgtaccttcatttagttttgaacagtctcccagcattttgttttcctttcatgacattgacttttttggtagggggacagagtctcgctctgtcacccaggctggagtgcagtggcgcgatctcggctcactgcaacctctgcttcccgagttcatgtgactctccacctcagcctcaggagtagctgggattacaggcatgcaccaccacacccggctgatttttgtatttttagtagagacagggtttcaccacgttggccaggctggtcttgaactcctgacctcaggtgatccacctgcctcggcctcccaaagtactggaattacaggtatcagccaccacgccgggctgacgttgacatttttgaagagttcagaccagttctcttgaagaatgtcccatactctgggcttttctgatggtttccttgtgattagattaatgttaacattttttggccaaaagacgataagatgatgctctgtacctaccactgtatcacaatctggaggaacaaaataacattttgttcctattggtatcactaagaatgttaaggtggtgtctacaagatactttccttgtaaaatatccttttccctttgtaatgagaaagtaattttttgatattttgacatattataatatccattccttaaccttttaccctatggttttagcatttatggatgatccttgtctaattcagttataatattggtggttgcataatggtggctttctaattctaccatactttctgcatgtattagaccattttcttatgtaaagaagagcttctacctctcccccgtctattcatgaatatcactgtggacatccaaggtggttctgagtgtacaaagaatgatatctctctttactgaactgccattggatactatttttgtcttggaattgtttaaaatggcagtgtatggaattgaaagtcctttctccagagagccacataaacagatgtctaataaatacatttccatattaaccaatccttttatgggaacaacacattgacataattaaaacacgtaacatgaaaactgtgctgaattgagaagctcatagagttttgtttcttttttttcctttttgccacttcaatatatatggacccgcacctgtcaatccaggtagctcatacatgccgtagcatctaatggtacgagggacatgtaatgctgaaaagaagggggaaaggagttgatcagatgagatataagtatgcatttatcagtgttgtggggtattcacttgcaccttccattggctctcgcagccatgttatcggcatataattcagttgaagatttatattcacctggaaattgtcctaagtgggccttgcttacttagctatcagactctagtactttcaaacaaattaaagattcaaaagattttggggatcgccttgctttttcccataggaaatcacttttgtcctgtctttttaagactattttaagcatatatttcagtattaaaatcgtagataatcttaagctgtttccttaacctctttgggccttttcttatctgtaacgtaaagttaaaacaggttatctcaaaagttacttatccctaagtgtctttgattctatgctaaatgttataaaggccgaaagggaaatggattattgtacttatttcaaagcttggccatgatcagcaaagtcttacctgatcttccgggtaacaactcttgtatcagagctgtaagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacctgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcacttctaaccgccaataccccccccccgcccagttgtgacaaccaaaaatgtctcccgtaaaagataccaggatgaaatcactttttgtcagtcccaaactaactagagccagggcagcatgaaaggaggagggttcatggttacatgcctgagataaagactgtctcaaggactttctaaaatcgccccacaagaaattcctctgttaggactgcagcagtgcacgtaatatgctctcaaaagaacatctgcccagtaatggcatccccactaataaactgacaccagttctggcgttgagcatctgaaacgaactatgtttccaagcagcttatgtaaacttctgtttttaccaataaaagtttccctctacagtctcctcttcagatgcatcttgggttgtaatcctcatttctaattccaaaataaatttaacatatttggcgatgtttttctctgatgttttttggtcgacactccaaacattgttatatttcctctggggtacggcatcatttccggttgagaaccaccgacctagagaaaagctatctgcctgtgcagttcctttcaagggccccaagtgtgaattttgtgtatacctatattttaagccagatcattctgtacataccttctaagtccagatgaagtctgttagccttttatgtgtgataccatcacatagaaaccaacacaaggacatttactgtaatcgataaaggaaattttggacagtttgagaaagtaacttattttgtcttctgctctttataaaatctttacaagtgtatgtttttgctcttcaggatgactaggcagctttttaaaattctgacttcatacagattttataatcttccttttatttcttgcgatcatattgcagttgaattcccacccactgttcaattcagcagattttaacagagactccagaagtatagttcctgtctttaattaatctgcaatttaggaaagaaattaaggaggtatcgttctgtattgtttccaggatggtggtttcttgttatctgagaattactgggcacagtctcttgcccaatgtttacttctctatatagagttgacccttgaaaaacatagatttgaactgtgtgggtccacttataagtggatcgttttcaaccaaatgcgtatcgaaaatgcagtactcaagagatgtgaaacctgcggatatgcgttcagctgggcctactgtgggacttgcgtatgcgtggattttgctgtatctcaacagcaaaatccccgtgggagtggggctgcggcgggccaggaagcaacccctagcatatactgagggatgactgtactaattattgtagtttattaagtgttcacatggttttcacaaacctcacaattgaaatgccaattgccttctcctaaaaaatacaatgtacgtgttcatggtagctgggatgcagggcttgctgagaaatacttaattgcatttcttctgtagccatgaattgattttattaccttgagagaaaaatgagtattcaggtggacctcctggcaggcggttggcccttcagtgtccaaggatttatagaaagcacaacatcaaagaaatccaaaagttcttcggaaccccagcaactctcctacctccaaacttgccatgtaatgcccttttaaacttattatattgataggtaaatcggtttgctagaaattccagatattgagaattctttgtctgtgtaccttgttatatttgtataaaggtgatatttgtatgaagccaccctccagtgtgctgtaacagagcaatagtaatgacaactgattccttcccctagcttttctgttatggatagttgctggcaggtgaggaccaacagaaaaagaggagaaacccaacataattccaaactgtgaccatcataatggaaggagctgtgatagctttgctttctgtgtgtgcatgacatagaaggggaaaatggagttattgccaaaacaacagcaaaagcaaaacaaagccaacaaacaaaacaaaacccagggctaaatgacctttccaagagattttgcttgcatggcttgaaactggtgtttagagatgaggacaaggtcacccttgatactgagaggggattatatctgagacttatatgtatctcaacaaataatggtacttacaaagattatctcagtccagtgaatgccatcatacttatcttttgaccttaataacttcctgctattccaatctatccctatatatttttttctggaatgatcgaaatgtaattttagctgggtttaattctagttctgttaggtctttacagaagcttgcctggcttttaattctttccttcttcattgccagacaaaaggagagggaatataccactaggatacagagtagtttgtcataaaaatgaaagattgaaacagaatgagaacgtgaatccccgtaccttgtcttcagtctgtcagttggcgtaggtgagcagttttaaaagagccaacatgatggatcttgcatcttaggggctagaaatttgagaatgttcaacctttaagcatagaagaatctatagttttttgaaagagtagaacattctacagcctcccttggtaattcacactaatgctttaacaactttcagcatcaggaaattcttccatatgagctacagcctaaattcttcatgctgcttaagtctgtttcttcttgttctgtcctcagtggagagatcgaacagctggtcacaggcccctatgcgagagccattcacataattgaaaactgttattaaatcgccccttcagaagtcactcttgcttgttctctctctctctctctctctctctctctctctctctctctctctctctctctctctctctctctctctctgagaatctgggaagattccagagctgattaacatgttgctttactgatgaccttctcagcttttaatatgttaacgtgctctaagaattttaagaggcagatataatgtgcactgtttctttcattaatttgaccttctcgtgaagcattttgctggacgattgatctgctggacatactgggaaacactgactcagagattttagttgagtaggaaccgtgtgtgagcctacggtacagaacaaaagaaagtaatccagttacactgtctggagaaatagaggtacattctccgcaatcatatttgaagaatagttttctaaatgacaatggcaaactaagccgtgtcatatgaagaagaagtaaaaagaataggaatgaagaggcatggacagataagacagctctggtaaaatatttaaagggctgttcaaagaccaagaacttctgggttgctggtcagatggataataataatgacaataacaatagcaaacatgattcttgctatgtgtcagacacggttccaattgcctttcatttgctgactcacgtaatcataaaataactctatgaggtaggcactattaatatttccagtttgtagcagagaaaaagtaagacacagagagataaagttattttcctaaggtcacacagccagtgagtggtgaactccagtggtttaactctggaacttctatatgctgtgctgatggatttcagctcaatgtgatgcagcacttttgacaggggtatctggacacaggtgttcaggatcaccttctaaggatgtttcccagctctctcacatgggtggtgtagtggctgtaagcacacactggcatgggtaagagtttggactcgatgaatgctgagtttggactcagtgaatcctgaaagtcttacagctctgtggtgccatgccaaaaggatgaatggacttgcatgatctttttcatttttagattgcataattctttataaacttttttttccacaaagtacctctgtgatggaactctacacagagaaaagtgctcagcaacagctttttaaaatttaacttgtaagttcaggggtacctgtctaggtttcttatgaggtaaacttgtgtcatgggggtttgttgtacagattattttgtcacccaagtattaagcctaatacccattagttattttcctgatcttctccctcctcccaccctccatcctctgataagccacagtgtgtgtttttcccctctatctgcccatgtgttctcatcatttaactcccacttataagtgaaaacatgcaatacttggttttctgttcctgcattagtttgctaaggataatggcctccagctccatccatgttcctgcaaagaacatgatctcattcttttttctggctccggagtattccagggtgtatatgtaccacgttttctttattcagtcttccattggtgggcatttagattgattctaggtctttggtaaacagtagcatttgatcggaagtttgaactgataccattttgcagctaggaaatccaaagttaaacagtttattatagtgttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaaaaaaaaaaacaaaaaacatattaagcacacaagaaatcaaggtggaaaaagaaagaaatcaaggtgaatgagaaccagaagaaatagcaaaccatagaagcagacctacgataacatcatattccagaattattagacagattattttcttaattgtgtttatgcagttagaaaaataaaaaacaacattgaaaaatatctacagggaaccacaaacctgagaagttaccttaaaaatgaccaagtagtatttctagatgtcaaaagtacaataatcaaaatttaaaactgtatgggtttacagcagaccggcaagagaaatggatacccagacagtaaggcagaaggaattaataagaatgaagcacagaaggatgttttaaaaagatgtggggcagagaggggggaactagggaagtcctgttcagagaaatatagattgaagaagagtaacatttatgtaacagagttctgaaagtagaatggagagggaatggagaagaggcactatttgttgagagaatgacggagaagattccacagctgattaaagactctaaatcacaggtttaagaagtccagtgaatcctaagcagtctaaatcaaatcctagaaacagcacaagatagaaaacagatagattatctttattttttttattttatttttattatactttaagttttagggtacatgtgcacaatgtgcaggttagttacatatgtatacatgtgccatgctggtgtgctgcacccactaactcgtcatctagcattaggtatatctcctaatgctatccctcccccctccccccaccccacaacagtccccagagtgtgatgttccccttcctatgtccatgtgttctcattgttccattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcaaaggagcaacagtcatctttactattgacttctcagcagcaacagagatagacgaaagtggagtaatatttcagtattcaaaaacaaaataaaaacaagaccccaaaacctttcaatcaaaaattttatacttgggccaggcgcagtggctcacgcctgttatcccagcactttgggaggccgaggcgggtggatcattttaagtcaggagttcgagacctgcctagtcaacatggtgaaaccccatctctactaaaaatacaaaaagtagccgggtggggtggcgtgtgcccatggtcccagctacttgggaggctgaggcatgagaatcacttgaacccaggaggcggagattgcaggagccgagatcacgccactgcactccagcctgggcaatagagatagagtcagtctcaaaaaaaaaaaaaattgtatttaatgaagataactatcaggaatatggattttttttttaaaaaaaggaggtattttcagacaaacagagcttgagaaatgcaccaccaacagctaaaggaaattctaagggacatatttcaggcagaactaatcccagatggaagatttgagatgaaagaaagcaatgaagagcaaaaaagtagtcaatatataggtcaatctatctaataatataaaaaattaaaacaatcctatagggttgaaaaaaacaaggtataattaaaattcatgaatatagtaacatataaatcaaatggtggtattttgagattgttgagatcattgtcctgtctgggatgaattgtatttcttacatttagactttgaaagagagagaaatagagaggcagacagaatcaacagggcatcatgaaaacagcgctaagccaggaggtttggattctattatcagctctgctgctagctgtatggcctttgaaaagctccttttctggtctacaaaatcagtttgcttgtctgttagatgaggctttggaaccagatgaattttaaagcccctcattatgattctatgagaaacagattctctagaaaaaaaaatcagttgtccccctcctttgaaattttatcagtaaacacctgcatttcacttctggctaacttttatgtatcagttcaaaaattaaagctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactcttttccagttacgtgtgaactggttttgttactttattttctaataactaccttgtactgttgcgtgctttttattcatagtgcttttttacttttggtgtttattgttccatagtcatgctgtttacaaagaggttttacaaaaacttttagaggtttctgaagcctagatagacaacagtgagtaggtactgcttgcaaaggtcaccttctttccttcccggtttcttggcaggtaaaaatgataccatgggggtggggagtggggaagggaagccacagtgactgcattagatttctaagctaccttttctctgcttccttagctagtgggctttgtatacaagggaaatttttataaaataaagaagaagaatgccttggaggatctgaaagagcactttcaccttcaattcttttgcccttatcatattatattattttaggacccagcacttctcattcctcctgtccccctcttgaaagatggctggaatctaaaaaagatagctttccttcccacttccccatatgtgacataagaaatatgtttatttgaattggctaaggttcttatctgagaaagcaaaaggcaggagagtatgaaacaaagaatatcgcattctgataatggaggaaatgtaccaactagtatttacagattataaattcttccatctaatccaaatttcatgttctcttggggcttcagttatcatttgtaggtaatggggtgagagatttctgaagagatagagataaaagagttcattcgagtaactgtttgaagatgaatcgtatcagtcaattagaaaacattattaaagcgagacttgttttaattgaaagttcttgttcacatttcttttgtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgttcattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgagtttggttgaataattttaatgaggtgtgcggactgtttatcaggttatgccatgctatttgactaatcattatatacaagggtttctaaattttgaactaaactcactttgctctcctctccaagctaaatattcagctcataaacaattatacatttgctctaggaggaaagtatttctttgttattactattggtgtgtattaataatactgaggttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgtccaccagtataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactga

SEQ ID NO: 14564 - DNA, 818128 bp, Human; identical to SEQ ID NO: 14546
  misc_feature (1)...(818128): n = A,T,C or G

SEQ ID NO: 14565 - DNA, 818128 bp, Human; identical to SEQ ID NO: 14546
  misc_feature (1)...(818128): n = A,T,C or G

SEQ ID NO: 14566 - DNA, 818128 bp, Human; identical to SEQ ID NO: 14546
  misc_feature (1)...(818128): n = A,T,C or G

SEQ ID NO: 14567 - DNA, 818128 bp, Human; identical to SEQ ID NO: 14546
  misc_feature (1)...(818128): n = A,T,C or G

SEQ ID NO: 14568 - DNA, 151295 bp, Human
  misc_feature (1)...(151295): n = A,T,C or G
gaagcgtgtcagaactcctgaattttgagcaggtaatttaaaagtgtaaaacaaacaaacaaaaaacaggaaaggaagagagtgacaaatgtcttactatccaggtgttacaaatccttagtttatcgatttgtaatatttacaaatgtccatgctctgaggcttctgtcttttcgttgaaataaacataaacagtagttaagtgatttgccacactgacacagagattggtgtctctgatttactgcaaagggcactacttcctcattacaggacactaatccctcttccccaaggatcggagcagacctagaatatactattagaccaagggacaacttcagccaaagcaaatcttagtgtgcccccctcagaccgtaatagcagctgcctccacaactcactagcttaaaattgctaaagggcaacactaagtaatctcagtgtatgagccagaatgccagaagaagtgccatatttgcttaaaaatagcaataccgatcatacttacatgcacatatctttagtgataacatttacctttatatttggtttgttaaaggtaataaagaatcctggcattcccttttgcttttgtccagatactttatttttgcctcctttgccatgctatagcattagataaagcaaaacgggtgtgcttccacctaaaacattctagggggaaaaatgttgagcagaaaaggattatttcaaaagaagccggatatggtggcatgcacctgtcatcgcaggcacttggaggctgaagtgggaggattgcttgagcccaggagttgggagaccagcctgggcaacacagtgagacccccatcccttaagaaataaattttaaaaaggggaccacatttaaactgtagaccgaagtggaatgaatcaatcggaaaggagagtggaaagcaaatgtttgaaagaaaataaaaagaaaagcaagccaacaaaataaatggacaaagaagggcagtgaaaatatcactaacagtttatcgtaagatgctctttggatgctaatctaaggtgttatgtgaagtttgcagaaaattcttgtgctaatgaaggctttcttcttcttttgagtatttccaagcttgaaataattgtgtgtagttaacttctatcatcatactgcaaactctaaaattagaattatttgaactgttcaggccctgtaacttttccaataaaatattctattagaaacaagttccttctagatcttcctaaaagaatactaaaggaccaaaccgtgcaacagcactggtggtattgtcttaatttagagagtccataccagtgattctcaaacattagtatgctcagagtttctggttcaataggtctgggccgggcccagggaattttcatttctaagaagttcgcaggtgatactgataactgctgttcccagggtctacattttgagatccgctgttatgtcacaaatccaaatccaaagtctttttaacaatcccttttagcccaggatgagcctaacggcaatttcacgtccttatcgccggccactttaatcttcaactgaggaggaagggagagtgagaattatgtatataatttttttcttttattttttaaaaagaaaactccaagcccacactcttaattatctgggatgaggtcatttgcacctgggtcatttatttagacaacaagtagtcttgctagaggctttaaggaggtgttagcagagcggtgtgtggcttccaggttcctgggtctaccttaaatccccatcctctttctttctttctttctttctttctcttttctttttcctttccgttttgaaagccccaactgcccagtctctgggtgtccgggttcccaggtccctaggtgggggcggagcccgacacggccccgccccgtctgcccgcagcgccccctccccggcccgcccgcgccggctcctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaagggtaagtggatcgcggccccggccccgtctgatggccgcaatccgtgcacttgtggcgcgagcagggggcaagctgaggcggtcaaaacttggacaggcgcggcggctggacccggggcgccgggcggctgggcgtctaggaacctctcccgcgggttcccgcggcgcggctgcaggtgcgcccccggggtttctccccaggcgccgggctagtgggggaacctcttccctcggctttgggacgggctcggagagaaaaagctgatttctccccgtccccagaggggataacgcgttcctcacgcggggattggggccgggggagcttttcactcctttccaggctgccagtgtggacgtgagcaaggctggctgttcctaaatcgtcgctcttactcgtagaaggaaggggcgcacgcggcgctaccttccattgcactgcaagtgccaaaaggtcaactttctgcctgatttcttccgaggattccaactgacatttccctcgctgcattttctaccgtgctcattccatgccccaagacctgcagaaatcaggaaagaaagaacaaacaactaaagcccagaagtcaaagatttcagcggggggggatttttgtttgtttgggctttttttttttttttttttttttttttttttgcccttcgggattgggtgtggagtcatttctagggtgttctctcgcatttctccaggtgtctgtgctcatcttcaagcaaagtttgtcactcccaatcccagcacggcaataaaaagggcagaacactttgcttatattagtcaaatttgaagttaagtttgaagctttaaattgaaggggtttagttgctcgagggaggcataatattaattataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttagaactgatttgcaattgaagtgaaactaagactgcaaaggtgaaatctaaatctgttttcatagttctttgcatttgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttgaagtccattccagatggtggcttttcaccgtggttccctgtctctgtctgatcaggcttatcagctcagctaaatgtttttctgcagacctatagaagatgctacggtccttacaaatatcctggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaaagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcagggggcttgctttaaatttcacccgccaaagtagggcgcagagcctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaaggcagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatatttgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagttctgttttctttcccctcataacttgaattattttgaatgggtacagagcatacaaataagggtttgaaaacaccagtctttttacactggacaaatgtccagatgtctggtttgtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaaggttttattaaannnnnnnnnnnnnnnnnnnngaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaataatctaggatcttcaaaaatgtctttctatacatatatttttatagaagttgaatcattctgtcttataacttgcttttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcaccttcagagttaatatttccaatagttttgtaacaatcaaacattcgttgggcttttatccaagtggtgattcatcagataacatctcccatttattgcgggcctattgtatgttttccacatgggatgtgccagcaaccaaccctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccaccttggcctcccaaattgttaggattacaagcgtaagccacagcgcccagcctgcctacatccttgagatcccatataagattaactaccagcactgcctttccccctctccaaaattacagtgtttcagagtcgaaacataagcataaaatactgaaaagaaacttttcattgattttagtttttacttattagtttatatttttcttcttcaagaggtatccctttaggtccaaattgctctttgagctggatgaaatggtcggaagccttcaactacagtcagttggtgaaaggtatcttgaaagcagaaatggtgttgtggtctggcgtgtcaaatgtttaagaccacatctagccccctctcctaatcgaacctgaacctcatgtctctggtgaggtgctgaaaatatcaagatgttgctttttccctctgtacccccactccaggcatactctaccgtggaagctacagtggttcacagtatgcatggtaggttacacattcctagagacgcccacttctaaggagatttccattctctaatttgccaaagttcccaagcagcctgttcaacacatgtttatgttacctgccttgccctcaaaagcattcaggtgttcccctgcacccagggtttgaacacaataggattagaaggtgaaaacattttgttagaactgaaaaagtagcaagtatttactgatgaaaagctataatattgcttgagatattaccattggagctctctaatacattctgggtggttttctttttcattccttttccactgattttctacaatgaatttatattatttacagttagatgtttggtaaaaaagtttcttcgtcgatacccccattccatttcttacttagtgtctctatagctacaattcattaactaatgagaacttatgacagaaaagcagcagtagccacacacacacacacacacacacacacacacgccccacatatatgtagataatttatacttaaggaccctgattctcatggactttgtcaggtaactttaaactcaaagagatcatctcatgtatttttagtctgtatgtccagttgtgaaaaatgcagatgtagacattttagtggtagagaaaatagaacttttttgattaaaaaatagataaaaaacaatataagataattaattttagattatttccaacagatctaaaatggctttgcagaggaggtttccatcaagtgttagaaatattgtgtttccctcatttatcggctgtgtacctacacaaaaaattgagagaaaatattgccagagtcctacacaaacaaagcaagacatagtaaagaaataatttaaaggttcactatgatgactgaacagtcattaggaatttgagtccccagaaaattttttacatcacattaatggtttgacaaaagcattgtcttggattttcacagggaataaatcactaaaagcaactggaaatcagttttctttcagcatttgtctgtgactacccccaatagtcatagaatggtagtagagaatagtagtggagtaagtgggatataagagaccaagtgtctcatgtctattttttgtagaccttggtgctttatctttaaaatgtgaggatattggggctgggcacggtggctcacgcctgtaatcccagcactttgggaggtcgaggtgggcggatcacctgagtcaggagatcaagaccttcctggctaacatggtgaaaccccatctttactaaaaaaacaaaaaattagccaggtgtggtggcacatgcctgtaatcccagctactcaagaggccgaggctgaagaatcacttgaacccaggagtcggaggttgcaatgagctgagatcacgctgtagcactccctcctgggcaacaagagtgaaactccatctcaaaaaaaaaaaaaaaaaaaaaaagtaacgatattggacaagtgtctaagatttttgtttttcttttactttgggctgagggtggggcaggctgtttctaaacttgctgtgatcattatttttcaagaggtacctttcggctaactctgcagacaagtggatttctaaaaatgtaatcattcctatgttttaaaatgtacattctgagaaaacaaacaacaggagaagattatgccacccatccgtgtcttacaggctgagtgaggcaagctgttgtcaaatagagaggctcttgagatatttcccattagactcctctgggtcattcatttgttattgagagggtacattcttcgtcactccctagaagtaataatatgtttgattcatgaggtgagttttagatttctattagcatttttacaaatgtaatggaaagactgttccaataggttagcttggtgatttaaaactctgagctcttcaaggctccagaaagcatttacaacatcagtagatgttagatagtaatatgctctggaatttattttgaaatactaatataatattgatttacatgaagtgcaattatgtggttaaaagcctgtccttttctcacaatttatgtctaggtccctaagttcattactgaaattttaagaaaatattttttaaaaagctcaccctgcccccacacacataatatatgctgcttagagatacttttattggggtttttttttttttttttgacagcatcttgctctgtcacatagactggagtgcagtggcctgatcatggctcactgcagctttgaacacccaggctcaagtgaccctcccacctcagccttccaagtagctgggactatagccgtgtgccaccgtgtctggctaatctttttttaaattttttgtagagatggaggtcttaccatgttgcccagcctggtctcaaactcttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagtagttcatcaaaaaaactaaaaagctttcatgaggagttctgaggtgacatagataagataccagaaggccacccctgggttcaaaggaaactgatcttaaaggagaggaggtagcaattaaaacaaattatctgcagagaagtccaaacactaaggataagcttcccatgcatttgatgaaagtacttgcgacgtttacaggtgtttatgctcatgactctcaagactaaatacagacataccttggagattttgcaggttcagttccagaacacttcagtaaagcaaatatcacaataaagtaagtcacacaagtgttttggttttctagtacatataagttatgtttactctataatgtagtctagtaagtgtgcaacagcattatgtcttaaaaaacaatgtacataccttaatttaaaatactttattgttaaaaaagctaacgatcacctgagccttcagccagtaatgatccttttgctggtggagggtcttgcctcgatgttgatggctgcacagcatggtggttgctgaaggttggggtggctgtggcaatttcttaaaataagacaacaatgaagactgccactcagttgactcttccttttgtgaaagatttctctgtagaatgtgatactatctcatgaaaccacttactttgctcatccataagtagcaactccctatccattaaagtttgatcatgaaattgcagcaattcagccatatcttcacgccccacttgtgatttcaattttcttcctgtttccactacatctgcagttacatcctccactgaagtcttgaacccctgacagtcatccatgagggttggaatcaacgtcttccaaactcctggtaatgttgatattttgacgacctcctatcaatcacaaatgttcttaatggcatcaagaatcacttccagagattttttttttttttttttttgagacacagtcttgctatgttgtccaggctggagtgcagtggcgtgatctaggctcactgcaacctctgccttcctgggttcaagtgattcttctgcctcagcttcccgagtagctgggactacaggcgtgtgccactacgcccggctaatttttgtatttttagtagagacggggtttcaccattttggccaggctggtctcaaactcctgacctcatgatccacctgcctcggcctcccaaagtgctgggattacagccgtgagccaccacacctgacttccagagattttccatttactttgcccagatccatcagaggaatcactgtctatgtcaagctatagccttacaaaatatttctcaactaataagagttgaaagtcacaattttttcttaatccttgggctacagaatggatgttgtgtaagcgggcatgaaaacgtgaatctctttgtacatctccatccaagcttttgggtgacaaggtgcattgtcagtgagcagttatattttgaaaggaaacctattttgaacactaggtcttacagtgagcttgaaatattcagtaaaccatgccgtaaacagatacgctgtcatccaagctttgtttttccatttatacagcacaggcaaagtagatttcacataattccttttttttttttccttccaagacggagtcttgctctgtcacccaggctggagtgcagtggtacgatcttggctcactgcaacctccacctcccgggttcaagcaattctcctgcctcagcctcctgagtagctgggattacaggcgtctgccaccacacctggttaatttttgtatttttagtggagacggggtttcaccatgttggccaggctggtctccaactcctgacctcgtgatctgcccgcctcagcctcccaaagtgctgggattacaggcatgagccactgtgcccggcctgatttcacataattcttaagggccctgtgatttcagaatggtagatgagcattggcttcaacttagtcaccagctgcattaggccctactaagagatacagcctgtccattgaagctttgaaggcagtcattgatttctcctctagagctatgaaagtcctagatagtatcacctttaaatagaaggctgtttcatctatgttgaaaatctgttgttcgttgtagccaccttcatccatgaccttagcttcatctggaaaacttggctgcagcttctgcatcaatgcttgctgcttcatcttgcaccttaatgttatggatatggcttgtttccttaagcttcttgaagcaacctctactagcttccaacttttcttctgcagcttcctcatctcttttagccttcatagaattgaagggagttaaggttttgctctggattaggctttggcttaaagaaatgttgtggctagtttgatcttctattcagagcactcaaactttctccatatcaggaataaggctgttttactttcttatcatttgtgtgctcgcagggtagtacttttaatttccttcattaacttttcctttgcattcacaacttgactgtttggcatgagaggcctagctttcagtctgtctcatctttcaacatgctttcctcactaagctcaatcattaatagcttctgatgtaaagtgacagaggtatggctctttcttcccttgaacacttagaggccattgtagggttattaattaccctgattttaatattgttgtgtctcagaacaggaaggccagaggagagggaaagagatgggggaacagctggtcggtggagcagtcagaacacgtatgacgttgatcaattaagtttgccatcttatgtgggtgtggttagttgcaccccaaaacaatttcagtagtaacatcaacgattactgatcacgattcaccataatagatataaaaataatgacaaatttgaaatattgagggaattttcaaaacgagacacagacccaaagtgagcacatgctgnnnnnnnnnnnnnnnnnnnntgctgatggcctcgttcgttcattggtttcctgcttcagtaaacatttaagagcgtgccatgtattttcaaactttagggcaacaggctaaaaatatcaaggagaaaaacgtttactgagggtatagaagtttttatgatcttacttttattgaacattaaaacatggatgttcattctagaaattttagaaggtgaagtgcaaaaacaaaatgaaaatcacctcacatctcagtacccagaaatagccactatttacattttaaaagattgcttccggtcttctttcctatgcatttttatatagttgtttgagataatagaatgtttaaagtgttgtatcctactgtaatcataagtcttctcttattcttagttcctcagagatgttatttttcgctagttgcagtttattggggtaccacttttgtaaaaaaatatttcccaatttttgaaaattgtgacaaagaaaagtcaaattcgtgttgaatttatggaaggaaatctttaagaatctggaggcttattactaacaagcttctgagaagaaagccaagtaaagtgttataataccttctgtccaacaagctacttatgtataagtgatgttacagaataaagtcagtgtggtcaaaaacagacagtcagttatcagaaagttgataagtaacatttatcctatgaaaaatatagctatgaatttaaatcaatagttttctaccacaaatatcttaatggataaaatcttctttaccaaatatgtatgatgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcagttattaacagaaaaggaagattgcttcctgcctcttgggtgaggaagactcatgtataccatagatatggtcagtttacatttacagttttctgtgaggcattgatttttttcccccataaatatggagtacttagaatgttcaaaacctttctctgggtaatagaatgcacaaaagtataaggcatgatccctgttcattgcccaagctggcgtgactctggtcatgcagcggacttcatgatgtgatagaattccttgcctatgagagtgaaggagatggtaccaggtctacttgtggccggtggtggaacacttacattattctaagtcctttctgtctgtagaacccaaatgacaaccatattattttatcttctcttattgctagtggtatcgtttattaatgccaacgtatacccattttgcttttcaaggttactttagatgtcttaggttggaatgactgaaggcttatacattcaaatttatatatgacacacacacacacacacacacacacacacacacatatcttattgttgcctgctatctttctacctgttgtataagaaatcctttgaaaaaagcctatgtcagcttcacaaaagatgttactgtgttttgggggaaataaaattgggaagtaataaaacagttaataaatgttacaagaccgtgtacaccaacttaaataagattaaggtcaaacgtatggtaccttatataggtaggaagagcagtattaattagaataattagggagagttgtttggagagtggaaaaaaacattgttctaggaagaaattttgtaatactcaggtaaagtaaaatgtagggccaagatattccagatagtgtagcagcataaacaaaggtatgaaagactggcttgtttgcgagtcagtgaagacattgttctctgagaatctactccagatttttttttttttttttttttttttttttgctttttgagacagggtctcactttgtcgcccaggctggggtgcagtggtgcgaacatggctcactggtgccacaacctcctgggctcaagtgattctcctgcctcagccccccaggcagctgggactacaggcacacaccgccatacctggctaatttttgtatttttggtagagacagggttttgccatgttatccaggctgttctcaactcttgagctcaagccatctgcccatctcggcttcctaaagtgctgggattacaagaatgagccaccgcgcctggccactccagatttttaaaagggaaatctgattcagtgcccctggggtgaactaagtgccttaaattatagagtgagaaatttacattgcatttgattggcaatgggaaaaacattgttaaatcttcagaaaagagaaataatgaagtccgtcttctgtgttttggaataggaatttggtgggtgagtttaaggacagttagagaggggagagattatttcgttttgttttgaggtaattgacatgatgagggtcttaggatagcaatgggggaaggaaaagggaacgtgactccagaggtttttcttaacaaggtagaattgccagaaggtaatcacagattggacaggttttaaagaaaaagggagttatatgtcttcaaaatttgaaggcgtggtgacacagagaatggtgataccattgaggaaaagaggaaattgcaaactgagcggagcaacagggaatagatatgaatttgattgaattacatacttatgggtttatttacaatttctcttcttagaaaaatttatttttggtggctcatataaatgtatgtgcttccataccataagcatatatttctcattaatcctttcaaaaaccctgtaaaagatatttgtatctccattgtgcagatgaggctcagagaaaataggtaattttctcacattgcaaagcagggatttacgtgtacttttaactcctaaaccagcgatttagcccctcagctatactttcttcctgagaggggacagtggcattttgaagaggaaatactctaaagccatttgaaaaggggaaccgaagaaagagtttggtccacagcatgataaaaatattacttgcacttttattatactttataacaagaagtacggggcagagaaaggttcctaacttttactgagcaagtatatatccaagatacatctcctctttggagcttttgagatacactatctctcttagttttgcaacagccctaggaataggtactattactgttccctttaaaaatgaacaaaaaaaaaatgaagcttaggaaagttaaggttactagaccaagcttattgggagaccatagtgatgaagaggaagggctttagggtcaaatggatttgaattttacttcttaggcctttggtttccttatttataaaatgggattgaaataatgatatcacagttgaaggtaattatatgagaatttatgttatttattgcaaacatagggtaagcacctaataaatgataacctgagaatttatgttatttattgcaaacatagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttcgaattgggagcaattgggagcccttaagctgaatgagtagacttgaagtcccacttagaatgagcctttatatttttgttctgtggcttgctcagggaagggatacacacttggggagaaaaagacttggattctagttgatgtttttctcctagctgactagggaattcagaacaagttactaagagctttctagtccttagttctctcatttggaaaatgaaaattttaaattagagattctatttctaaggcaccatgtatttcattttcttaataaaaagtatatatattcccctaaagaatactcataagaaaaaggtagagttaaaatttcccaaattatttaattcctggttgcccagtaaccattaaatttctcagcagtcaggcaagaaccacattcccaccttgagacaagatttaggcctttccaaacttaccctcgggctctgttccaagtttatttgtaagtcagttgcatacaatttggaatgaaatgtgttataaatggtggttaggtccctaagtcacagaatcttagttaaccctcagagtgcctgatatactgcaccatgtaaatagaaagcagctgtatgtttctatgggagcaaaaaacttttgtaggaaaaatggtagaaactcgtactgcaggtgttgattattcagcaaacttctctagataaggaggactgggaacttcatcattattggtctagttacattcctggtcactccctcatcccattgactggtcagtttccctccctgtggtccttgtgcaagggtttctgcctcaccccataccctctgctccttgcccggtatcatggttcttctgagggtactactgcccattcacccttgtgctaattaggattacactgggtaaggaaagacatttgttctgtagcagagaagcggggaaggccatcagaggctttgagtgtcagaaagatttggtcttgaatgcaggctctgggatgcaaccgtagggaagttaccaaacatttgtgagcctcattttatctttaacaaagctgataatacagaactcagggccttgtaaggactcgatggtatcaggtacacacgacatttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttggattgaatcttcaaattggtaaagctttatatcaagcaactcccaaatgcagcatagttttgaggtgataaagaagagtcttttcaaggctgggcacaatagttcacgcctgtaatctcagcactttgggaggccaaggcaggcagatcacttgaggtcgggagttcgagaccagcctggccagcatggtgaaacctcatctctactaaaaatatgaaaattagctgggcgtggtggtgggcacctgtaataccagctacttgggaggctgaggcacaagcatcacttgaacccaggaggcagaggttgcagtgagccgagatcatgccactgcattccagcctgggcgagagaatgagactccgtctaaaaaaaataaaaataaaataaaaagagtattttcccggagtaccggtaatattggttccagattcaaatgtattgtccagatacacagagggtaaacaggaacgcttcaggcatcctttattaaaagcacctcagtctatgtcagagggccaggcagtccattatctaatgaaaatctcctaccattgatttattttatcataactgcagctgctaagtaattttgtttaaggaatgatttacatattagtgtcttcagcaggatctcatcattagcatctagtctccagaaaagttaacacataacagtgaaaagaaaacattctctatcacatgcttctgcatgcatgggcaatttgagtcataccacctgttcccctcttctgttatgctagagtatacaaaaagcagagatacgcatagtttactatgatcctagatgcttaaatatcttgaattgtgttctatcttggactcattattcatgcataaagactcaacagattctcttcttgcacctctcaaacagcaacatcaacaaaacccaaacaatgtatctttcctaatgaggtgaaagcatgcataccagcctaagacagaaatgttgcaaaaatgttttttgcaagaaggtcagtttgcttttcccatggtaactaaggttaatttctactgtggttaattttggcatccattttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactttcaaaacatatgattagttgaagttaccaaaactatttttttaaataacatttatcttaagagctataaataaagaggaaattttgcactagagatgaagttatgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctcacgtcatttctccaccgcaaggaggattgcgggggtggacgatgctccctatttagtcttctgcattttgttgcttacagttcaattaacatgtcagttagagatgacttttggttgcagttaataaaatatctgaccaattgtatcttaaacacagaggagttgatattttttgtagaacaagaagtctggaggcaggtagttgagagctatggaagagttccgtgatgtcatcagagacctgggccatggtttattctgctgtaccatttttaacgagtgactttggtcctgatggttccaagacgactgctgcttctcaggcaggaagaaagagaaaggacgttcagcctcagagtctctttgtctttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccaccttcctcttatgtatctgatcaggttcctcatcctccaccatcccccatgtgacgtctgatcaccctggcctgtgtcttcagcaaggttcctgttaagttttttttagctagaatcccccttacccccatgctttctcttagtagttttccatccaccaaaccccaccctgctccttggctatcaattcccacttgtccatgctgtattcagagttgagcccagttctatactgaggtctctttcccactattgcaatattcctgaataaaatctgtttttaccactttaccgtccatctctggtttttctttgacactcacataaccagagttttgtatgtgtgtgttgcttgacacatcacaaatacctgggatacgtgtactgattttttacagggtgaataatctttttgttttccccaatatcttagaaacctgaatctttaacccctgggcttagtacacagttaggcatataataggtgcttaagtaagcgtcaactgatgattttaaatgcagaagtaattgtcacttaatgaaatatagtcaggagactcatggattttggcctgtcttcctacctgttcttgtactgcaacagtaagtgtattaaggcaatatttttggcagcacaatcatttagtttgaatgcattagtaaaaggtggagtccaaagaattaatcgctggaaagttttgggaaaacccagtaacaactgtttccatagagtaatttgagtgacagccaggtaatagctacttattggagggactccacagtcagagccttgacagggacctgaaaaagagtgtaactgaagggtaaatgtaaaagcttttgggagaacaagggagtggtcaggctgaggcaaagatctgaaaagaaatgcctcctggggccaagctggtaatttgaatgactgaaggtgactgggtgggaactggggcaacctgaaaagcttctgttagggtaacagagcctccgttgcagctgactgttctatgagaatgtgagtctctattgtcaggtcttcaggttcttccagagaagcaagacaacgggaaatcaccagatttttaactaatggcgtatcattcaacaatttcaaaaaccattatgtgagcccaaactgaccaacgaatcaaacacacacacacacaaaaaaagagtctgcagactaaattcaaccagttggtgacctctggtctgtggttaccagagaagtaattgaaatggagttttgggagaaagatcatatgttgaaatcttgggagataagggcagagaaataagtaagccgagacggcggtaaggccaaggtagaaaaggtagcctttaggaaaattaagttaagactttttaaaacaggaaggggcaaaagatgaggttaaagcagatgaggaaatttactgttatttattttcatcattaaaatacgctttccacaaatttttcaactgtaagagagagtgataaattcaaaataggtaatgtcaaccatattatgaagagtatgtttttgcaatccaaaaaagctaaggcacaacattaaaaaaaaaatctgtgaatttggctttgcaaaggtataagaattaagtcacatctgatcatttttagagtcttaccttttataacaaagaggaaaatttaattaaactggctctgccctggcgaatctgggatgtgtgttcacttatgaagagagactgttaagattcgttaattaatgaggttgagaatagagttgaaggagattggggtaaatttataagtttgtgtcattctgagagttctgtaagtagctgagttacccatgttgtgactgagaaaaacaggagagagcagtgactgaaggttctgagccaaaggaagagaatagtattgtttattccagcagccagagtggcctgtgtgactgtaagtcgcctgtcaagagggagactgcaaggaaagtgcattgatttgatttggagtagttgtaactgcagcatgaagaatatgatatataaggatgataattgaggaacaatttaatggctgcataccttgctgaagttgaagttccttctggagatgaaggtggcaaaaaagaaagtgcttaggtagaagagctttttaaaatgagttaacagaaaacagcagactaaatatggaattgaggagtaggaaatgaaggaaatgaatttgaagatttactttctttcaggatgcagagctggtatgtaatccctctgtttccagtgccttctcccacttccaaatttcactgctcctcatgcgccctggtgtgtggtgcagcttcgagattgagcctccagccttctgtcaggatgaagcagcaggtggctgagatgctaggctccaagtgggggaggtgtttagggctctaaagactttcaaccagtccttgtattttcagccacatttcagtcttcagaggaacctggagcctttcatttctgagacttcttggctacataaactggcatgcgtcttgttagttcctcccactccctgccccaatctccttgtctccccaacatcattaattgagcttgggatttctctggtctcctaagttggttaccagcaggtcattttctaagccaccaaaatactggagctctgatctgttctcatctcctctcctgttttgttaattttcttttgggtaaatgccattttttattcctcttctatcaacctggtagagtttcagggataaagagagacaaatgagtctgctccatctgctgtgtttaactagaagtcccaacacccaaaatccttcacacgatgtgcagggctctgcagtgggcctccccctgcctacctgtcaggccttatctgtgcccactcttcctccttcctctctgagatttcagcaatattggccttctaaggattcttaaagccccaccttcttctctgcttcagagcttttttttttttttttttttaacatgtgctgacctattacgctgctgtgttcttacctggcacgctcccatcatccttcaagtctttgcttcaatgtcaccttctccaagaagcctctcggacctatgtttccctatgtatacagtctcatcacttcctgtgtgtttccttcaccattttaccacagtacatatgaatatttgtttgttagtttgtttgagacggagttttgctcttgttgcccaggctggagtgcaacggcacaatctcggctcactgcagcctccacctcccaggttcaagcgattctcctgcctcagcctcccaggtagtagctgggattacaggtgcctgccgccgcatccagctaattttttgtatttttagtagagacggggtttcgccatgttggcccaggtggtctcgaacttctgacctcaggtgatctgcctgccttggcctcccaaaggctgggattacaggcgcgagccaccgcacctggcctacatatgaatatttgattattatccatctccttcgctacactgcaaagtcaataaaggcagagatttattttggttaccagtgtattccatgtacttggcatggttcttggcttatagtacatgcacaataaatattgaaaggatagatgaaaggattatggatagatgaatgtcttttaagcagttataaaacagttctgcctaaagagtcttttttaatcagtagtattacttcaaatacatatttaaatacacatatgttataaatatataaaatatgtatttaaatatgtcatttgtactattttaaatgtatttaaaataatatatgttatatattaaaataatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctgcacctcctgggttcaagcaattatcctgcttcagcctcctgagtagctaggattacaggtgtgcacccaccatgcctggctaattgttgtgtgtttttagtagagacaggtttcaccgtgttagccagaatagtctcaatctcctgacctcgtgatccacctgcctcggcctcccaaagtgctgggattacaggcgtgagccaccacgcccaggctcatctctttttaagaatcgaaatcagacatcacatatgtgcatgagtagaagtgaatcaactcattgaaaaatgcttaatgcctaatattttctgtgtcagaatatattgtaaaagttaaaacagctaaatgaaacctgaagttaaagtaataccattgtaatatttgatactaacccagatttttaaaatgccttttaaaaaccacaaaagtttaaaaacagtaagattcatttatttattcaaatatttattaaaatccaactatatatgccaggcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtttactgagaaatgatgatttccaatttcatcccatgtccctacaaaggacatgaaactcatcccttttttatggctgcatagtattcccatggtgtatatgtgccacattttcttaatccagtctatcattgttggacatttgggttggttccaagtctttgctattgtgaataatgccacaatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcatcgccaagtcagtcctaagccaaaagaacaaagctggaggcattccctgctactttcttctggtatgcctgaatcactgtttgagaatggattggactttggtgcgtggaaaactggtagcagaaggcttattcactgcagtgggttgggggtaggctgaaaagatgtcagggaggattaactagaggcagaatgtgtcatagttagaagtatttagaagggaagaaagtttgaactctgatactgttccacactaatattcatgccctgaaagaatcagatcattcttgcctctcccacttggatctctagctactggaatttgccaattcttgatatgaacgctaagatttggatggagcttgtgacctcatttagaccatttgttctaaatgctgaatagaaccaggaaaataggaaaagagggtagaattggggtcataagagaggaatcgtcgttctttgaaagaagaaagatgataggaaactaggcacatgagttacgaggcagtggagaaggaggattagaaagggaaaaaaagaagagaaactttatgccaatatcttctacaagatgtttggctggcacaaaactaacactcaatacttttgcataagtaaaggaatgagagaaaatttgggattggatgcttatcccctggaaactgctacaggctggtgttaatgggaaagggatctgtatttgaccaaaagtgcatttccacgtctctacatttctttttataaagagtcaaagggactcaatgatgagtgtgtgtgtaagggaactccacactagcaagtacaggaaaaatttgatggtactggtgaaggatgttgcaccaatctggaggggaggacaggaattggtttctcatggattgatgccgcaagacaattcataccatgagttggctgagaccacttaaaaaagtaagcagtgatgactgggcaaaagagacaaaggaagaaccacatcttttaggggagagagagagaaggacaattaaagggactcaactagatcaagttctgctcactaaaggacagcgtccaggcaaatgttaattatcttcaagaagcaatctgtatatatagcatttcaagatactccgagatgcttttaatttattgaatactttttattggtatttatcataaacaagagactcacaaatatatcccagaggggaggttttggtgtagttgactatagtagttattaaataatctattaataaaagcccacaaaatggaagatagaaagatagaaaaacaaaagacaacacaggatggtgttggtatacagaatttatacttgaagtttaacaacacggaacaagaaactttattaaaatattcatttaaagaacttccatatgaatcaccagaggctcttagtaaaatattgattcggattcacagatctgggtggggcctgagattctacatttctcataagctccaagcagatactgatgctattcttcctcaaatcacactttgactaacaaggactcacacaggttctctgtaattggtgttggtagtcattcatggttagatgtagttgaggactgccctcttaactacctctcggctgccaggttataaagaaagcaagtctcagtacaagttctgtcacttaggagcatttattagccaatgggtacaaaacaatcttacagcctgtgccagagacacagtgaagtcacagttctgtcttttggggtgcttggtgtgagaggctcacagtctacacaggccacagtcctctattagagtggttctcaaagtgtggtccctggaccagcagcatcagcatcacctggaaacttgctagaaattcagattcccaggcccttcccatacctactgaattagaaaatctggaggtggggcctaggaaatctgcatctttaaactatccactccaggtgattctgatgtttgctcaagtctgaaaaccattgttctagcagcaggattccctcaaccatctaactgaattctggcaactaagaatccggtgaaccacagctggacattttggaattcagcctagggcaccatttctaaagatggagaacctactggattcttcttaaactcaatttaaaggcagggagtgtttctaaatgtttttcaacaatcttcatattttgcaaaccactaatatcactacacaggcccgtctaactattaattaggaaaattaatgaaacccctggtgtaataagagctaaatataactgaatcacttacagtggccgcctgtggcatgaggctttttgattaattgctagccaaccaccccttggagttcactcctgattaagacaactgaccacctctgcagtgtagcttaagctaacacacacatacatcacagtgtactgttcatgtgagggtttttaaagactcttaaaatttaccttatcagggcataatttaaacactataacatgtttccattttaagtgttcaggttagattttggcaaatgtatacactcgtgtaaccaccatgccaatcaagatataacatttcgatcacctagaaaacacccttgtgttcctttgaggtcagttacctactcccaccacaccccaggctaccatctggcatagtagctaagttttgcctgttctagaagttgatataagtgaaatcaaacagtatgtactgttttgtgcctggcttcttttacccagcttagtgtttttcagatcagttcacattgttgcattatcagtagttagttcctttttattgcactttgcacagtagtatcccactgaatgactttaccacaacttgtttatccattaccttactggttggtttccggtttttgactattatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgtttctttcccctagttgaaattcaggcttttatgtttggtctctgcgatggccataaagctgaaaatgttgacccaagtgacttggatatggattgaattatttccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctatgtggcgtgagtcagggcttgatagcccggtgattcagaaaccactagtaacatatattgttgttaaccttgctgaacattagaatgattgtgccttagaatataggagccaaatgtttattttattcctaattatatttttagatgcatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagattactttctagaaaaaaataatgcctgtccatctctttcctcttgggaacaggactacatgaatgcccttcaggctataccactttagtcttcacagaacttagccttcctggttgtcaaagggcaaaaggaattattttttcttttccccacgttaacagaattttcacctccgaaagcttggcgtatacacactatatgttttctaggctatttttgtggtggttgtagttattggcaaatcactgggcgtcgggggtgggttgtctgttatttctgatggaataacaaatgctctttgttttccctcttttcagctgacctgaataatgtcagattctcagcttataggactgccatgaaactccgaagactgcagaaggccctttgctgtaagtattggccagtatttgaagatcttgatactatgtctttgcttagaataaaaagtaggttgggtacatttttacttagagaggggagaaacagctgtcacaattcctgttgcaatgtataattcattctttaatgtatccttggcctagagtttgcctagaatgttttgttttatttttagaatcattcctgtcaccattcctcagctactgatgttgaattaagatattgagaatttttattttccaactactggcattggcatcggcatccataattacctttgtgaaacttgcacaatccttgttctacctttgtttttttttctttttacaaaatgtacttagtattagaagactatgactatctgatctaaaccaaacttcatagacatgtgtggtttattagcttgaatgctaacgtgcagatgaatgaagtggtagaggaaaaatgacagaattgctttcctccttttttatcatacatctgtggaaaaatcctgaagtgttacacagctctatcatgtcatcaaatagtttatgtataactctactattgtctgagggtctgtgtgcattgatgatatgcccatgaaacaggcacagtttctttttctttttttctgtttttttttttttttttttttttttgagatggagtcttgctctgttgcccaggctggagtgcagtggagtggcgcaatatgggctcactgcaacctccacctcccaggttcaagtgattctcctgcgtcagcctcccaggtagctgggattacaggcatgccccaccatgcccggctaatttttgttttttgtttgtttgtttgtttgttttgttttttttgagacagagtctcgctctgtcaccctggctggagtgcagtggcgcgttctaggctcactgcagactccacctcccgggttcacgccattctcctggctcagcctccggagtagctgggactacaggcgcccaccaccacgcctggctaattttgtttttgtaattttagtagaggcggggtttcaccgtgttagccaggatggtctcgatctcctgacctcgtgatccgccctcctcggcctcccaaagtgctgggattacaggcatgagccaccacgcccggcctaatttttgtattttttaatagagacggggtttcaccatgttggtcaggctggtctcgaactcctgacctcaggtgattcacccgcctcagcctcccaaagtgctgggattacaggcgtgagccaatgcgcccggcccaacaggcacagtttctgctctgatggaacttacagtctaacaagggataaccaggcatgttcatgaaatttgtagacataagcaaatatatgtataatgtattaagaatgtctacagttggttaaaaaaataaagtgatcttgtctctatttccaagaccatttcaatgtcatatatttagttgtgcaacagtgggacaatggggtactatgtgaacagctaactgtgtggaatgagattcaaagaatgtttgtttgaagaggtgatgtctaagctaggtaactctagaagagtaagcagctctctctctaggaagagcgttctagtcagaaagaagagcatgtgctgaagggcccagagaaagcatgacacattcaggaactgaaaatatgtcagtatggctaaagcacagaattccaggggaaagatctattgtgaaataataggctggagagagaagcaggaagcagattgtgcaaggtttttaaaacccaagttaaggaatttagaggtcaggggatttggcctgggggtgacataatcagattgtcgcttagaaagatgattcttgctgtggaacagagtatggattggtgcgatgtgggagtgacaggagaaaaacctgttgcagtaatttaaaccagcaatgtggtggcttgaattagcagagtagtaagggagataagtggagagaatttagaaatatttaggaagtggatttgacaggcctcagtgattcatttgatgtggtgcagggatgtccaatcttttggcttctccgggccccagtggaagaagaattgtcttggaccccccataaaatacactaacgctaacggtagctgatgagctaaaaaaaaaaaaaaaaaaaaaaaatcgcaaaaaaaaaaaaaatgttttaggaaagtttacgaattcatttgggcctcattcaaagccatcctgggccacaggttggacaagcttgatgtggtgggtgaaagggagtcaaggaagacacttaggtgcttggcttggaatatcaggtgaatgtgggacttgtctggtaaggttagacacggagctgtggtgctcaggagaaatatacaaacaacgtttagggatcatgagcctgtaggtgctgcttgtaacgggggagaggattggatagctccaggaaagtgtagcgtgagaagggaagttatttaggacacaggataagcaacctacagaagggactgcaaaggaatggccaggaggaaagaaggaaaattccaagaggttatgatgccacatgctccatgggaagaaagaaagaacccgttaccagggtcagatgttgctgggatgtcagcataaagttgcggaaaatgcccattggacttagcaacaggaaggtccctagtaactttggtgagattttagaggcacagtggaagtggtgtggtgagttcaaaagtgaaccaaaagtggagaattagagaaggtatgaatgattcttggagaaatttacttatgaaggggagaagagtggggtggtagctagttggagggggctgaggagttaatggaaatgtatgtacagtcacgtgttgcttaacaatggggatatgttctaagtaaatgtgttgttaggcaactttgttgttatgtcaatataggagagtactacccaaacttagatggtatannnnnnnnnnnnnnnnnnnntacacacctaggctgtatgggatagcctattgctcctaggctatacacctgtacagcatgtgactgttctgaatactgtaggcagttggaacacaatagtaagtattgtgtatcgaaacgtatttaaacatagaaagatacagtaaaaatatataatagtgtaatctcatgggctcgctgtcatataggcagtccattgttgactgaaatgtcattatgtggcacaatatgtgtatataagtgtgtgtgtgtgtgtgtgtgtgtgtgtgtgtgtgtgtgtatacattgatccttgaacaacatgggtttgaactgcttgggtcaacttacgtggatttttttcaatcaaatgcaggccaaacatatagtattcgtgggaatgtatttatatgagtatgagaagacagggtgagattacaattattggcccaagaggagatgataaataatgggagttctcagagaatatgggcaggtaatccagagcccaagggagggaagagatacctctcttccactgtaatgggtggggtagagggaaggatctgggcaggtccaggtaactaagaaaccaggtagcagcaaggtgaaggatgtcttactataaaggcttccattttttgtatggagtggagagtccctgcaacgcagttaacagcaggagatgatgaagttgggcttatctttgtggagaataagagagagggcggagttgaaaaccagctgtgtgaacccagaggcggctgagtgtttcacggtagctccaatctgcaggggtgtggtatttccccaggcacacttagcacttgggagccagatgcttctgtcctggggtagggagggaacagctgggcaagagaagtgaggatttgggcaaaagattgattaaaatgatactgacaagtccctgttgggtaggagaagctgtgaacgcatatggaaactggtaattaggaggtagagggatgaaaatgctaactcttcagggaggtaggggaagaagtagtaaaggaactgaaggtcaagaagttgtggtcagagagaatcatagatgaacattattttgaaggtggaacagtttcaggtgattagatctaggatatagccatttgagtaggtggcagaggtagagtggatgtgaatttccatggaggtgaaatagcaagttaaggaactgagaggctagaatgatgcatgagtcccccatgccaatgttgaaatcatgcagaattggagcgagaactgggcaaaagagaaggaccgtgaaccctggctgccaggtcttcagaaataaaggggttcaaccagaggatctgcagaggctagcaataagatagtcaaggagtcacttggcatatggttcttacacagagatagagaagaaatgccttagaagtggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaaaaaaaaaaaaagaaacccagaaatagaccagatggaaaaaccttataatgactgttcctttctataatgtccattttcaccctggatttaggcattattcgattttcctgctcaaaaaaaattccattcacatatgtgttttattgtctgtcatttcaacttataatttccaataaacattgggaaaatgggggaatttcataatatacaaaattttgtccatttgaggtgataaccttgtaataaaggtaagctccgaatgtagaataatttctttaaattttcacttttaaatcaatttgaaattctctgcatttcctttctgagcatggcttttctaatatgtgaaaaagattcaagtatgccaaaattaaggtgtatgtatctaaattaagtattgaattctcattaatgctaggagggtgccatatatagtaaaactatagaatgaagagttcaccccatccttttattgaacatatgtgtggtcacattacttactttcaatatatgatttaagaattttctcctaattttatatttgcttagatttagcttccaggcttttgtcatttctaagcctgcaaagccatgataaagagctattgtctgcggtacaggcaaataaaacttgccctggctagctttccctaccaaaggccacttctaccaactctaactttaaggaaaattaatgatgttatctcagtgatttcctggtgccagtgaagagtttgaattacagatgccttggaaatatgcacttccacctctattaagcacttgatcttatttttttttcacttccctatcaatgtttccgtattgcagaaagccaaataacccaattgtatccactatagagaattcactatttaagtggagagcatcaccgttggcctataatgtccccagtttgtaatcagttaagtgttgcatgactccttactgcctctcaacacattggaaatgaaaatgaaacttggtagaaaagcaggaacaaagataaaatcttggtaagaaggatttataaactgtttcatatagctgatactccattgaaagttatgaagaaggtaatttaagcattttctttctccctttgtagttctgatgacattctacaggtgtgaggcttctaaaattaaaaagccaacttgtaagagcagaaataaaaacgcacttaacaaagcaagtgtatttagtttattaataatgtgtggtgggttggagagagcccaaaccatagggctaaatatactgcagttgataagtgtgacaaatattctgcaaacagtaagaaatagagaacattttgcctctattcagcaactaaagcacacattatagagatttggtacaggctggagttgtgtgaatagtcacagtttctggactcgccctcaccatgacaaaccaggtgaaaaatgcaccgccttctctgtaaatgcacctcaccttttgatggtgcgctaagggtgacattagataggcttcagttgctaaagaagactctcaggacccacaataacatggcttacaaatccgcgctctattgccagaaaaggctacattacaagagcattactgtcaggatatggatccacagccacaggctgcctccacagcaagggggtctcgagaggccagtgtaattattttgccactctcctacaaaaatctactttttctatataccatgtattatttttcacataggttagaggccatgtctctgttagttctgagtttaagacgtcttgaggacatggccaaactaattttctcagtttatatggtttgacagatattagtgcccaagagaggtctcataacatgacccatctatctcccaggggaaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttttcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttccctttaaaaaaaaaaaaaagtatcggctgggctcggtggctcacgcctgtaatcccagcacttcgggaggccgaggcaggcagatcacgaggtcaggagttcgaggccatcctggctaacacggtgaaaccccatctctactaaaaatacaaaaaattagccaggcgtgatggcgagcgactgtagtcccagctactcgggagtctgaggcaggagaatggcgtgaacctgggaggcggagcttgcagcgagccgagatcgcgccactgtcctccagcctgggtgacagagcaagactcggtctcaaaaaaaaaaaaaaaaaaaaaaaaaaaggaaataaaaaagtatctttggtggtttccttccccttgcaacaatctcacctttttccttttatcattaattttaagccaaacctcttccccagctacacacacacaccacacaatgcagacagtccccaacttgtgaagtttcaacttaacaattttttgatttcacagtgatgcaaagtgatatgcattcaatagaaactctacttctagatttgaattttgatcttttccgaggctagtaatatgcggtatgatactctctccccttgctgggcagcagcactgaacctcagctcccagtcagccacaagatcatgaggctaaacaactgacactttactgtgtaaggtgttgctagacagttttgcccaactgtaggccgatgtaagtgttgggagcacattgaaggtaggctaggctaagctgtgagtttcagttagttaggtgtattaaatgcatttgtgacttaagatattttcaacctatgatggggttgtgtgatagcttcaattaggcaaggcacaaggaaggagtaatccattccattgatccttgtggaatgcttgtgcttaagtaccaactaatagccatagtatcttattttggaatattaccagcctttgaaactcttaattgtagccccagttcagggactactaggtctggcatcaaaaaagaaacctgtagtgacatagggaatacctgtaagtgccccacttgaattatctttttaattgtaactggtctcacaggtgtagcccatttctcaaaaatgatagttgcttcagctttttggttgggactccacctgcaggccagagagggtgaagcccagtggaaagaaattctgaacttaacattagcttttgccaacccagccaaggaattggattttttttagcagccttgccatcagtttgcaattgcctcctaatccattttgttagctccttaggttcaagttctctcacttccagattccactagaaagttacaccatcagtaaccaatttcaaagcctgtgttacttttcaaccaagcgtagcttgttgagcaacttcaaaggttctttttcatcccttttatcagaatcttctttttttctttctaaataatgcctcagtcatacttttagctaagaatgagttggaggtgttctaaacaatcttgcttctgacactcactgccctgacagtggaagttaaacagggttcaattgctaaagaggactcacaggaaccaaatgacagtgcttacgaatctagagttccttgcagaaaaaggatgcaatatacccacaacattaaaacaagaataagtgtcacagccacagcctgcctcacagcatagggtccagagaggacaggtgcaagctataattgccctctgtctacaagagccacaccacgatgcattttctctcttggaacaagagctactgatgtgagcacagaacaccttggaaaccagggagcacaaattggagtttcagccagggtttcttatatcccgtgggtaacctaggcatactgttcctatgtaaccagcctcaaactcagtggcttccgttggtctgactgtgcccgggtaaaaatggtcaatgttactgttagcaataaacaatggtgataacctgcaacccatggctacacttcaacacagtaagtcactttgaaaagcaagtgctttgaccagggctctgcactgtgtagatattttagcaagtcatctcgtgccaactccagcctctctggaattaacccttactgcacagacaactacatcaaagtgcattgactttcttgaagtgcaaagatttgcttgggaggtccctcagccataagtgtaagttgcctgtagagtggcatgcctgggcaagaaaaatcagcaaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctggatatcctgccataacacccagagtgagtctccatatactctggtctcagttgtctcaactgcaaaatgattttaaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtgggatccctgtgttgaagtcctgcctgctcgccgccccccacccgccactgtctgcttttcctgcacagcatagaggatcctggagagtcagccatttcttttatcctgtccccaccctctctcacccccacagccctcatgcataggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacatatatatatatatatatatatataatatatttaatggaaattcctagcttaaggaaacaatggttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcatggattgtgtatacctaaatggaaattttttcaaaatagctccatgaaagttgaattctgtttgacatgtttgtttagggaaatgtgctcttcagtcttctgtgatggattgttcttgtgtttaaccacatccagttttagcagagcacactgcacagtatttctctcctaactgtgtcatcttctgctcctgtaatttcagagcaattgctttgctcccctctggagctatttctactcaacatttgctgttctatgtgttacccattcacctgtacagagataagagcaggccccataaaatgaaatgcatgcagtttttctctgttcatttccatcacacggctaaataagactcttaatacaaaagtgattcgaaaaattttcactagttacttcttaaatgcctggatcagaggcaaaatatttatgatgactaaagcagagtaacaaaaaagaaaataattgaaaaacttcaaaccacccatagcttccttcagtatataaggaaacatgttgggaatattggtgtttggaagaaatccattcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaactggatagattatgcaattactttagtttgcctatagaaaattttagtggagagtatttttttcacctaatattagggtagcagagagatgctgaggtgactgatatttcaaggagaaaagcgcttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttctcaaactgagaacatttttcgttttcttttgttttttaataagattttatgaagtttcagtttggcgcctccattcatcactctctcttagagaacaattgtttgttttggattgcacacaagggagatatccccagttctgatttttttttttcttgagcttaatgaagacaattgaagaagggagcagaaggaattggtcttaattttgcctaaattcttcttagatctcaaaattattacatgcctcatttcaccaatcaagaacatactcccatttggaaatctgggaaggttttctgaaaagagttgcaaaacaactgttttgccttttacctttgttgtagacttctactaccttttgaactaaaatttatacctttttttctttcttattttgataaggtattgctttttaaaatttcaggaccacctgactattacattcatcatagtcatctaccaagtccttgaacatgtcggatttcaattgtgaactacgttcacattagttttgataagagtttgtattcaggtttcccctcaaatatattttggcactgttttctttgcagatgacatgtgaatgcattctgaatgtataacttccttctacctgactgaaaagtatttggtgacaattttaactccttgaaggcctgagttgctgtataaagtggatttgttaaattttgatctaccttttcttaagagggagaaagataagaaaattttccagtgataggaatttggttagtccattagtgcccaggatttctttttgactgagggatttaataaattttagcagctggaagttgagcatattgttcaccgaaaataaccgccattgggacctatcctttgtgattttgaagtgctaataggcgaattattctgaaatattttctcctttttctttttaccaatatctaagggccagtagctttccgtaataaaataagaagccaaaaaactattgaaagacactttttaactttaattttaggtttcggggtattatgtgaaggtctgttacataggtaaactcacgtcacgggggtttgttgtacagattatttcatcactcaggtattaacccatttatgcctagtgttccattattggaacactaagcttgtgggaattattcctatcctactgctcaaggtcatcgccaaggtctgattttcacaaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttttcttaatttacgtagaacttttgcagttcaaataagggtttttaggaattgaaacttggtaaacattcagtggtcaagttggttgaacttccattgcattgtaggtcatcagtcaaagagataatgaatttggaaaagttcaaaacaatcttaataaaacagtggtcaatagagttcacacatcattgagcactttactcttttatttttccttttcaaggctttattcttaactagaagtgtttaccctctaggaaagggtcagtaattgttttctgctttgattcttcataataggggacgaacagggaggatccgtgtcctgtcttttaaaactggcatcatttccctgtgtaaagcacatttggaagacaagtacagatgtaagtcgtgtatactaatgctgtattcttttattaatgttggctaattaccctagttctagatgggaaatgacagactgttcttatttgacagcagattcctcatgtaagatgtagaactgcttttagagtgtcataaaatttggtttgtgccattccttgtcaaacattaaattgcaggcatttaagtagagaatgaggattagcttttccagtccaggtattattttacattacattgactgtgtctgaataaaacacatgttcctaggggataaagtctgattttctaacctctttctgtaagtcggaaaaataagtgtgaagatttaatctctgcacttgtctagtctttgggttcttatttaaagaataccatgtgacattcatgttcaagaaacattgtttattttataatcatcttactgcaagttgtactgacacatccaattccgtgacgtgactaacattttattatttgagagacagatagcttgctgtttcttaaaggatagatacgtaccaccctacagaatttccttttgattacgcattgggttcttctgcttaaaaactgtaaaaccaaattaaaagccaatgctagaggagtgatggttcagatgaccaagtgaccatccattcatattgtgaaaggctgcagttggttttccccttgaaatgcttataagcaatcttttcagtaggaatattaaacaaattcagcctagcttgtcttttctctcttcccctgaggcctagccacacatgtgaggagatgtgctaagcttcaggacaggcaggagataaaagccactctgtctcctactgatcatttctccttcaggagtaagccacaaaatacacaaaccattttggccctcacttttatgtagtttccacttgagttttctcatcctcagaacgagagaaaaataactgaacagcttttgttaaccattttaaaatgtatttcggatgagatgggatacctgtgtgcttttctcctttaaatattgtagttacttagtataggttaggttctaatctaccgtatatatggtatagtgacagcacattgtaaatataatattaaattgaataattgaggaagctttgagttggtgtttcgaataactactaagagggaacatgtttttaggttggtgaaacaaaaatattaaatgcaaaatgagatgtttgaaagtaactcataactttgaaaataaacacctaggtatgtatatcggagagcagataaaaagctgtgcgtacaatctcaatttttagtgccatcttaggtatcctgttaaaacatttaatttcctagagtttaaagtgtgcttatgggtacagaaagctttcttggatttactttttttgaggggcaacttctaggtgaatataaggtatgattaaaattttatatctgagaacaaaacataacattgcaagcattcagtatgttcattcattctgttacatatattgggcacctactatccaccgggtactgccattctactgtagatacttctggcacacaactgaccaagatatggttccttccctcaaggggatataagtctcctgccaaaaacgatagacacatattgaatcaatgccagcataacatgatgtgagctattaattagaaatacgcagccaggcgcagtagctcacacctgtaatcccagcacttagggaggccgaggtaggaggatcacttgaggtcaggagttcaagaccagcctggccatcatggtgaaacacgtctccagtaaaaatacaaaaattagctgggtgtgatggcatgtgcctgtaatcgcagctactcaggcggctgaggcaggagaatggcttgaacccgggaggcagaggttgcggtgagcagagatcgcaccactgcactgcagcctgggcgacagagcaagactccgtctcaaaaaacaacaacaacaacaacaaactatgcacagtatcctgtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacagctgtccttttttttaaaactgtcctttgtagctttgacattcccctattattccaaagtctagaggtgtatactctctgctaatgtccatcactgactgaacacactcttgtccgttctctttcctatcctgtcccattgctttttctctgtcgtagtcagtgccccagaaacaccctcttcttcccaaatgcctgagcactccactggtagacattcatcttgttctaatttttttttctctttccttttttttttttttttcttttttgagtgcagtctcgctctgtcacccaggctggagtgcagtgagtgagatctctgctcactgcaacctccacctcccgggttcaagtgattctgctacctcagcctcccgagtagctgggattacaggcgcccaccgccaccccaagctaatttttgtatttttagtagagacagggtttcaccaggttggccaggctggtctcaaactcctgacctcaggtgatccacctgcctcgaactcccaaagtgctcggattacaggcgtaagccaccgtgcctggcctctaatttttattaggtagatagtgctacaatgaacatccttatcgtttagcttttgtctttgaagctttctttataggatcaattctcaggcgtgtgattgccagacaaaataatataaacattttttgtggcctttcttcaaaagttgttctaattgtaacgctatcagtattgaaggagtaagatgctttcggtatcacattattcacagtgttcttatgtttttgtttttggttttttcaagtgctaagagctgtttttcttatgtagggtttctcaatccattctaattctattaacaatggctgagatttacaaaatggaactagctgtagaactaactgggttatatctgaagtctttgaccacagactaggatgaaactatagaaggtttcctgggcagatcactgtgaatatttaggtgtttaaagcagtttgagtatttatttaatagttggacagatttaccggatgcacacataataagttcatttatgtaaagtgggatatactgtttgaattattttgccaaaattatggcaaattagttgtaaatgtaaaatgcatgtggagaaataaatatcttttcctcctcatacccaaaccttccaaaatgcagatagatgatcaatccaatcaatcatcaaaatgtagacacaagtaacttccatacaatgaatattaatggccacaggcaatctaggttcattttgattttttaaaatccaattataaaacaacttgccataaacgcgagttatttcctaatcttttggttgtgtgttttttttgttttgttttgttttgagatggagtctccctctgtcgcccaggctggagtgcaatggcgcgatctcggctcactgcaacctccgcctccctggttcaagcaattgtcatgcctcagcctcccgagtagctgggattacagggtgcctgccaccatgcctggctaattttttgtggagacagggtttcaccatgttggccaggctgagctcaaactcctgatctcaagcaatccacctgcctcggcctcccaaagtgctgggattacaggtcctaatcatttttcccctttagtcaagtctcagttactctttgagttctagtgaaacacacacacgtgttcatatatagggatatataaacatatgtgtgtgcattgtgacttgggttaaaggtaaggctcagtgatggtccctgctgcaaagtaaactaggctgtattcagggccagctggattctttgttttctcgcccgagtactgactcatcaggaagccaccaccatcctcactgcagcctctggccctcttggatttggttgtcaggataagcggtggccatacagaagctctgctttccctgggctgccccccttatcaggagaccaacctattccatttctgcctgctacatccttttgctggataacctcctactcccctaagcccatgtctctggtttggttacatttctgtctctgtaataacaactctgtattctcagtctcaaagctttgaattcagtccatccttgcatatttgttgaatgcctcctggttggccagccagtctccaagctctttgaaatgtgaaatgtgttttgttttgttttcagaaggggtctaacttcgtcacccaggctggagtgcagtggcacgatcacagctcattgcagcctcgacctctgggctcaagtgatcctcccacctcagcctcctgagtagctgggactacaggcatggaccgccacgcctggcatttttttggtgtatgtgtgtgtgtgtgcgtgtgtgtgtgtgtgtgtgtgtgtgtgtgtgtacagggtctctcgccatgttgcctaggctggtctcgagctcttgggctcaagctgtccacccacctcagcctcccaaaatgttgggagtacaggcgtgagccacggcatccagccttgaaatgttttctatgagactggggggaaatcagtcaagatatgaatggtggtaacaggtggcttttgattttctctgtactatttttattttctgagttttcttctttgaacatttataattagaaaaaaaattagtaaagtgctgcctctttttttagggaaagaaacatgttttgtttgattgctttccattgccattcttacattgtttccaggccttctcatcattgcactggcttcctagcaagcctccacttcacactccagtccttttcattggtcttattgccctcatactagttttagagaaaagcatttcccatatgatgccgtccttgaaaatgtcagtatctttctgttgtctagtgaacaaatcctaattcctctatttaactctcagacctttcctactctggtttcataaccacccatagtttgctttcactatcatgaaacagcttctccttaccatttgtacctattatgcttataaataatattgttaccattgctactaacaaaactttgttcacatgaattctctcatttaatcctcaccaagtctttgaggggaacagaatagtcaggctttggagattttgcttttattattgtttaagtggatgaataatttatttgcgcccttaaagtccctcagctggtggaagggtttgattcctagtccagtatgcccaccgccacatttactacctcattcccaaatatgtagtttctgatacttctgctctccagcttcccaaggccaaacaacagctacttttcctgagtcctggatagaataagaaaaggtataacaagacaggggacccttgagggggaagaggaattagtttgaagtgctggcaaatgtagtatttctaatcagatgctagtaaattccatatgtatggcgaggctttcattacttagatttggggagcctctcagcattttagcaatttgcaatcaggttgaatggatccattgtaaatacttaggaatacttaggaatccacgtcctggccctggcatgcttttcctcggccaggtgcactggcggtcaccttgcctttcattgtgccacgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacatacatgcacacacacccatctttattgaaaatactctaatcccaacatagctgtttagtctatcttcagataaaaccaagtatcacttttaggtgggaaaactatacagtcatgtgctgaagaatgacgttttggtcaatgacaggccatatatactatggtggtcccataagatcaacgtaagaagagattataatggaactgaaaaattcgcattactttgtgacactgtagccattgtaacatcatagcacgaagaattatttcacaaacctgcactgccagtcatttaacaggtaaaaaagtatgttttaaaatatttttaattattatggacacataatagtactcatttatgggttacatgtgatattttgatacaagcatacaatgtgtagggtaacacaatcagagtaattggggtgtccatcatctcaaacattcatcatttctctggtaggaacattcccatttcactcttttagttattttgaaatatacaataaattattgttgccatgcatggtagcacgcacctgtaggaccagcgtttcaggaggctgaggtgggaggatcacttgcgcccaggaattcaaggctgtaatgcacaacaattgcacctgtgaatagtcactacactccaacatggacagcatagtgagaccctatctgtaaaaagatttaaaaatatattgattactatagtggccttattgtgctaccaaacactagatcatatttcttcttactgtatttttgtacccattaaccatcccttttttatcccccgatcttcactacatttcccagactctggtagtcatgattttactctatctccatgagttcaatttttttttttttttttttttttagctcccacacatgagtgagaacatgggatacttgtctttctgtgtgtggctgatctcaacataacgtcttccggttccgtacatgttgctgcaaataatgggatttcattttttatggctgaataatattccattatgtgtttatagtacattttctttatgcattcatccactgatgggcgcttaggttgattctatatcttggctattgtgaacaatgctgcagtcaacatgggagtgcagatatctttttgtggtttcgattttgtagtatcttcttcagtaaacattttaaggactttattgtttagataacgtcaagtataccaactttatattcaatatgcttcacctatgagagctggagtgtcaaaatctgtttattttacatctgttttctgcctcctgttgtacttagtattccaaatgagtaagttgcttttccatctatcttctgaatttctctatttgtatgacaaaaatgaataccatctatgcacagttgttgtaataatgtagaatgatatgaaaatgagaataaattacagtctcaactgttgagaacaagtatttctctgtgttagaaacattcccaattctactcttttagttattttgaaatatacaatgtattattgttgccatgcatggtggcatgcccctgtagtcccagctactcaggagactgaggtgggaggatcagtaacacataaatgagaaagcattccagaatatctggagaagtgactggcagagtggttaagtgcataggctttgaaaccgaactgtgcctgagtccaaatctgagctctgctatttgctggctgtgtgactgtggacacatttcttaaccttcctggcccctgaactcctggaggtgattgtgaggattaaatgaaccaatagaagcaaagcacttaagagctgtagtggatacatagaaggtgcccagtgaatgttagctatgattatctaaagtgtgttgtggcatgaaaatatcctgccaatgttaacagttgcttttatctataacaaaacatcatctgtggattgcattttagagattctggagattctgtttctctgcaaatgttaaaatgccatatcaggagacttttggctggttagacagcattccccgggtcaactgattactttttttttttttttttttttttttttttgagacagagtctcgctctgttgccaggctggagtccagtggtgccatctcggcacactgcaacctccacctcccaggttcaagtgattcttctgcctcagcctcccaagtagctgggactacaggcacgtgccaccacgcccagctaatttttgtatttttaatagagaaggtttcaccatgttggccaggatggtctcaatctcttgaccttgtgatccgcccacctcagcctcccaaagtgctgggattacaggcatgagccatcgcacctggccgattccattttattaatagattttccatcctgaaagtaactcctaaaaaccctccttcacttaggtttcctttggctttttgtgtattaatcagactgtgggccctttggttccatagacattccttttacaccccttttggacggatgaatactcactagtaactaagtaattagtaagagttactacaatttggtatttataaagaggtggcctttcccagaattgaaggtagaccctaatagtccaatcagccttccatagagatagctggctgccatgaaaagctgagagatatcaccgacctcttactgggcctgctcatgaacagttagttaaaattcctgcaattttcagaaaagacccttatcagagtattatcagtattgtcttaagtttaatattggtttccagttgttatttttaaaaattttaagctaccgtgggttaagctttatgatgatctgtttaagtggtttgtttgattaacttctctattggagtaatggatgttttcttcaccagaattttgaagataggtttgtgttgtagttgaaacctgttttgtttatacacttactgctaaggaaaagcacatgtcattttgttttccatcttcatccttctaaagtagcacttcattgttatgaccaaatctttctttcttccttccttcctctcaccctgtcttttccttccttccttcctgccctccctcccgcctctcttcctttcctctcctctcctttcctttctttctttcttttctcttttctttcgttctctctctctccctccctccctctctctctccccttctccttccctccttccttcctttcttccttccgtttctatcacccctaaaattccatcatgctgtatcatctcactaagtcccaatctctggaaaccacagctctgttttctgttcctataattttgccttttcctgaactggattttaaaggattgtaggaggcagtagtggaagagctaactttatatcttgttcttttacataatgcgccctgatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggtagttatgggaagccttttacttcttcttgtctcacaaagacaactcttgacctctcaatccttaaacaaaaagttctgcttctgcgcatgtggggactcttaaactcattttcatgcctggagattcacatttagggatctaggaaaagcacatctaggcagagtcgatgaggagatgctttaagaaccgtgacaaggacaggaaggaaatcaattttgcgttaggtttgtatttttagagaaaacgaatcctggggaacttttcacactcattactattgacattaataccattgtcctgtccctttcacagttactaaaatcactcttgcccaccctcctgccttgcccacaacctattcccatgaaggggtgacttgggagaaataacggtttccaaccaacgttttattttggaaacatttcaagcacaaagagtagttgaaaggatagtctaaagaacactcatctgtgtcatacatctgttcaatccatggttgcttttcgctctacttacctcctccaccctctcagctctgtttatgtatgtgtctgtctgtgtacatacacacacaaacacattttcccctatgccatttaaaagtaaaggagcatcacaacataaacccctaaacacttcaccatacaccattttcttaaaggatgacattctctaacataactgcaatgctatcgttacacacaaatttaacagcaatccagcaataccctctgatatgcagtccacactgaactttccccagtgccccagaattgttccttatagccactgttttcttccagcatctagtcaaggtttttgtctgtcatgtctctgtaccttcatttagttttgaacagtctcccagcattttgttttcctttcatgacattgacttttttggtagggggacagagtctcgctctgtcacccaggctggagtgcagtggcgcgatctcggctcactgcaacctctgcttcccgagttcatgtgactctccacctcagcctcaggagtagctgggattacaggcatgcaccaccacacccggctgatttttgtatttttagtagagacagggtttcaccacgttggccaggctggtcttgaactcctgacctcaggtgatccacctgcctcggcctcccaaagtactggaattacaggtatcagccaccacgccgggctgacgttgacatttttgaagagttcagaccagttctcttgaagaatgtcccatactctgggcttttctgatggtttccttgtgattagattaatgttaacattttttggccaaaagacgataagatgatgctctgtacctaccactgtatcacaatctggaggaacaaaataacattttgttcctattggtatcactaagaatgttaaggtggtgtctacaagatactttccttgtaaaatatccttttccctttgtaatgagaaagtaattttttgatattttgacatattataatatccattccttaaccttttaccctatggttttagcatttatggatgatccttgtctaattcagttataatattggtggttgcataatggtggctttctaattctaccatactttctgcatgtattagaccattttcttatgtaaagaagagcttctacctctcccccgtctattcatgaatatcactgtggacatccaaggtggttctgagtgtacaaagaatgatatctctctttactgaactgccattggatactatttttgtcttggaattgtttaaaatggcagtgtatggaattgaaagtcctttctccagagagccacataaacagatgtctaataaatacatttccatattaaccaatccttttatgggaacaacacattgacataattaaaacacgtaacatgaaaactgtgctgaattgagaagctcatagagttttgtttcttttttttcctttttgccacttcaatatatatggacccgcacctgtcaatccaggtagctcatacatgccgtagcatctaatggtacgagggacatgtaatgctgaaaagaagggggaaaggagttgatcagatgagatataagtatgcatttatcagtgttgtggggtattcacttgcaccttccattggctctcgcagccatgttatcggcatataattcagttgaagatttatattcacctggaaattgtcctaagtgggccttgcttacttagctatcagactctagtactttcaaacaaattaaagattcaaaagattttggggatcgccttgctttttcccataggaaatcacttttgtcctgtctttttaagactattttaagcatatatttcagtattaaaatcgtagataatcttaagctgtttccttaacctctttgggccttttcttatctgtaacgtaaagttaaaacaggttatctcaaaagttacttatccctaagtgtctttgattctatgctaaatgttataaaggccgaaagggaaatggattattgtacttatttcaaagcttggccatgatcagcaaagtcttacctgatcttccgggtaacaactcttgtatcagagctgtaagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacctgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcacttctaaccgccaataccccccccccgcccagttgtgacaaccaaaaatgtctcccgtaaaagataccaggatgaaatcactttttgtcagtcccaaactaactagagccagggcagcatgaaaggaggagggttcatggttacatgcctgagataaagactgtctcaaggactttctaaaatcgccccacaagaaattcctctgttaggactgcagcagtgcacgtaatatgctctcaaaagaacatctgcccagtaatggcatccccactaataaactgacaccagttctggcgttgagcatctgaaacgaactatgtttccaagcagcttatgtaaacttctgtttttaccaataaaagtttccctctacagtctcctcttcagatgcatcttgggttgtaatcctcatttctaattccaaaataaatttaacatatttggcgatgtttttctctgatgttttttggtcgacactccaaacattgttatatttcctctggggtacggcatcatttccggttgagaaccaccgacctagagaaaagctatctgcctgtgcagttcctttcaagggccccaagtgtgaattttgtgtatacctatattttaagccagatcattctgtacataccttctaagtccagatgaagtctgttagccttttatgtgtgataccatcacatagaaaccaacacaaggacatttactgtaatcgataaaggaaattttggacagtttgagaaagtaacttattttgtcttctgctctttataaaatctttacaagtgtatgtttttgctcttcaggatgactaggcagctttttaaaattctgacttcatacagattttataatcttccttttatttcttgcgatcatattgcagttgaattcccacccactgttcaattcagcagattttaacagagactccagaagtatagttcctgtctttaattaatctgcaatttaggaaagaaattaaggaggtatcgttctgtattgtttccaggatggtggtttcttgttatctgagaattactgggcacagtctcttgcccaatgtttacttctctatatagagttgacccttgaaaaacatagatttgaactgtgtgggtccacttataagtggatcgttttcaaccaaatgcgtatcgaaaatgcagtactcaagagatgtgaaacctgcggatatgcgttcagctgggcctactgtgggacttgcgtatgcgtggattttgctgtatctcaacagcaaaatccccgtgggagtggggctgcggcgggccaggaagcaacccctagcatatactgagggatgactgtactaattattgtagtttattaagtgttcacatggttttcacaaacctcacaattgaaatgccaattgccttctcctaaaaaatacaatgtacgtgttcatggtagctgggatgcagggcttgctgagaaatacttaattgcatttcttctgtagccatgaattgattttattaccttgagagaaaaatgagtattcaggtggacctcctggcaggcggttggcccttcagtgtccaaggatttatagaaagcacaacatcaaagaaatccaaaagttcttcggaaccccagcaactctcctacctccaaacttgccatgtaatgcccttttaaacttattatattgataggtaaatcggtttgctagaaattccagatattgagaattctttgtctgtgtaccttgttatatttgtataaaggtgatatttgtatgaagccaccctccagtgtgctgtaacagagcaatagtaatgacaactgattccttcccctagcttttctgttatggatagttgctggcaggtgaggaccaacagaaaaagaggagaaacccaacataattccaaactgtgaccatcataatggaaggagctgtgatagctttgctttctgtgtgtgcatgacatagaaggggaaaatggagttattgccaaaacaacagcaaaagcaaaacaaagccaacaaacaaaacaaaacccagggctaaatgacctttccaagagattttgcttgcatggcttgaaactggtgtttagagatgaggacaaggtcacccttgatactgagaggggattatatctgagacttatatgtatctcaacaaataatggtacttacaaagattatctcagtccagtgaatgccatcatacttatcttttgaccttaataacttcctgctattccaatctatccctatatatttttttctggaatgatcgaaatgtaattttagctgggtttaattctagttctgttaggtctttacagaagcttgcctggcttttaattctttccttcttcattgccagacaaaaggagagggaatataccactaggatacagagtagtttgtcataaaaatgaaagattgaaacagaatgagaacgtgaatccccgtaccttgtcttcagtctgtcagttggcgtaggtgagcagttttaaaagagccaacatgatggatcttgcatcttaggggctagaaatttgagaatgttcaacctttaagcatagaagaatctatagttttttgaaagagtagaacattctacagcctcccttggtaattcacactaatgctttaacaactttcagcatcaggaaattcttccatatgagctacagcctaaattcttcatgctgcttaagtctgtttcttcttgttctgtcctcagtggagagatcgaacagctggtcacaggcccctatgcgagagccattcacataattgaaaactgttattaaatcgccccttcagaagtcactcttgcttgttctctctctctctctctctctctctctctctctctctctctctctctctctctctctctctctctctctctgagaatctgggaagattccagagctgattaacatgttgctttactgatgaccttctcagcttttaatatgttaacgtgctctaagaattttaagaggcagatataatgtgcactgtttctttcattaatttgaccttctcgtgaagcattttgctggacgattgatctgctggacatactgggaaacactgactcagagattttagttgagtaggaaccgtgtgtgagcctacggtacagaacaaaagaaagtaatccagttacactgtctggagaaatagaggtacattctccgcaatcatatttgaagaatagttttctaaatgacaatggcaaactaagccgtgtcatatgaagaagaagtaaaaagaataggaatgaagaggcatggacagataagacagctctggtaaaatatttaaagggctgttcaaagaccaagaacttctgggttgctggtcagatggataataataatgacaataacaatagcaaacatgattcttgctatgtgtcagacacggttccaattgcctttcatttgctgactcacgtaatcataaaataactctatgaggtaggcactattaatatttccagtttgtagcagagaaaaagtaagacacagagagataaagttattttcctaaggtcacacagccagtgagtggtgaactccagtggtttaactctggaacttctatatgctgtgctgatggatttcagctcaatgtgatgcagcacttttgacaggggtatctggacacaggtgttcaggatcaccttctaaggatgtttcccagctctctcacatgggtggtgtagtggctgtaagcacacactggcatgggtaagagtttggactcgatgaatgctgagtttggactcagtgaatcctgaaagtcttacagctctgtggtgccatgccaaaaggatgaatggacttgcatgatctttttcatttttagattgcataattctttataaacttttttttccacaaagtacctctgtgatggaactctacacagagaaaagtgctcagcaacagctttttaaaatttaacttgtaagttcaggggtacctgtctaggtttcttatgaggtaaacttgtgtcatgggggtttgttgtacagattattttgtcacccaagtattaagcctaatacccattagttattttcctgatcttctccctcctcccaccctccatcctctgataagccacagtgtgtgtttttcccctctatctgcccatgtgttctcatcatttaactcccacttataagtgaaaacatgcaatacttggttttctgttcctgcattagtttgctaaggataatggcctccagctccatccatgttcctgcaaagaacatgatctcattcttttttctggctccggagtattccagggtgtatatgtaccacgttttctttattcagtcttccattggtgggcatttagattgattctaggtctttggtaaacagtagcatttgatcggaagtttgaactgataccattttgcagctaggaaatccaaagttaaacagtttattatagtgttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaaaaaaaaaaacaaaaaacatattaagcacacaagaaatcaaggtggaaaaagaaagaaatcaaggtgaatgagaaccagaagaaatagcaaaccatagaagcagacctacgataacatcatattccagaattattagacagattattttcttaattgtgtttatgcagttagaaaaataaaaaacaacattgaaaaatatctacagggaaccacaaacctgagaagttaccttaaaaatgaccaagtagtatttctagatgtcaaaagtacaataatcaaaatttaaaactgtatgggtttacagcagaccggcaagagaaatggatacccagacagtaaggcagaaggaattaataagaatgaagcacagaaggatgttttaaaaagatgtggggcagagaggggggaactagggaagtcctgttcagagaaatatagattgaagaagagtaacatttatgtaacagagttctgaaagtagaatggagagggaatggagaagaggcactatttgttgagagaatgacggagaagattccacagctgattaaagactctaaatcacaggtttaagaagtccagtgaatcctaagcagtctaaatcaaatcctagaaacagcacaagatagaaaacagatagattatctttattttttttattttatttttattatactttaagttttagggtacatgtgcacaatgtgcaggttagttacatatgtatacatgtgccatgctggtgtgctgcacccactaactcgtcatctagcattaggtatatctcctaatgctatccctcccccctccccccaccccacaacagtccccagagtgtgatgttccccttcctatgtccatgtgttctcattgttccattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcaaaggagcaacagtcatctttactattgacttctcagcagcaacagagatagacgaaagtggagtaatatttcagtattcaaaaacaaaataaaaacaagaccccaaaacctttcaatcaaaaattttatacttgggccaggcgcagtggctcacgcctgttatcccagcactttgggaggccgaggcgggtggatcattttaagtcaggagttcgagacctgcctagtcaacatggtgaaaccccatctctactaaaaatacaaaaagtagccgggtggggtggcgtgtgcccatggtcccagctacttgggaggctgaggcatgagaatcacttgaacccaggaggcggagattgcaggagccgagatcacgccactgcactccagcctgggcaatagagatagagtcagtctcaaaaaaaaaaaaaattgtatttaatgaagataactatcaggaatatggattttttttttaaaaaaaggaggtattttcagacaaacagagcttgagaaatgcaccaccaacagctaaaggaaattctaagggacatatttcaggcagaactaatcccagatggaagatttgagatgaaagaaagcaatgaagagcaaaaaagtagtcaatatataggtcaatctatctaataatataaaaaattaaaacaatcctatagggttgaaaaaaacaaggtataattaaaattcatgaatatagtaacatataaatcaaatggtggtattttgagattgttgagatcattgtcctgtctgggatgaattgtatttcttacatttagactttgaaagagagagaaatagagaggcagacagaatcaacagggcatcatgaaaacagcgctaagccaggaggtttggattctattatcagctctgctgctagctgtatggcctttgaaaagctccttttctggtctacaaaatcagtttgcttgtctgttagatgaggctttggaaccagatgaattttaaagcccctcattatgattctatgagaaacagattctctagaaaaaaaaatcagttgtccccctcctttgaaattttatcagtaaacacctgcatttcacttctggctaacttttatgtatcagttcaaaaattaaagctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactcttttccagttacgtgtgaactggttttgttactttattttctaataactaccttgtactgttgcgtgctttttattcatagtgcttttttacttttggtgtttattgttccatagtcatgctgtttacaaagaggttttacaaaaacttttagaggtttctgaagcctagatagacaacagtgagtaggtactgcttgcaaaggtcaccttctttccttcccggtttcttggcaggtaaaaatgataccatgggggtggggagtggggaagggaagccacagtgactgcattagatttctaagctaccttttctctgcttccttagctagtgggctttgtatacaagggaaatttttataaaataaagaagaagaatgccttggaggatctgaaagagcactttcaccttcaattcttttgcccttatcatattatattattttaggacccagcacttctcattcctcctgtccccctcttgaaagatggctggaatctaaaaaagatagctttccttcccacttccccatatgtgacataagaaatatgtttatttgaattggctaaggttcttatctgagaaagcaaaaggcaggagagtatgaaacaaagaatatcgcattctgataatggaggaaatgtaccaactagtatttacagattataaattcttccatctaatccaaatttcatgttctcttggggcttcagttatcatttgtaggtaatggggtgagagatttctgaagagatagagataaaagagttcattcgagtaactgtttgaagatgaatcgtatcagtcaattagaaaacattattaaagcgagacttgttttaattgaaagttcttgttcacatttcttttgtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgttcattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgagtttggttgaataattttaatgaggtgtgcggactgtttatcaggttatgccatgctatttgactaatcattatatacaagggtttctaaattttgaactaaactcactttgctctcctctccaagctaaatattcagctcataaacaattatacatttgctctaggaggaaagtatttctttgttattactattggtgtgtattaataatactgaggttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgtccaccagtataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactgaagtctgtgttttctttaatagcagtaattgtatttaaagtatttattcataggattataaatactgtataaaatatattacaaagccatcctattcaggcataagagccaggtcctaacgtgtttcattttgcaagacttgtatctaatgttaacaaatcctatgatgattacaatatttgatccatttgatatggatcacagaatttgaaagtttccagagatacagactgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatatagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactgccttttggctcattttctgggttaataaatgtctcttnnnnnnnnnnnnnnnnnnnnaaaaataccatggaattatccttgaggcaaagaattaaagctctgtataagattttctgtataaaatggtattaaagtattttggatttatatgcctactttttcttggtgtacttatgctccaaggtcttaggctttcattcttgtacacacttccaggatagcaactattacaagggaaaacactactaatgtattttccctgatggtaggctttttgcttattaaaaaaatatgtaattgaaagactggtctgttccaaaagatagttcttataatacaaataatccaagtattaatttatcttgatctgcagtgaagatttcaaaacagaccttagcatttttctaataatgggctatgccagggttctagaagattaacagattaactctccaaaactatagtgaagattcacatggaaatctttggatctgcttattaaattgagtagtcatcgttttgtttcctcttgacaatttaaacgtctttataactcatttcaatttgattatgattacacttgacctagatgacattggtttcataaataagacctttctctctcagggaagaattccatttccctagttatttgctatagtgtgtcgtaattatcttactgtagtatattaagaaatatgaatttctggcacattttctaatgcaagcttagctactggtaactgcatctttttcttttttaatgtaagaagaaacaaacacattctccttagtgtttcaaccaagtccttcaacgctacttggacactgggctaaaccagggtcctctctgaattacattatcgttgacttttggatttatgcctttacctaagggctttctgtgtcagcagagaaatggaagagaccttttgtgctattccaattaaaagaaaaagtccaagcctaaactggttttcagaacagatggttttttttcctaaggttaatccaaaagatactataaaaacttcaaggataattaatagatcagatatgaaaggatgaaaaaatgttaaccctaccagaattctagcctatggagataagaaaagataggtgtttatatacaaaaagcatatagactattcctgctaatgatctcctcttattttctcacctatgttttagcacacagtatctctaagaaatatttcagatatcatgacgttctatgaaatttagtcattcttttttaaaacctcacaatataatccagggtcattctattttgtgctagaaattagtggtatagtcttgctgctgaattggaagatacatttcttctttacaaaattgcatagatcaagacatcttgatacatggagttttaagaagtcttgtactagagtagcctctttgaagctaaaataattgtaagtatctaggcagatatacagctttgattcaataagaagatagcctataaatggcgcaggtgtaaactatttaaaattttaaaccacatagggctaacacaatttcggaattataggatgtgagaaattacaaagtaggaggacaaaatgcttcctagaaactgtctcccccaaccttttctacgatgggaattttccagagaagattttggcctctcttcatggcttttaataaaagcagaagtatgagaaatcatctctcaatcctggattttaaaatacttgataatatttaagatataggagcaactaaatgtatacattatccatagaattagaataaaagcattctaggccatgtgtataacataactgtgtggtgggttttttctccattaatggatggtatctgtgactaatcacattttctgccttataggcctgcctcgtcccctcagctttcacacgatgatactcattcacgcattgaacattatgctagcaggtatgagactagttgtatgccaggcaaatattgattgaaataactaaccaaggaaagctaacctataatattttaaacaaatcttttctttttttccccaaacttgtctgattcctactaatcaacttgccctctaacgtgcatgccgttccactgcatgttgtttttggtcaccaacaagagcattagtccagaataatcttccctaaccctggcttttaaacatttccggtagccttgctatgtttttttatactgagcacatttactaaattggcttacaaatagtttaacctccttagaaaactgctagaccagacattcatatatgaaaaaatgatactatattatatggagaatatgaaagcatcagctttctgtttgtgtatttattttacatgatatgctgtaaagaagagaataattaattttcctaatccttggacttttctgtctcaccttctttgtgtttgagatgatttttatacctaaaaactgaattactaattttaaaatattttatgcttgttaaatccgtaagagtttggttaacttttttagttgtaaaaaaacaaacaaacaaacaaacaaaaaaccccctgtataattgcctgaggtgaagaagattttaaaggtaaaaattggtggcagaatgtttagagagcttactgtgcatccatcctttgtcaatattctaactgctggacatgtttaccaatcgtgaaaagcattagctagctgtgtaagtctgtcatcagtggaaagtagtaattgtcttaaaagacaaggggtagtgtaaggtagggagtgcacttattgttagggaagcttttcttctgaaaacaaagacctgttctcagtgaaagcaagactgatctgtagggggaaaacagtgaaatataactttccttagaatttctatcataaatgtagtgctactaactagctgtggtctaccacacactgcctcaaatggttaagccaacacacacatcctttaatttgaaggattcctttctcttcttgccatgatttatcctttagttttcaggaatgttcgattaggtcttgaatagattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactttaaggacggagatagagcggtgctaagagcagcagggaacacagctatggcagggaaacaggcttcattatagagtgagggcagtgttcacaatacagagcacaaaggaacattgccatgaaccaagtaaatgctgaccggggcttgaggtagagagagcagacattgaagcaaatatgaaggaaaaaataaggatttgccaagtgaataaataacataaagagaagaaatctagtcaaagtattacgatgcctttttagtttgataaagtaaggatatctcacccatcttggagaatatagacaaagggaagaatggtaaatttatcatatgtagttggtgtggcaacacaaagtcatgctcagatgagaaaagaaccttcataaggattaggccaaaagaaatagtatcaaagtggcatatatataactagttattgaagacatgagaataaataatctcatctggtacataaacgatcaagctaataataaagaatcaagtcaaccctcagtcatttgtatatgacttagttccttcaaacaaacaaacaaaaaagcctttccccaaccataactgtgatgccttatctttcttagctatgggaaaaagtattaatggtactaatatataagatacttcaacagtaaaatgtgtggccaaagaatcagccaaatgtaaatagcttgtgcttctttggctcactgattttggtattagaagctctagcacattcagattaattcgagttgtatctacgtaacagtggctgtcattcattgactgcctaagagaacaggaagaaaagtgtagttacaactctaggttataattaaacatgggaagttctagcagtacaacttcagaatttggaatgagtgtgataaattaggtggtaaaactgcttttgttttattttaaaataagctttagcttattctgaggacataaaatccattttgactcaatgttggatggcaaaaactcatggcattttaggggcaggtttggggaagtggtttggtggattggttgacttcacttaaatgtgtgtttttaatacccaataattatttttagtcagcttttcacatctaaaccaggtaactggcttgataaacaaaaataattcaaatgagaaggactttttcctaaatttctgatatttttcaacttaagtgggtatggagaggagaatattagcgtatcatcttaatgatatctaaccagaaacaatgagctttagcctgtcattacggacagaagaaaattcttataacttggaggtaaacaggcctttccggagcttggagcaatgcattcagaaaaaagtttgtcctgtgtattagagagttcctagtttccaggaaagattgtagctgcctccccaaatagaagcctttttgcctccttttcccgcaagattagtccttaaaaccattatgtataaatttaaaaataaataaaacttgtatttaaaaaaactctgccccgaggaatgagatgttcagtcttcttttaatcagtcaccttaatgtcttttttccccttaattttcgttcttctgtctaaacaataactgaatgaaacaatcatgtatctccagtttaattgttgttgtcattctgcctcaatgacttatataagttaaaactgacttactgaagcaatactttttggttacattgccttccacttaataaaatatttcctctgttacttttagagctgcaaggtattttttcctactcagtacaacaatagcgtgggttagtgaacagattatcttgacaggcttggtggccaaagcattatacagccattattatatcttttaatattttttagctattgactaacatcaacgtagagtcccagtatttctgtaattctgcctttcatttatccgtgtaaataggccaatcaatttcatttgaaaatctgagcaagaaaacactttgaattggtaccagtagaatggtagatcacaacctcagcagtatcaaaaggtctttagaagcaggaaaaaaggtctaattaattgttaagagcaaataaatgtttctattttcaaatacactcctgagtccctaacccccaaagcaaaataagggggggaaaaaaccaaaacctttgattttattttccagagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggtgagttttctttctagctttgtcattggtatgcagagtgcatacacttgcacacatagaaaagtgccaggaatcttcacttagagtcattttatgtctaattgttttctaaaataatctgtttagctccatttgcagattctctctctcttttttttttttgttatctgaaagaagacaatggatgcaatagtatgatgaagaactcatattttaggtgtgaaggagttaatgctgatggtggtatttgacttgttgcatgtgtctccaaggctttgattttatatttcagaatagaatttaagaaaaaagtaggttatttaattttatgattatatgattttttttacatgtgtttggccatattatctacctcaaacatttaagaaagtagggttattggcttggtcatattgggaaaccaattgtttcatcttatttttcatcatcaaatgcagaaattattatttatgctcaccatcatagcaggttagtgagacaattccaattgtcagccatcacctgtaaaagacagtcatgtaaaaatagcagaaattgtagaagagaaaaaggctaaagaactctcataatgactgcagggaggacaaagatgtaaacatctggggtactgtattgtgtcaggataatgcaaatcattggactttcagttctgtattacatttattatgtcacaggtcccttggtttaaaaagtcttctcacatgatcacttctaactcacaatgtgccttcttcagacagatgccaccaagcaaggatttaaagtagatgttgctcagatttgtgggtcttaagtactttcatctctttggttgagcccaaggcaccaaaagctcttaacgtaggcaacgcagtgtgtctgagatcagtgccctcgggagtatgccacttcaggatgaaaaaacaaactgccactcttccattgcttcctgctgccactgcgagccttctagctcttaacaccttttacctatggccatagctccttatctggttggcttccctttagtctctttcccacccttgcaataaatcctccatactgactctacttgtacatcttgccagaaccaagacccatcatggcattcccctttcactggatttctgcatgtagaaaaaaatcaagcttcttagtggggcgttcaaacccttccacaatattctcttgacttgctttttctatgccatcttcttttgttctccctgtgttctggctatgctgttgtagctagtatttctgaatacatcctgctctcatctacctttggggtcaagctcaagcttgagtctcagcctaactgctaacctctaacccaccactgccgtatctgacaaaggaatcccacctatcctccatcacactgctcaaaataactttccccatggagccctgctagatccctgcagttggaagaaatctgtcttttgcctctattcccagagcactttggacctttctcagaaaattccttgacagtttgcctttttatcagttattaccagtgcctctctttaatgagctagtgtgtgtctttggggcatggactgtatcttaatcatcttcatatcctccagagtacttagcatggtttgaatatttaatggctactcaggaaatgtttgctaaaaacctgaaaatacagcaagaacatcacatgagtaccatccacgagataatattgaactttttttgttgttttaatgatagctttatttttggccgtacttttgagatcatttgtcagtgaagaccatggtagagaaaacatttctactttattgagaataatcagtaatatccatttatgttaaatctgtaattattgtaggggtcaaagtcaaatcggaataaaaagttggaactgacactgtaaatagaatttgatgttaccaaggagtaaatatatttttgaagtatatgatcgtgtaatatatcttttgagctcattggtcaagagccctgcctcgtttgtggttagcatagtctttctccgtaccattgcacccgggtcaaagaatgtttgtaaagagtactgataactatcatttatttatcattttatcattttgagtgcacttttacatattttagatcatttaatcttcttacaaacgctatggagaagagactgtcgcctttctgtgaatgagacacaggttcttagaggttcacacagcttgccccagatttcccagtcagccagtggtagaactgaattgaaatccagatttttctgactctaaataggcaactctgccttcaaccagataataaagaagagtaagtctctgtgaatgtcatttacatagaattgcggcatattccccagaatgtgccttaacttgagggactatctatgaggactgagtgtcccggaataaacctgttcatctacttgtggcacagcgataaccgctttaccctggaagatatccaagaccattctccaagaatgggatggtttgttctctaaaagaacaaaaaacataacaccaggcctacttagagctccaaaatgaggactctggggttgatgcaaatctttgtgtaagttaccttgaccttcacgaaatgatcaggatgagcttccttcattgtcccttcattttgtcctatttgaccttctaccaaattccaaagaaatgtctccacagagttcccttcctgaaaacagcccgtgtgttttctttgatctgccctgtcctgtcttcttgcagttctgcgcaaggagcttcagagccctagatttgccttcgctacccttgaattcagtgttgcttaaggagcctttaatttgccatttcctgttgagaaaacccaggaattctttagatgccctctctgtgcatgtctagctggctatgtcctaagtcagcattgggctacgcaatctgacaaatacgagcatacttttagagaaaataagaaagtatatttaaaattgagattgccccaagtcctttggatgtgtacttattgatctgttaatatatatattttatgttcctttagctgtgatttatctccaaataacagcaaaagagagaggcctggagagccccattcctgactagatatttattaaattccattaattgttcttattcatgacacctccctacaaccccctagaaaaacagaggatggctgtttgagaagtgtctcagaggtatcttatctctgcctttagaattccatttctcctggttgttgcacatagtattcaataaatatttgttgaatgcattaatgaataaatgaattgaagctgaatttattttaattgtagcatacatgcatgcacttttgactaaagttcttttacaaacctaatttcgtagagaaaagcctttcaaaggctttgttttctgcttgcttttcaaaattctcccctttttcaaactgccttgattagcaccaggcatggctttgtcataaatttagaatgttaagaacccgttttccaaatcacaggcactgtatgtatcccacattggtgttctctgattcttggttgatgccacagagataaggctaaagctctgagtaaaagctaaatctgactgagtttttcccatagtgcctcccataagtttggatgactaatggtgttagtgagatatctaatctttaatatttcgcttctgcatcatatttctccctcattaccacatataattcagatacatctttatttggcaaagagccactggatcttgggtttttgccccattgtgtgtccttagcattgcagactcaaggtttacttttttttcttgcgttgattaaagccttcagtctcctgacttaagcctgtagtgttcaaatacagagatgtatttgtctctgcactgtctaaataaaccaagacttgctctgaaattcaaggtatgatcctagcaatgaaaaggtagcctttctgagagacaaagacattgtcgttctactacctgcagagcaaattgattagattgttctcaagtcaacaaggtggctaaatattaacctaattcaccataaagtctaaagttaaagttgttagtagatgttatataacacgagggaactctgtagattcttaatacctactcaggacctttcatatgtcttgttgggcagtaagaccttatgaagccaaaatttgagttttctctttttcctttaaattcctccagtgattgtgcaagattattattgttacagtcaaagaagttctagatcagttactgataccactgaattaaagtagctggaaatcatgatcccgttgctttactttgtaattgacttgatgactttggacctagtctagtagctatcaatcttcatagctacgggaaatctttattcaatgttctttcattaggtctttgtgcaagtctccaatgatggtgaaaagatggccaaaatgaagggaatctgaagaggttaggaatgggcattcctatggaatataaacaaaggtgtcagggtgaggaatggcagagtttgtttgagggaaactgcagttgtattaccttttttaagaaggcaaagaatgagaggagatgaggctgaccaggtcagcaagggcaggtcgggaagggtgtggtacccactgcagagttgctgcctccgtgcctagtctagggagcaactcaagggtgtgatccaggagtcaggccatgatattgacatgaatatacgccacacaggcagctgtgcggagggtaactttgaaaagagcgatgctggaacgaggaaatcaagctggggggagtcacatgggagcccaggaaagagatgattagagccttaagtaaggtgatagaaatgaagtagacaggctgatctgagtgatatttcgggggaggatagagctgtttgattcggtagttctgtgggactagggtatgaaggaatgattcccagggctggtaactacaaaacaagatgatagtagttatttgcagctgggactgataattcaggaggagttgcagcaggtccatcctttaatgcagcagtgtttattagaggtccttcctgaagggctgagtagctggaaggtgataaatgaggtatggaagaggtcgagttgaggtcctggtgacatctccatgtgtaaatgtctgacagtctgagagatagaactctgatgcttgtagaaaggatataagcctgagatattaggactgtgagtcgccagctcacaggtggtagttgaaaccgtgagaatgaatttatatatcccgggagcatgtagcagaaggagaacactggatttggtagaactccggaagatgtgaacattaaagtgtgtatttaattacttttatttttagtagagaatacatgtatattattatacaaaatccaaagggttcaaaaagacatatagagaaaagtgaatccttctccaaccttctcccctggctgtggtgtttccagctctggaggctgccatctttcttggtttcttgtgtttccttccaaacatgctctctacatatgcaaatatttgcaaacatatttatggttgttggggttacttcacacagtgtcgtgcagtgttcactctggttttctctttttacttaaaaatctctaattttcacatgctggagaaatgtgccagaagaagaggagggcagagcttgggaatgatgggagcattttcccacaggaggcaggagagagaagggttagggaactaaagtatgggaggaggcgtgaccttgaatgagaggaaggactgcctctgaagacaaagtggtaggtaaggaatttagggtaaggaagggaggaaagaagcataatggaatgaatgttaaaatgtccagtagacatcactggaaataattcaagactgattcctacggctgttcccacatgtttttaaagttggagtggagaggaaagcgtggtatatgatacatttaacgaaactaggcattcaagttacttggtgtattagtccattttcatacggggcaatttacaaagaaaaagaggtttaatggactcacagttccgtgtggctgggaaggcctcacaatcatggcagaaggtgaaggaggaggaaaggcatgtcttacacggtggcaggcaagagagcatgtgcaggagaactgccctttttaaaaccatcagatctcatgagagttactatcacaaaaacagcatgggaaaaccccacccccatgattcagttacctcccactgggttcctcccatgatatgtgcggattatgagagctataattcaagatcagatttgggtggagatccagccaaactatatcatttggtgacatgggccccaaaacaaagggctacagagcccttcttgagacaaagggagctagtttgatcacagaaatcagaaagccaagaccttttatggcaaggatgaataagagctgaagggcatacatgccacatttaagaagctgtgtaagaatggggtcaaccatctcagctctactcaggcagggaggacaggaacatggtagaagtggaatcaccattattcacagactcagtttctaactagcagggccagtgtaactaaatttccttcagtttatccaaagttaattgaagtctgaggggactgattcatagtatgcagttcatggcagtgaatggataacccagaatgaaagtttatttctccctttatcctaattatctctctttttaactgccttgtattaaaatgttatcaaggttgccttaaagcttttttaggaggagacagcatctggtttaagtgcaaatactagatctattaaaatgaggaatatattcattttttcggcacacagcatcctgtgtcttagaatccagtgtcttaggaatcacaataaaaatcaaattgtgttctggtgagcctagaatcttggcatctaaaattggatgtttgtgaggactgcttcatactacaaaaaaattgaagcacccctctggcgattagaatattcacatcttacaagtacagctgccatctccctagaacatgctggataagagtttatgttcttacaatccaatttcccttttttttttttttttttttttagatttttcatgaagaccctcatcctcctgttggccttcatttgccaattgtccctctacagtagaattgattatggtcatgagtttctttagctactttccaggcctgaggatgtaattctgttcaattctgcagatagttactgagtgcttaatgtaattttaaaattatgagactacaaagatgaataagccttggttcttaccctcatggagctcaaaatttattttaaaaaagttaaaatagaaacaactacttatatcctgctgttacaagtgctctgggggcacagaggtgaatgatttattctatcagagggagtagagaggcctttacaaagagagtttaagagttgaagactgaatgggagttttccagtctgagagatgggggaaggatgagttttccagactggtggaccagtgagtaatgtgtggcttggaatgaggagaataagagggcagtgggatggtaggtggggactactgtttaaaggactttgtgcatcatactaaggagtttgggttttatcctataagcaggtgaacagtgatggctttttgacgggggggaggattgagaaaaataactgacctggcagaaagctaaagccatgaagattggtagaagcacagtggaatagtccattaaaagatgccaggttcttaactaaggatgtcttaggcaagtgaagaaggggatggagaaattagaaggtcactgaatgaatgagaccaagggaaaatggagagggggaggcatctggtgttacggaaagttttaatttgggaactgggaaatgatcattgaaaaacaaacaaaagcaacctagtgcacccaggaaaaactcctgatttgcaaagggttagtgcatggagagaaagagctacgtatcagacatactgaattctatttgcccaaggacatttcaagtggaaatttcctatgttgattttacgtattcagttttcagaaaggattctttaaaaagtcatagcaatacaattcctgcaatataaataatagatcaatgaacatcatagggattagcatagttgatttgactaagcttcagattcagtttgagcttccctgtagccagggagataataggaaacaaagatttgtctgtctcttaatattgaattaaagaagcacgcagcatcctaaagaaacatcattgttttcctggctctacgtaataataataataacaaaaatagctgtcctttgagtgattgctatggacaggaactgttctgagtacatatgaactcctatttaatccttaaaacaaccctatgaaagagaggctgtttccagaggattacgtggcacagagtattaaggacacttcatatggccagcaagtaataggacctgtattcaaacttgggtggtggtcctgaactcttaagcagcgttacacttgaagtgattattggctagtgtccttatcaacatttttataacaaatcccaagggaaattatatgtggctgtttctcatggcctttgataattgtggaaagcttaacattaaaacaccaaagatagggtgacagttctccaaggataaaggtcactgttgcctaaaatgtattctgcagaataccactgagatactctgagaaaaaaaggattccaaggacagtaaaactttgaaagcactcatactggaaagtcatcattacgttagcatttgcactgaggagtttggaagtgaagaaacctgattagctttgtctaacctcatgttgctcccacttacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatgggaagatatttctccctctttatcttatgacagaaatgcaggtatagctttcatctcaaagtaagattaaggtataagttacaaagatgtgtagctactatatggtcctgtgtaatgctacttgaggaaggctgttcctttcctggcactgaaattttagagcttgcataatcagtatatcaacctcgtgtggcttggtgcttagcaagtttcagcttctagagcccatggctaatggagccatccaggagaatgttggagagataggtctgaagccttagaagagaagtcttgattaaggagtaatgagttgcgggaaggggtcatggttgtggcggagatggaagcctggggagaggacagagacctcctaggaagagagtttgtgtaagaagaagaccaaggacctcctgatgtacttgattgtaattgggcatgagcagcccagttagaaatggtttcctgttggtattacatatgtacatggatggcttctgcagatggctaaactcacccattttatttttttactatcttaatagttaaaatatgaccttttcttgtgtctccaaattctgagttaccttatggtgctagtctgtctgttgtaactacaagtcataagtaaatccatatgattcttttcctgtaatttcctagtaaatcaaggcgataatttcaaagataaaaatctgtatttttagctttagcagtgagcatgattcccagtctttttgccttcgagtaaggtttgttaccatggtggaagtaaacaatatcccacactctagaatgtgagctcttcaagggtaagggacagtgtcctacatatatctttatctccacagcactgggtacataaatgtgtcataaaaatgaatgggtaaatatcctttggagtttttctgttacttgatgggtttttggggttgattttcaggtatctcccttgtttttctcatttcttacattattttctttcccaaaatcccttaatatacctgtttagtttgtgatgtcattttccattagactgaaaccatccaagttgtttaggctaacccagacttaagcattttctgggcttatttttggactctttttaaaactcatcatctgaaaatatttaatgtccacacggataattctgaagacatgtgcataccatttttcttttatgtacatgggttaaaccttgatttttccatagtaggagaaagcattataagattttattgttttcactggggtaatatcttttgtgctataagaaataaaattttgaatctagaacttagttttttataagacctttattgagatataattctcgtaccataggagttacccatttacagtgtattagtcactgattattagttaataggttaaccagtattagtaatcactggttattaattacagagttgtgcaaccatcagcgcacaattttagaacatttttatcaccccccaaaagaaatcccatccccattttcaagtcactcctcgtttctcctgcaactactcttttcagccctagcagtagacaatccctgatctactttctgtctctatggatttgcttattctggactgttaatgtaaatgaaataatacaatataaagtcttttgtgactggcttctttcacatagcgtaatcttttaaaatggtatctatattatagcccgtattagtatttcattctttctttaatgctgagtaacatttcattgtatggatataccacattttttaatctattcattacttgatggacatttgggctatttctacttattgtctgttatggataatgcagctatgaacattcatgtacaagtaccggtaattattttaaagaagttattctgggctgggcatggtggctcacacctgtaaacccaacactttggcaggctgaggtgggaggatcacttgagaccaagaatttgagaccagcctgggcaacatggggagataccgtctctacaatttttttttttaattagccaggcatggtggctcatgcctgtagtcccaactactcaagaggctggggctggaggatcacttgagcccaggaattcaaggttacagtgagctatgattacaccactgcactccagcctgggtgacagagcaaggccctgtctcaaaaaaagaaaaaaaaaaaaaagattctatagtttctgtcattgtaatagaggaggccataggatcatatatggcaagagtatatagcagtgcatgccagggagtgaaaaataggccatcaaattgaagttactgggagaacttaagactaagtctaactacgcatgagggattgaagccgggacacacaaagcttaaaattatgattcttctagagactgttacggctttttgctgaccacagacaatgaaagtttgatattttgctgtatttgtctgaaaatggaaacacacttttcccaatggcagtattcctgaggactagagttcttcacctctaaaacctctccaatcctagtttttccttttggctgatgatgaccagccactgccatttttgtcttaggttttgttagtctgtcttatttccagttataagtggttaaaatttcttatgaattcttcttgtgttgaacttttgattaatacatttagtctatagacagtaatgaattagcatctgatcaggaatttgtgaaaaacatctcagtcattaaagattaagaaactgaagccaattaatattgtcatgttctgtctcttggaacttgagcaagatacagatctacgtgtcaatgacatatccagaaaatagactccacctagatacattaaccctgtacccttggtccacatattttatttcagcaatgatccatggacatattataatttgacagtttcatcacatacctagcgtattgggtcaaatcaaggaaatctcatcctagtgatcttaactcagtgatttcattttgcccagatgttcagctgtgataaactttactaaggcacagatgatggatgatacacaataattccaaaatttgggggtggctacaatgtggctaggggctagaactcaggtatctacaggacaaatactgagtgattagtcactttctaagcgctagatatgcatatgttctgccaagctcagtaggtctaagtagattgcttccatttcagataattaagtgctttctttttataggaagtttttagcacatctgaggttctaaatccaaaaagtaaataatatatagagaaagaagtaataacaataataatagtaaccaacatttattgaacacagtatgggctgggcatggttcaaagaaagtttgacatatagaatgtcgaccatactggcttaataatcctcataactgaattagtgcttaagtcagttgcccagcctcagcaagcagcagaggcaagtaagtcataaatcaagatcttctgaatccaagaccatctctcaagccttgttctaattctctcctcagccatggatggtgaaaggcaccacaaaggcagcgtgtcaaaaagtggcattgttcaacctttcccctgatggggcaaagcttttatttttttcctttacgttctttgacatctgttttaaaatgcagatatcactagaagaaatgacaactttattataaaatcccagtaaaatgtaaatgtcttatataaaacctttatactgagcaaatttcagtaggaaagggcttggaagtaaggctctgaatgttttaaagggggacagtgctaagaaatgattagaaacaagagcctggaggggtcctgccatttttactgttttgcttaaggctgacctaaaatatgcatagtcttacttctcaccctgtgagcttatccttattaatgtctttttccacctagtttaggggtatttttgaatttgtgtttgataaagatgtctaaagctgtactgtaaaattttattgtcacttttttttttaaatggagtctccctctgttacccagcttggagtgcagtggcatgatcatggctcactgcagcctcaacctcccagactcaagcggtcctcccaccccagcctcctcctcctgagtagctgagactacaggcatgtgtcacgacatatggctaatttttttcaatttttttgtaaagatggtgggggtgtctccctatgttgcccaggctggtcttgaactcctgagctcaagtgatcctcccacctcaacctcccaaagtgctgggattacaggtgtgagccattgcactgagctttattgtaatttcaagggctcaatgcaatttccagtttttaaagttcatcttgcttgcagaatttgtctttcatttaaaaaaaaactgctgattggctacatttatagctgctgtaatagttctgtatgatttactacatttgcctgaatttagattggtggatatgatttagctgcttttaatattatatgagggtaaagccagatttctttggatctattccttttagatggcaatctttgtagttgttctactttacaaaataatccctgtgtgtgctcatgctttggtatacagttaaatgtatgatactgttaagaaaacattgatcactggaaagtgaccttcatttctttatttcataaatatcattatacaactatataactacacgtagtagggaagctccatttaaagagtagatgacttacactgaaatcatttgacctttgtaaattagtttaaattacacagagattgttgtaatgttctttatcatacataatagttacgattgctagagaggcactcataaatcattgctaaaagggccagctgctttcatgttttcagcaggttgagttaagggaacaagccttgccaatttgattaatctcttatgtccattagttggttgggaagtttttttgagtgtaaatttgtatgtagacaacagagtttatattctttatgacataaaattaatcagatatatctacatatttgtagaatggggggattcttagctctatagagaataagaaatactggatggaagactttttttaggatgactggctacaggaagaaattgtagtgacagaagccatgtgtattgaatttgaattaatgttccttagggagctaccagagaaatataatttacaagataatcaagaacgtaaatagattctctgtggagtcgttgtctgatcactgacatatattcatctgtattgaaatgacttcatgactacattctaacaattagagaatcattaggggtgagatgtacgtgtataccttcaagaaaagcaaaatatgtattggtaataattgacagctgttaaaacgagtgcattgtgtacttgttaaacattagaggctgggcatgttggctcacacctgtaatcccagcactttgggaggccgaggcaggcggatcacgaggtcaggagatggagaccatcctggctaacacggtgaaaccctgtctctactaaaaatacaaaaaaaaaaagccgggcgtggtggcgggcacctgtagtcccagtgactctggaggctgaggcaggagaatgtgaacccaggaggcagagcttgcagtgagctgagatcgcaccactgcactccagcatgggcgacagagcgagattccgtctcaaaaaataaaaaataaaaaaataaaaaaaaaacattagaataacttaccttggaacagtaactctgagggaaccttgatcatttatgagaatgatctcccctacgttaatactgcatcaaaactaacattatggtatacctcaaaaagtattggcatagatgtttttaaatataagaaaattcaaatgcgtaattgataagggctaaatggctcaatttcccaacccctaacaaaaatatgccctaacacagctctgtgactatgactgcatttattagaaaacatttagtaaaaatcatctctagttcaaaccctccagcatcagttcttcttgataattctcatgaacatttagaaataccttaaaagagaattcagactcaaatcaaaaaaccttatttcatttggttgcaggccaagatacctcttttaaccatttctggcttttagaatccttatcatgacagcttgtcctatctcagagcttcaggaggaaaaactagtccctcaaaatcaagtttgctattgagcttaataagaggtttctgtatgtcatatgtttgtttagaagaaaagcacttgttcgactcatttaatcctggcctgatgaattaaggcttgaattaatactgagggaaccttgactatacatctacaaaatcaatgtgtcctggtaggcttctgattaagataacattagctcttgcttgaaggcatctttctctgctcctaccatttatccagtggtagataatatatggagtgaaaaatgaaaaagacatagctgggctttaaagcaagatgaacatctctgtgaaccagaaatgtgaaagaaaaaaaaaaaagtaagtggggctaaattagtgggctttcagctcgtgctgtagtaacagggattaaaattctccttacaaggtagtggcccaaagccaggattactatttgaaatcagagccccacaaaaacacacctagagagagacacatacacacttacacttaaaagcaacatgaaaagaaacagtttgctgcaagggtctacagcttatatgcagctatggccctaatgcatagagccgagggaagaggcaaagattcgcagttgggaaagagagcatcacagccttgaaaccaggacctgaaccaatctacctactgcctggcaatgaaatgagtgatatctctgtatcactcagtgtaggagctgcaaactaccaacagatgtggctctaaactctaagcccctgggtatggctgggagaagccataaaaccacctgagagagagataatgagtttaaaaagagaggaaaatattaaagtacacacacatgagaataatagaaaacatacacatgcatatgtatgcacatgcaaaacatcccttgcaaaatttgtctccaaatcacgatccaaaatacatgaagaaatgggatagcaccccccacccaagttaaacatcaaaaagtgaattaggctgggaacagtggctcacacctgtaatcctatcactttgggaggccaaggtgggaggactgcttgtgcccaggtgtttgagactagccagggcaatgtagtgaggtgccatctttacaaaaaataatttaaaatatattagccaggagtggtggtacatgcctgtagtcccaactactcaggaggctgagataggaggatcgcttgagcccaggaggatgaggctgcattgagccataattgtgccactgcactccatcctgggcaacagagtgagaccctatctcaaaaaaaaaaaaagatgaattaattctagaagaaagcaaaataatacactagtacaacaaagatttttacttacatttaagatgctcagaccaggtgcagtggctcacgcctgtaatcccagcactctgggaggctgagatgggtggatcacctgaggtcaggagttcaagaacagcctgcccaacatggtgaaaccctgcctctactaaaaatacaaaaattagctgggcatggtggcaggcacctgtaatcccagctactcaggaggctgaggcaggagagtcgcttgaacccaggaggtggtggttgcagtgagcggagatcgtgccactgcaccccagcctccatctcaaaaaaaaaaaaaaagatgcttaaaggcataaataaggggtaccactcgctaaaataacaagaaactaagaaacagagatggatgaaatgtaactaggtctgaaaacaaagatatctttgccaaaaaaactagtcattgaagttactaaactcaatatacaggataaattctagactttgtcctgtcagagaaggcaagggaattagaagatgatgctgagaatgttactgtgtacaacactcacagaaaaagataagaaatataaatgagcaattaggagaaatggagaattgaccacaggctctacaatataccttactagaatttagaggtttgtttaggagtgtatttgagaggtttcagaagaaaatggaggaaatggtagagaagtaatatttgaagctgtcatagctgagaatcttccagaattgaagaaggatgtgagtcttgaaggaaatgtgctcccaagagaaatttcaaacatctgggaaggaaagaaaggcctgcattgagcaattgatattctttacagctcagctttggctgattaaaatgagccttttctgttttcactggaaaccaccaaaacagaaatgtaatgtgttgtatataccaaaccatgcctcttgaacaagggtccttataaataaatcataaaagaagagccctgtggacaactaaacccacaggatcaagataccaaggaagatctctctagaaaaggcagtctcctgtcagcacctttgtgaaaaataggtgggaagacagtaatggcttgttgtaccatcttgaggtccatgtctaaaaactgttttcaaaaggaacaccatggctgccccaatctggtagaaagaaaaatttgaataggattctacataaaaagtgttgccagttagaacattttgttgaagttttcttttaatgaagagggaaaaatagaaagtaattcctatggaatgagaccttgtgaacattggatactgcttcaagttcacagaaacattgaactgattgccagttaagttctcagaaattagatttaattaatgtggacagttacatacatcggtgcacacccagaagacccgtgtgcagaatctgactgaaggtgtacttacttcgatgaatctcttctcatcactgctttgtcaaagcagattgctatgaaataaactatacaaacaactacccttgaaggctgatagcaataggatttcaatcagtacagataggagattctatttctgtagatgaaaaagatcatacattgattttctgtgtgactttaaataaattcctggaaaccttgtaatgttaggtactaggtagaatgaaaaaaatgaagcaaaacaaaacaaagaaaaaaaccagagtagattgggttttctttctgcttccatgtggagatctagccttttgaaactgagcattttggaagacatgccgtcccctgtggaatgttcattccgagtatgggacaacagaaaatatttagcagacctggtgatgagatgatcttgctttctcaaactggacaatgggaaaactcttcttggctactcactacttacatttcatctcttttctcattgatatagatctcccacatttgtggataggaatttctctcacctgatgaaatatcatctgtgaacaacagaaatctgtcatcttattttggtatttatcacaactagaagaaagatgtcaagagttctaatcagtcactggatatcaaatatcagaaatgtcctcaattggaattgtattctcagtaaatcctaaagcatttgggaccttcacatgtgctaatactgtttatatttatttggaaattaaccaaatataaccaaaagacagtggaataaccatagaaacctttaaatggaataaaatttatggcaatcaacattattaggaagaaaaagtatactacctagaaacagtgcaagaacaacgaggatcttctgtgcatctaactatataggtctagaaatatataaagtgaattatgatagaattaaaaggagaaactaacaaatccataattatatctcaacactcatctaacaaaaattgatagctacaaataatcaaaaattaataaagatatggacaattttaacaacaaaatcagcacactatgtatttagagactccatctttccaatggaaaaatacacattatttcaagtactcaatgaacatttttagaaagtgactgtgaactaggtcacaaaaagaagtattgctaaatttcaaaggatcagtatcatacaggggttctctgattgaaacgcaattaaattagaaatgcactaagaagtgaaaatggaaatataaccactgtgctcctaaatgactatgggttaagttaaaagaaatcacagtaagaattacaaaacataaggcactgaattgaatcaggtgatgtatataaaaacttttggtatataattaaagtggtaccaaggaggaaatgtataaccctaaatgtgttcattaaaaataaaaaatcaatgacttattcaacctgtaaagcaagaggaaaaaaaagagtaacaagtaaaacattattaatggacataaaatgagaccatagtaagtaaggagcttcactgcattcttggatgtgaagactcaattattatgaacttagttcttcccagtttaacctatgaattcaatgtaattcaaactcaaaatttcaacaagcattttcataaaatcagaaaaccaaacactaaaatcatggagaagatcaaaggggtcagaatagtcaagacaattttgaggaaaaacaaagtgggctgagaaggcctatcagacatcaattgatttaaagctggagtgtgggatctaccagggatatgcagatagaaccacagactagaatacagagctcagaagcacacctgtatatttatggacacttgatgttttgcggaagcatcgttagagatcagtgggaaatagatggaccatacaatgaatgaggctggcttcatagtttatccatgggggaaaagtaaaattagatcgcatgttcacggcaagcacaaaaatagattctgggtaaattcaagtcctaaatgtgaaaaaccaaattttaaactttaaaatgtaggtgtaagaaaagattttcgtgaacaaaacataaaaagcagagaacatacagggatatgttaaaatttacatcttttataccataggatgccataagcaaagttaaagataagctacactaagataagggtagaagatcatatttgccatgcacataactaacaatggattagcatctagaacatatccaaaggtttaaaaagaaaaagacaatccagcaggaaaatgggtaaaggaagcatgaaaagccagttaacatggaagaagtctaaccttgccagtaatccgggatgtatgtgcaaattaaaatgcacccatcaggttaactaaaacttgaatgtctgataacaccaagtatttggtgaggaggtgggccaaatggaaaacctcattcactactgaagcgagagtaaattggtaaaagcaccgatttgtcacccagagcgattcggtgacatgtagcaatgttgaagatgttgctaagatccaacaattccacatcaaactatattctgtaaagaatctcttcaacaggtatccaaggagataggtataaaaaagaatttcattgtatcattgtttataatagtgaaaagttggaaacaacctaaatgtccatggacaggaaaatgttggcatattcaagcaacagaataataataccttatggcagttaaaatagcaaactattatgtatcgacctggagaaatctccaaaatggtgttgaaggcaaaaagcaactcttagaatggtatgtatattcttaaatgtgaagttcttaaatttaaagtttaaaaacatgcaaaataatgttattagattgaatcacataaaatgggtgtttttgtaggtgaaagaaaaatacaggcaaacatcagcatcttttttaagctcaacctagtatttgttgatacattcatggtaacactgggcatgaaattcagtgtggcattatctccttgagggcagcggggaggagagaatggtatggtgttgaggcgggcatgtgagggagcttctgctttggctgttaacttttctttcttcaaaaaacttttgaagaaaatatggcaaatgataaacttatcaaggggaggtgataggaacatgggtatacttactccattcttatacatttctgttgaaaatatttgctaatgtttagagcaaaccaaagtgttgatagaggtataaaatttttaatctcatgacattataaagaaatatttacaaagtgattaaatcctttgctgcttacttatctgaacataccagtcgcgaggcttttagtgtaacataaaaaattgaaaagcatggctcccttcacacaccaggcaaaagcttcaaattttgttttgttcttttagcactggtaagattgtcatcattaaaaccattcattagtgcctcttttgcttgctgttcttcggtggcagtcagatgcatctatctaccatggtatataaaatttggtgatgatattcaaattactttttttcttctttttctttttctttctttttttttcttttttacttttttgatgccaataggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaagtgaggagagagatgggatttttacaaacattcatttttccctcttaaacaaaactaaacctcagagagcactttttataggtgcaacaagcatcaattcttaagtgcttggtatgtgcctgcaaagtgatagtatcaaaggatagaagtagaggagatagaaaaactagtgtgtcttttttgtatttgtccaatattgtttcctaccaaaatggttttttcttgaccaatttgaaatacatcttggggaaaaaaacgcctaaaggtttccactagttctctaaaagtgaatatttcacttcttgaaatggaactatttcatttacaattagttatattttctggtatacctttgtgttttttttctcctaatccctaacacatagttctttaagcctccatcgaaaacctagcaagatactgcattgtaagaggacctacctggacatagttctggctttctgggaattttaaatttttcaattatgttctctctatcttgttacttaatacttcacaaagatatgaatcttccattacagttttgagatctcacatagtctcatcattcacacatgaccttctaaatcttccagttatttaatgtaatgatgtatagtctcattccagtgtagctctgatttttttctcaaatttataagggagcacaattcagatacaaagacagtttctatggattatatcaacagtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggcgaaaaaagtctaaaaagaaaattctaaaaaggtgtattctggcagctctatctggcccacagaaaacttgtataggtgagaagaccagttaggaggcaattgccaaggccaagattggtgagttctgagggcctgcacttgagagatgtgggaggagaggactgtgagactattctataaaaatagacttgccagggggctgggcgtggaggctcacgcctgtaatcccagcactttgggagggtgaggtgggcggatcacaaggttaggagttgaagaccagcccggccaatatggtgaaaccctgtctctactaaaaatagaaaaattagccaggcatggtggtgggcgcctatagtcccagctactcgggaggatgaggcaggagaatcgcttgagcccaggaggcggaggttgcagtgagccaagatggcaccattgcactccagcctgggcgacagagcaagactgtgtctcaaaaaaaaaaaaaaaaaatagagttcccagggtctggggactgagtgcaaattgtaagaagaggaatgaagggagaggatttggttggaagaagatagtgaaacttctgattgtggacataatgtgtttgagaaattgacaggtcttctaagtcatgtcccaaaagaaattaagatacagatctatacttgaagtaagtgggcaaactggagagatttgagaatgagtttcatagaattgattgctgaagggtgtgagatgagaaatctataaaatctataacacaggtgcttcgatccagtgccttggaaaagacctccatttgggtaatgggatagtaaaggatggataagtagggaggttcaaggaagatgtgacaaaaaggtgaaatgctaaagagagctcaatggaaattaaaataaatcacagtccattgggtcactataaatgcattgggtaattttgagaaaccattttaggccaagagaagggaaggtggaaaacttctgtttcaatgaaatgaaagactaggtaatcttaaaatgaatgaggattaaggaaagtgaagacaattttgaaacattaccaagtaagaaggaagccttaggcaaaagttggatgaatttgttgaggaaatggtccacatgttctgttctcattcttagcaatgttctctgcctaggactaggttctaagaaaggtggagctgatgaggcataaatgatcaaaggtcaaaacaagagtagggcattttacagtggtaatgaatggctaggacaggggttcctagccagctgctcattggtttttcctgctgtgtctggctagacaatagagggttttatgaaggccacaaatacttggtcccccttcctcatttctctttctctgtaaaggcccagtaggagtcagctccatcctctctccttacttttccctgggacctaaactggttatatacttggtcctctcaaatcttacctcacagaatagaaaagacctgtgactccttgattccatacacttacagctctattgcctgatatgatgatgtgttcaggaattcatttcatacttgagctcttccatgagggtagaataaagggaggcaaagtgccttaaccaaaatggataggacagaaaggaaaagtcaggggtgtgggtgagttttatggcgaaaaatttggagatcacagtcgggaaaattcaaaagttggatatcatggaagtaaaatactttcaagcaatttctacatctaacatggtgcctcccagcgagctgctgaagattttacttggagatcactgaggggtagggagtacagttcatggagttgatgagaccaacgttgctgagcttatcagcagaggggtgaggtccagatcctgacgacagtggtagatcaggatggaaaagatgttgaagaagatggacgagggctctgaggagatgaacatttctgaggaaagagacagggtagttgaaataaatgtgatgaagttcaagaacctggagcagtgggaagaggcacatcctcctctggagaagccaaatcttgtaggaaagccaggttttgatttttttgagaaggaaaaggatatgtttgaggttattttcctgaatttactacacctccatgatttaaggcaatctctgtgtcagattatctccctccacctgagatctgaatatagctaataaactgttgggattgtaaatgacaacacactacatgaaaaacaactgtatgcatttgcaaagtctgtaaattctgaaaacaactgagctttagtacctcttatttttttctacttcaggattttcccccttttttaagtaagtaaagcatatgaaactaagttacatattttagtggtgagattcagagccctgggtgcttagaagcattaataattatttaggtcgttgacaatggcgaataggcagcatactcgttaaagcactcaaattaaagtgcacattaggatgtggtcctgatgatctgtggagctaaaaagatcatggtagaactgaataccaggacaaaagtgctatattccaatggctaagctaagagataacttgctggcataaaatggataagctgtgttaaatttgtcctctgaaagaaaagactgaattcaagggtactttttcttgaactgtgtattaatctgttttcacactgctataaagaactacctgagactgggtaatttatgaagaaagaggtttattgactcagttccacaaggctggggaggcctcaggaaacttacaatcatgggggaaggtgaaggggaagcaaggcatgtgctacatagcggcaggagagagaaagcgaggggagaactgccacacttttaaaccatcagatcttatgcgaactcactatcatgagaacagcatgggggaaaccgccgccatgatccagtcacctcccaccggacccctcccgcagcacatggggattacaattcaacatgagatttggatggggacacagaaccaaaccatatcgaactgcataagctaacttcatttaaaaaggaaaaaagccttaccgtcttcttgaaggatgcacacaggtgtttaaataaatgcagtgtatatacttgggctttgaaggtttgagatacaaggctgggatctgctgaaccacattctggatagagctgcattctttaaatatgcaaccccgatgactgattttcttttaagtgaaacatgagacaagtcatattaggtgatgtgtctaaagagtcaacatatttcctcaagccatgaaatacttatcactgagtctctatgtaccatttgtattctgtacagttcttactgagacaatgtgctaatgaaacgtacattctattggaggaagcaaatacagaacaaaatagcaattaacaatgtttatcccctattggctctcatgggctccatatacaaatctgtgatgtccagacaactccttatctctgatgactcctaactttccaccagattactgttttttgaagcattttatattttattgatttaaaaattaaactgttcctttgctttttaaaaaatttatcatgtacatttgaggtttatgacataatggctccctagctttttatttagaacaatttcaaacttatggcaaaactgcaattaattcaacagtttgccacatttgctttatagctatttatttatgtacttttacattcatgtgttgttaaatggattgcatatatttagattaacatgtatatctgtatgttaacatatttttatatactgtatatgtttatattttatgtgcatatttaatcatattcatgcgtgtatatagtttgtggatttttttttcactgatccacccaatggttaggtttcatacataacacttcacccctaaacacttgaacacgtgccttctaaaatgaaagatattcttgcataagcacaattatcatgctcaaaaagaacaatactgttatataatgtagaatttaaattcaaatacctccaattctgccaattaatattcttcatagcgatattttacattcaggatcagtgatgtccctgtagtctcctttaatctgaagcacttttccagcctctttaaatctttcatgacattgatatattagaagaggtcgggctagatgttttgtagaatgtcccccaatttgaatttgtctgcttgtatccaagtgattgggttcgggttaaatgttttatgccagattaccatataggtaaggtatcctcagtacatcacatcaaggttttcctcaagattctccatccccttcaccgttcttcactctccctgggcgctccttccatactttggcttctgctatgctgacaactcttaagtcaagatttccagcccagacctcccacctgagcatcttctggataaaattataaataaaaatatagcctaatctgaaatcatgatcaacctttggagcatctcttccaatttcccaatctatacaaagtcattttctaccccttcttcctttacctgccttccttagctatgttccaccaccatcaatccagtcaccaaggtcagtgtgttttgctacttatgaaaaagagcaaaattcttcaattcagctacttctgcccaaatttagccctcatcatgtgttacctgaacagacaatatgaatactttcctaattggttcctctgcctttggtctctctccctttctaagctatcttccagaaacttcagttcctcttctaccattcaaattatatcatattattcccctctttaagcattttatgccttctgtttgacaacagaataaatgtgctctttggccttgagtacattatgttcttaacctgaaatatagcatcctttcttttcactcagtgagttttcttttggaacttaatcatgcattatatcattctggttttgttgttgttgttgttgttgttgttgttgttgtttcttttgtgtgagacggagtctcgctttattgcccaggctggagtgcagtggtgcgatctcagctcattgcaacctccacctcctgggttcaagcgattctcctgcctcaccctcctgagtagctgggattacaggctcgccaccatgcctggctactttttcttgtatttttagtagagacagggtttcaccatgttggccaggctgttcttgaactcccaacctcaagcaatccacccgcctcagcctcccaaagtgctgggattaaaggcatgagccaccacacccagccatgttttcagccagttactagtacttctttcttctgcctacaactccctagaacttaagctccttaaggacaggatgtaagtcttgctcattgtcgttactgtatgaggatactctgtgcaacaaacaatcagtaaagtgcttgttgagttaatattttagaaatcaagcataatacattcttgtgtacacatggaacagcccacacgtttaggaaatttagctactagtttcagtatctttcaccaccattcacaactgatcagctaataatcagcaacaacattgtacaccataatatgttaaaggtgttacacacagaatttatgtgtgaaattgaaagcatcggtcctatatcatatggaaaaaaattaattgtagccaaatgttgggtattggatacatcagtgtgctttttcttctaaaaaatactggagaaaggcaggaaatacacaagtactaagataataacacatcaagtcggaaactggttaaaatccaaagaaaaatgttggtgggcgtatttgttcatacacagccccctttatgagaaaaaataatttcttgtacacagctcctttttaaaaaaaagagaaaataatttgtttagattcagacaaaaacacaggagtaattcttgtgtctattctgcataggctgcgtaggttctggctaaaatcactttttaagcagatagaaccattatcagcgtttgaatcaaagggaagtgagtcagatgggatatcttcccttcaagaaagggatctgaaaccatcgttatatttcagaagactgaagaatatcttgccatggcaaagcattccttttcttttttctcggattaaattgagtcatcccacttcttttttcttcacttcagcagtgattaaaggagactatcatattttgctatatcacggtactatttaactttgactatgtctttccttattttaaaaaatgtttcagtgatttatttggaccacaatcagacaagccaggaagaccaaatagctaataatccaaaaaacattatttttctctttttattatttcagtagttttcagggaacccaggtggtgtttggttacatgaataagttcttcggtggtgatttctgacatttgggtgcatccatcacctgagcagtgtacactgtacccaacgtgtagtcttttatccttcacccccctcccacccttccccccaagtccccagagtccatggtatcattctcatgcctttgcatccgcatagcttagctcccacttataagtgagaaagtacaatgtttggttgtctattcctgagttactttacttagagtaatggtctccaactccatccaggttgctgtgaatgccattatttcattcctttcatgactaatattccatggcgtgtgtgtgtgtgtgtgtgtgtgtgtgtgtgtgtatataaacaccacgtacatactgcattttctttatccactcgttggttgatgggcatttaagctagttccgtatttctgcaattatgaattgcgctgctataatcttggtatgcaagtatatttttcacataatgacttcctttcctttgggtagatatccagtagtgggactgctggatcaaatggtagttctacattttagttctttaaggagcctccatagtgttttccatagtggttgtcctagtttacattcccaccagcagtgtaaaagtgttctgttttcaccacatccacactgacatctattatttatgcatgtttgtggaaatcaccttggagtagagtcaagtttaagtgttaaagcattgccatcaactaagtttaaaatcccccaaagactagcaatatgctatttgagcaggcaatgaatctgtgaagtagggataagggctgtgcaggtctctagtgtgcaactggaactcagtattttcttgttgaataagtgaaaaaagtgaaaaggtgtttttgtttttggtgatgaggggcttgtgatgacaggtattattgttagagtcagaaatattttgaggttgcctattaatatggtttggctctgtgttcccacctaaatctcatctcaaattgtaatccccacgtgtcaggggagggacctgatgggaggtgactggatcatgaagaagttttcccccatgctgttctcgtgatagtgagtgagttctcaggagagctgatggtttttaaagtgtgtggcacttcccccttctctctctctctctctctctctctctctctctctctctctctctctctctctctctctctctcctgctgccatgtaagaggtgccttgcttcccctttgccttccaccatgattctaaacttataatcatgaggcctcctgaggcctcctcacgcatctggaactgtgagtcaattaaacctctttcctttataaattacccagtctcaggtagtatctctatagcagtgtgaaaatggattaatacacctattatgttgtagctacatagtgtatgattagacaagccataaatattatatctggcttgtttcatgcccataatagtgtatcagtcagctgttgctgcataacaaataaccacaaaattctcaagttgcatatttctcattcacgcatctgttgtttggctgaacttttgctggcaatcagctggacttgacaccaagttgtggtttgggttcaggtctgttcaacatgtctctcatccttcttgggctagcaagctacctgggccatatgcttcttgtgcacataaacacaagcgggcaaccccaaccagtcaaagacattctaagcctctacttttgtcatgcccgcttacattccattttccaaagcaggttatgtggccaaatccgaatccccaggccagggaagtactgttttcccagctcttgttcactctgctttatctacattagacttcttgctgtgcttgaggaagccagtcacactctcctctcagagtctttgcatttgccaatccttctgtctggagcacttttccctcaaatacttgtgcaactcataccctccagttcttaaagcttttgctcaactgcatctcatcaatgaggacttccaagactccactttctgatgactctcattgtcccttgctagccctctcctcagagtgttcatcaccactcaagatacctatatagtttacttatttacttgttaagcctgtgtgcctccttatgaatgcgagtttcacagagagagtgtgtgggtggggtttgtttgcttattgctatatcttcagtgaacaatatgccaggcactgttcaaccatttgaacagtgcctggcatatatagttggattttaataaatatttgaataaataaatgaatcttactgtttttaaacttttgtggtttttaaaaggcattttaaaaatctgggttagtatcaaatattacaatggtattactttaacttcaggtttcatttagctgttttaacttttacaatatattctgacacagaaaatattaggcattaagcatttttcaatgagttgattcacttctactcatgcacatatgtgatgtctgatttcgattcttaaaaagagatgagcctgggcgtggtggctcacgcctgtaatcccagcactttgggaggccgaggcaggtggatcacgaggtcaggagattgagactattctggctaacacggtgaaaccctgtctctactaaaaaatataaaaaattagccaggcgtggtggcacgcgcctgtagtcccagctactcaggaggctgaggcaggagaatcacttgaacccggaaggcagaggttgcagctagccgagattccaccactgcactccagcctgggtgacagagcaagactccatctcaaaaaaaaagaaaaagagaaaaaaagcaatgcattaaaaccatcttgagaaatcatgaaaatatggagaaaagaagaaaacaagattatactctacttgtttttatactacctagaatgtaataggcactcaaaaaaatgtctgaatggatacaattatcactgccttaaaagttttccattaaagcaaagaagccaattttacatttgtattatacttggacactcatattaaagactcacagagagtttatctggaaaaataaacttggctgacatcattaggtttatactttataatttgatctttgaaataattcaggaacaggaatgccagtcacttcattgaactgtacctgaattttaacacagtacaattgagttcctagagctccaatatgatgtaattaaactgtcagaaatattaacatcgatgttcatgagcgtcgttcatgatgttctcttggttctgatttattcagtgaggcatactgtcactgaagtggacttactgccattaaaaatgcctcatgtttcccagttccgcaaaaatttgcatcagtaatgaaacagagagatgtaatcagccctgcagttgtcaggatcttgatcctcttggtagtatttcattcatttcatcttcaccagataatggtagtttaaaaccgcaagaaaaatgaaactaaaaatagtgaatttcacttctttttctaaaggcataaacttaagcaaatagtgcatgtgtgtgaggggggaggaagagagagagaaagaggagagagagagtttgtaactattccttttctgctttgtgaccttaattcttcagcacccatttcctgtacttaatattgcaaagaggtttcctgtggtatgttaccaggagactcatgtagtctgaggctttttatctaccttacgttcttatccctccattctaataaaaatatgaagcctcacatccacctagaatatgattttgtcttaatggttagcattggcaatgattcttttagcttctgctgttaaaaaaaaaaaaaggaataaatgcaggattctaatcaaacatgaaaatccaagtggcatagaccaaagggaatgagaagcatatttaagtcatttagtcactggcttccgaagcagttccaagtcagatgtaaacctgaggttgtccctaattaagttcattatggttgacttgctaaagcaaggtcttgttttagatggaagtgacaatgtgcaaaacaaacagagcttgaatagaagttattttcactattggaagattgtatattatgaaaagttagtttcaaaggacctttaaagtttaattttgtttgcacctaagaaatttccctttaacttgcaaatgctgtttgaagtgtatttctttaacacatgaacaaacaatacagacacagattcacaaaatctacaaggagatttccattcccagtgaatatcatccatccataggtttctttgcttccagatcatcattctctcctcacataaacagtcaaaatgtttgtaatgtcttctttataaaacccaaaacataattatgataaagtagtcccaagtaacagaggaaaggaccataactctccaatatatgccatatctacagtttttagaatattcatatttcattacctatataggatatatactatttttatttctattacattggagtttaaaggtacttgagtttcgtttgtatttttggttaaatgtcaaaacaaagagtgaaaaaaagacctcagtgtctcaactcccttcttaccttcatgaagtgactgcaaagtgttcaattcttactcttttgtgttgaggagacagcactgcaagtgtgcagtaatacttattttattacatagaacaaagtttcacatttgtgaatggggcacaaaagagagcttgtcagttttacctttttcaattgactttttcttttattctttttaacttttaaatttattttttgtttttttgtttttttgtttttaaatagagacagggtctcactatgttgcccaagctgctctcaaattcctggcagcaaacaatcctcccacctcggcttcccaaagggctgggattacaggcatgagcgaccgcacccagcctgttttttactgtagtataatatttgtacatatttatggagtgcatttgatattttgttgcatacacagaatgtgttaatgatcaagtcagggtatttagagtattcattatctcatgtatttatcatttctatgtgcggggcacatttcaagtaactagtcaacttttaaaaagatacgcagtaggctgggcgtgttggctcacgcctgtaatcccagcactttgggaggctgaggtgggcagatcatgaggtcaggagttcgagaccagcctggccaatatggtgaaaccctgtctctactaaaaatacaaaaattagctggacgtgttggcgcatgcctgtagtcccagctactcgggaggctgaggcagaagaatcgtttgaacctgggaggcggaggttgcagtgagccaagatcgtgccactgcactccagcctgggtgacagagcaagactccatctcaaaaaaaaaaaaaaaaaaagatatacagtttttttttctccaagggtaatgatatagataaactactgtatggatttcttcttccctttaaagaattacttcctcattattaagcttgagggttttctttgttatttatgagcaagtgaaatgaatttataatggtgttaaaaatgtaatcatggccctttaatatctgttttctataaatgtaattttccattatttgtttttgcttttattaaggtgaggaagatcttctcagtcctccccaggacacaagcacagggttagaggaggtgatggagcaactcaacaactccttccctagttcaagaggtaagctccaatacctagaagggactcagatttgctgggatcaggccactcgcttccctacccaactggtgtgtgtattttccatatggaagccaacacgcagtatcagaatggcaatttgggtccatggtgaaaagatttgatttttaagtgtgaatttgtggtttagagtactctgaattcaaatacccgtgagggcaacatgtttccaaaaataagaataccaccctctatttgtcaagtattttacttgcttcacacattagtctgaagagttaattatgaggtgccctttactgaagagcaattattatgtgacttttacagatgaggaaattaatgccctgatagtgcctttgccagggacatatggctactacgtgctacagcaaggcctagaacaatgcctactgattggtagtggtagagattctgacttgccatctgatgccctttatatttaaaaattgtatcttactccatcatttaaatatagggacaattaaatcttcatagagtagttggttattttttacttcgatagaggaaatacaggcttagcaaagaaagacattaatatttttctttttcttcatcactttggccttgcgtattttacccccatacaaaaacagcattttaccctgcagaattttcccactggcttgcatgagcttcagatgtcttgcttcatccaagatgatgttttgctgctactgttcgtttctgggggcatttatttggtttattgccctcacataaaacaaagtcactctctcgccttccttcaacgaataaaaaggatggtggcagtcacctgtgatcaaatagaagaaaagcctagagaaacaaaagggagaaaacacaaggctttgtggccagtgattggcacctctaatgggtagcctgggagggacgggcagcaggaaatctgggctgtttgttcctctccataagggcaatgaggagggtgtattgagtagtgtgtttttcctatctttttgttcagtgtcagttaacaatggccatttcctagctatttgatgtgcaagtaaacgttgtgcagtgcacattaaaagcaataatgttctggtagagcgttgctaaggaaccgtcaggggaagctaattttaaatgtctgcaccagccatcttttcactgctgagcgccactgaagtgatgattttaacagataaaaatcttatctgtcttccacccacctccacatcccccaccgccacccgcatccccattctgactatcttaggtatctccttcttctagatgtcataattcataatgagaagatcatacacaggcttgacagaatcaggtgctttcacgtgtctcctcattactttgtcctgcttgcttttactagcacctactacgtaccagtggaggtagtagggatggaaagaagaaatgacaaattccttgccttcaaggtacttatggtcaattgcagatacagaactccaaagaaattcaaatcacagtacaatcattgattactgtatgatcctggccccttgaactggcagcttgcttacctgctctggaaagttgctggctgccctgttggcaccctgggcatttcttccacatctaaacaagaggttagtagagaagaagctacagcaaggctcatgactctgcttcttcataggcagccttgacttcctagactcctttttgtacctgagtttctggtccaccctaattagctgtaaggtgaaatcctttgcaccatctccctgtgtcccgcttttagagtccttaaagctagataccacatgggtgtagaagcttcctggaagacaagaaatatacctcctctgatatggtatttagcagtcagtatctctgatgttgatttacttacttgtatggaaacttgggaaactcaattcaggccacctggatagtgtttactaaattagtgcttacggaagaatttcaggccttaagtgctgatttaagttctcaaatgtgggagaaggaagccttgtccgataccaattccattaacttaagttccggcttactcagtggtacccttgtggcctgagaaaataaattcacattcttaaaaaacaaaacaattaaatacacaaaaaacacaagagagtagctaaggtattggaaaatctggcctatcattctgtaataccatgatcttggcatttcctcacgttttgctactttcagctaactcaggctttcttacaggcctttttctccccaaattcaagtggataaaaagtttcattattgtaaaaattaggctaattattgatgcactcaaaaaagtggtttttggatgctttctttccaactaaaagcacttttgttttttaattttgaaaaatggcatatgtgtgtgtacacacacatataccgtcaagtttggcaggaacatcttaccagttggtagatgtgttcagctgatattaagcagaaattcttgagaatcttaacatcttgggattacaaagtctttcaaatggaagagccttgaaaggtcattttaacacttttgacatccaggacagtgatttctgactctgttttgatggttatccatatcagaggaacattttacatcacaaactggggtaaagatataaaataaattgtacatgtgtttatgtacacacatgtatatatacacccaccatatgtacacacacacatttacagtgtcatatgcatacaaagatcagaaacaaaagtttcatcaagtgatgccttccatactacatacagtgcatgctgtttttctattttatttatttaaaaacaaaatgctggttgcaacccactaaatggattttctgaaccagtggtttaaaaatactaatctatgtgatctcagtttttcttgcctggttgaattatctttcaaaaaaatttaaattttgagatttttgccgtggaagtttctgccaagacgttgctaatgtctcagagacctttatagttttattctaacactaccatccatgttctcattgttgtgttacaaaaaacaaagttcatggttgctacagctgttttggacagctgtttgagtaactcaaaacagatgtgagagccagaggtctgacatttagtggaaatgtgctattaaataccaccgcgtggtttacttaaccctgctagataattgcccacagaggaaaagccgtttttaaaaaacttatgctcttcataaacataaagtatatagataggtaagctattatgtacctcaaatttacaacttttctgttgccccttgccacagagttggtcctgaaggtgtcagctaacctttctttatcttttattttcacaaagagtacctggaagccaagaaaagtcaagtgccttatttatggccattcagcaggttaagttaggcttctaatcttatcttaatggctttgctaaactgttatcaaaattaataaatgagtggcatgcttctccatttagtgataaaccgatggccaacactatcctgcataataggcaatataagcaggagcatattcaagatatgaatgtgtaaacattcagctttgtgattatatctttctggttggtctctagatatacttagttgttcacaaacacttgggagatttgagtggctcagtgtatatttgaacactgaatattagccaatttctatctaatctgtctatctctaatctcttcctttgtaagtatatgtgtagaaattgaattatagtgtaataagtcattatctactttactataaggtactctctaaagctctgccattctataggaaaactacatgggtacaataaacaaacgtaatttaaaaaataaccccattaagtgatttgtccataagtctctgatcatttagcagactaacaaagatatttttatatgtatgtgcattgatgaaagaaacgctctcctagtcagtagtatggtattaggctctctaaaatgtggtaccactttatatagatgaatgaataataggagccaagataagctcttaatgcagtaaaacaatccagaaagcagttagcagtgctactatttctgctacctgtacaatctcttgcctactgacctgtgccacattatctccaccagcccatgccatcctctttttttcataccatcccctctcaaataagcccgcgtacattctatcaaatacccctaaattaccaacccaacagctttgtaaaacctaccgtcttttaaaattaaaatcttattctgtggttcttttatggaagagcaacataaagaacaaaggcagatagaaatatggtgtgccctttttcaggcaccattctgtttcctgtatgctcccacaaaggatttgagcggttatccctttaatccaggactagcaaactacatacagcccaaatgccaaatctggcccaatacctgtttttataaagctttattggaacacagccatacccattcatttacatgttgcctatagttgctttctcattaccagggcagagtagttgcagcagtgctgaatagctggtccagagaccgtgggcttgcaaagcctgaaatatttactatctggccctttatggggaaaatttgccaatccctgctttacgctattatttcgttgtccattctgactcattacatgtatagagtcacaggcttctgtgctgatcaactttcagctgaacaagattattgagctgaaattgaattgatttatagatttatattcatattcaccaaagagcctgcaagtgtggccatttgaatttttttgacttataaaataacagaaatcctaaaaagggacttattcttccttaagtattttaaatagtcagtgaattaatataaaagaggctaaaagcacccagaaacagtactgtcctgcaattccaactctaaaataatgaattacaatcaataatgtcaattttatagtgcccgaggaaattagacttctcgggacctgaccaagccctttatttagactcaggactgccccagcacacttcccttttgtcttgattcatttcctgacaacacatcacattgccagatggacactgtaactgaaggtctacagaaactcatttccaaaaaaaaataaatgtttagaaaatgaaacatatctgaaactttatttatcggtcaagaacttttaaaaatgttgtaatcaagtagcctctgttttgtcagcgtagaactagtccttttacagtagaaaatatcatttgtttttaactttttctaaagtgaaaaaaaggaccttccttttgtaatgtgttaatgagtacgtggggacccaagtgatgagggaggattttagaagagattagagttagcttggctctgggaggtccattttcataaaatatggtttctgaagaaggatctggaacataacacaagtcatttgctgctacatattaagaaataatcaattgataactgagttctgaatatggcttagtgtagaattactaaagatatgtatcattaagcattcaaagaatcatcgttacattctgaagtacataaccataattacattctaaatcacatggctttctaacaacactgtccttcctaaagatctcaagttttcaaaactagaccaaagttacatgccgaaacaagttacccacctttggcatccaaactaaagtgtgccagtgaagggcaagttacttataacacagaaggactcctcttggtcatgacccaactactactttaccaattcacttcagccagtatttatcaaataccaaaagtgtgtatatacggtacagggcattgggcatagagaggtggatgagcaacatgtggaccccgtcctcaagaggcttatagtcttacaggggaagggaattaattctgccaccagacagtattatgaaacataaagatacttttttaaaaaaaccttgctaaaggaatcaaaaagaaggggtgagtgattcatactgggatttcagccatcaaggaaagaatgatgttctcctccccaaatgatgggaacatcatttggtatggatctcccactagtgacacccacagctgaggagctagtacccatttttctccctcttttccctggcttgaggagcatcttaaatacctggcccttacgtggtcaagctgaaaatctgatactcctaagaaatcgctgagtcatgtaggaaattcagaaggaagagaggaagggagagaaggagaaagggagggaagaaagagaaggagagagggaagaaaaacttagaaactatccttaaatgtatactagaagttttgaaccctaaccttgagtgagttttgaaaggtttctattggtgtcgtagctccatacctcttcattccagactagtagttctcaaattgtttcagggagtttttagtcttcttggagccactgagaatgatgggtggaggggaaagggagatgctgtacaggatctctcacagctctgctttgaactgctcaaaatattggaattccatataagattgttttaggagatgtcccattgctatagttaaaacagtttgaaaaccaagattttaaaggaaattgcatgcccaagacaggctattgacatgtatggacagaagtccctacttttctgtccaattatgacttatcatagaacactttctcatcagagtctacttttgaaatacaaataaatgcatacagatgtaggaatctatgaatcaaggccagtgggtctttagccattgcctcgtaaggctcctgatatttgctgaattggggaggaagtggaaagctcattcctggatctggctctgtggcttgcccattactgggacttacctcttcccctcatctgttctttctgttttctcaaatgcctccaatttcatcatggaaatgctcagcttctatcagatagaacaaattctcccaagaggatggagtccagcctctatgtcgggttctaccttgcatttgatgtgcagactttgggcacacagagtcaactactgtttatgtttcaatgtgctgattgtcaagagtgaagagattctgagactttttttaacattaagtttgagttgtccttgaaaacaatgcccaatttgtcagatttctattctgtgccagttttcatccagtttaatgcgtgaactctatggattttacaaatgacgtcttctggatcatgttatctgtttacactgatcttaagtgtatgtaaaggttatttgactagatgtgtcttttgggttttttgtttctgtttttttttttttttttttttccagcagagaataaatggtcatctcaacatttgtttggtaaaagaagcaaattggtatgaaattgtatatttatgcatgttttttttccctttctgatatctctgcctcttcctctctctattattaaaggaagaaatacccctggaaagccaatgagagaggttagtgagattcaggctcacggccatggcttctgtctgtctcatcctgctttttatgtttggcgtttgtgtaagaattgtgtgtgtgcacgcgcatgtgtgtattacacattgtgtcatcatgtaaggatggtagtcacctctccacttgcagctcatgaggaacattcctcaaatgttcattgccgttgtcatcaccatgacgacaagactggggttgggagcaagaatctctttaaaatggcaatcctttgtagtccctaggttggaatcctgccgttcatcatctgttgccatttgcaacactaacaaaatcttcaaaataaatttagccttgaacataactgatgagtcataaagctttcttccacttccaggaccttagcattttctgccagcgcccttagtttttattcttctgggatgacttcattttgcttttgtttccttttttcttggttcctacgctctttctctcccattttagcgaacattttttgagcacttactgtgtgccaagcattgttctcagcacttgccatctttttcatcatgtcatcttcatgacaaacctgtgaggtaggtactcttattaaccccgttttacagataaggagactgagtcaatgagagagtaagcagtgtgtcccaggtgacagagccaaggatttggatccaggcagtctggctccagacccacactcttaactctcatttgaaaggcttacatcatctcaacgtacccttcagaagatgatcttttttatttggtatttgaagccacacagaacaataaccaattcgattaaaaaattaaatattggagttttgagaggtttttaaaatgcctatttatgggttgaaagggatagggtgcagtcttatcactgaatgtggtttcaggttttacggtgaaagatgcttcttactcctattccaccaggaatattgtctgaatatcgaattacctaattaagtgactgttggatgacaaagtgttaactgacagcccaagtaaaatcaaggttgtctttaccaagaatttaatctgaaggaggagagaaggaaagctctcccatgggatgacagtgttctgggagacaggctggatgggtggagagtccttcttaaatgagaagattctggattccttagcaacaggatggactggagagaccactgattcatttaaacacaggagtcgtaatgaaaactctgccaacatcatgccatacaagtctaatcaatttaatgattcttcagtgtgtctgtgccagtgcctccttccaaggctttgggcagtggggccagggagggaatggtaggctgggaggagaaattgaggaaacctgacttggtgaagcattgaatgcccctgacggtttgcctggttcatgtacttcgtatgtgagacttcttgggttcattcttatggtaagtgccccttaaaatttattcattttaactttttgtagaaaaatgcaccataattttgaccaccttaaacatgtttcactcacaaatgaatttcagaaaaggctagcacatgtaattgaagttatataggcatttgcagacttgactacctgaggtgtatggtgttcagacaagtttccagaagccaaagaatcaaaacaataatgaccttttttaatgctatgaaaatatcccaaatgtacgtaaagcagatttttttcagagattaaattatagagaagaaaagataagcaaatttccctgtagtattccggctttcctttggacaactgaatgctaacaatttatttgggaattgtatttttaaaaaatagagcaccagattgctattgaggtcttggatctttgccagaaagtctcaattccaatcgctgtggaaaacaattccctcaggcagtggtgacgtgtgagactaaatgtgttgcagttagcgccaacttgaaaaacatacaactgccctaatgttcaaggcatagtgcctttgtgttcaataatccttaagaatggattaaatcaatactttctatagacatagttttctgtcaccttgtgcctgaaggtgattgcaaatgcctgaatcctggctgcttttcagtacctctcatacttcatagtatgagattgtaattttgactttagaaaaatctgtcaggtaacattaatgacctcccgaatgctctgccttacacacatggataatagaactaggatacaaatctactttctatagtcatgtcacagtgcagtcttacccctccaacggattaaagtatgattctttagggcagtagtttgtaaaaagagattgacttcttttttctggatctaatgaaaaactccatggaaagaaattagaattatttattctggtaaagcaggtatttagtgaagtaaccaaaggcataatatagatgatgaggtgactctaaaagttctttatttttatagcacaaagatggccacaaggtcatttgtgaaaatgcagcagtgtaaaccggttaaaggccacccaactttttgtcggagtgtgcatggcacattaagaataatgaacctgttttccctggcaaatctttaaatagcagatacccctagaacttatgcttcttgagagactcaagaattttccttccagttagtaactgaacaccatttcaaggaagagaagcaccacttggctatataatccataaatgcatttatttgttttattatattttgaactgccatctacatcccctagcacacagcctaaaaagaaagacactttgtgattatcgataagctgacaggaaaaaaaatgagttttctccccttttcgttgatgttttgtaatatgttttctagctactaggtggactacatactatagtcacatgtgggccatgagaaatacttcgaattacattcaggcaccatgttgtaaaggtcctggactttgtttttactgattttgttaaccgtaaagatcgctagtaattaaaaattggcagttagtccatctatcttcaatttatgcatgaataattatgcagatttcccagggttgctggacagccaaaaatagatacaggggaagccctccaacttgatagcagcagttatatatttgtactctgagctctaaggagcagcaaaggccccactgtgtcgtcttcctgtggtttttatggcacagaaagccaaaaatgatttcagttcttcactgagggctgccaaactattggcccactttatgaatagttgcatatgctttgttaaaaaatttttatacttgcagtctcagccaaaatccaaagtgattttctaaaatataattaatactccatgaaattctttgcactaataaagcacaaaaagatagatatacaaacttggtcaccttaatagaaatgcctgaatgacattaaacttttaataagtaagtcttcagttgatctggtgccatcactgtttaagtgcctgcccgtgaatccgcttcattttgtagagaagctatatctcttgaaataaatattaaaacaaaatactctccctagtctatagctttaatttttattgggatatctttaatttttattggtatttttaacaattattatgggaatctgtaaagttgatacatggcaaggtagtaatagcctagtaaagcatttcagttccaaagacaatacttgaatagtggaaggatttaccaatgtgcaataattaaaattagccatgtaaaactatgggacatagacgaaaaggcaagccataaagtaagtctcagattatcttactctaaatctgaattttgctacgaagtacccagggacattgtgctgttctttttctccgtgctgggagattcgtgctaggtcgtgctgcattattagtaaaaggctattgtgatagttaaccctcatttaggaggagctctaagatggattcacaaaatacccaaatgcatacaatacatgtgggtcaccttataattagggtctagagtaatttggaatgtaaagcaatttttattctgaggtttcctaattcaaatgttaatagtgcaccaaaaggtcaattcaagagtttattattattatttttcaacccaagtaaaagcagagagaaaatagccacctccaccatagcctcagaagcaagccaacagcctgaaacagctttgaaatgaaaagttggtgtggcggtgatggtggcagtgataatggtgacgatggttgggtgctggtgatggtagtggtagttgtgaaggtggtgatggtggtttgattgatagtaaaaaaaatgttcgttaatacaagtagagagtaagtaatcaatcaatcactcatagccaaggtggaaaagatgtatcccatcatggaatattcctgttctgatagaaatcttgtgcttatctatggaattcttttgatatatatttacattgggaacctgaatgtagcttgacatttttccatgttaacaccagtagcctgatccaacattaagctgatactaacaaacaacgtgtaatggcttcattaataaggctttgcttcttcctggaaactggtgaaaaatcaaaccttgttgtgtacaccctcgatgcagcttctgtgttgtcttcacccagaaatggggaatgatttcccaaatggcaaagaaacagagtgatgctatctatctgcaccttttgtaaagtctgtctttctttctctttgttttccaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtattgactggactgcagtactttgtttttattttaatttagttgttgttacttacttactttttaaataggtaatacatgcatatgagtaaaaaactataatccagaaagacagtgaaaacactcctaactaccccttcccccatatcaatcaatcatcctcattgctctatgagtagacattattaatttcttatttagtcttccagagggtctttctttattaattattatataagcagttaaaataatatatatgttcctatttatttttttcctattattatttcataggatatagcattctctgcacccagttatgcaccttacttgtttgtttgtttaaatttaaatatggactcaagaaatcttttcatttaaatatataaaatgctttctcattcttttttatagctgtataatatttcattatatgttcataggatattttatttaagcagttccctttggtgggatatgtagtctgttgtcagtctttcttttgctataacaaacaatattgcacatttctcattacatcatttcatttgtgcataaacaaacaaatctgtgggatacttcctagaagtgagattgctggatcaaagggggtaagcatttgtagactgggagatgatacattttgtgcagtgattgattgattgatagtcatagtgtttgtttgtttgttgtgttttttgttttaataatgacaagtatattaattaagtcagtttgcagttcatactttgcttctcaagagaatttcatatcacttctattcttaatgtcaccatctaagaggatgcatgagtgagtagtaagaaagagacacctaaaatgatgtctcacaactggttctggggaagaagaatcccttaccatagtcaaccaccaccatggggagaacctctcctttgcccctgccctgctctgtttcttgccctagctgcaaaggaagctgagaaagtgggtagcaatgtcagcacttcttagggagaggctatctatctttacctattcccaaggttcatggatggggtgggcggggttccccaacagtgttcagatactggtgagccaaaggaataacataagtccaccaggtgcagcctatcctagtgattttggaaataataggagatgagatgatccatctcattagaaatgatgtttgttagtagatgtggcatctctgctgtgaatcaatcacttgctaattttttgaaagtagggtgatgatgctgacctaagtgactaccacattgaaacacttcccttgacatccacacataccaagaaaaattttcatcctatttaaataaacaaatcatttatccttcccaccattacccgaacctacctttgtttgaaacacccagactggctgttttggtgacacttaaggaggtaactgaggaatcttcaatacttcaccacgtctaagacaactgtgtgtggatgactctgaggagggcatttggttttccattccatacttggcacacactagaagagacagaattaattcagttaaaaattaaaatgaatcgagctggcacagattatgcaccggcaagcaaaatgtgtgtttgtttgggagaaagcaccaagactaatggatgtgttctgtagagctgcgatgggatttccctgaatttgtaatgctctaatggtggaatgaatacaaaggcaggcactggcgcacttgcaaagactttgccttcaaattaagtgtaggaaggacacaaatcaaattctttcccacagtagcaaagccattggagtaggaactataaatatgttcttcaatgccccttgcacgtcagtgtactgtgatctcatggacttagctgacaacacaagagtggcagcatgcccaacattccataataaacaatattgtgtgaatgtgtaaagtttggggatgtttgtttgagagtagcttttgtgtacagaaaaggttacctacagtaacttgaggtttaaatgtt

SEQ ID NO: 14569 - DNA, 151295 bp, Human; identical to SEQ ID NO: 14568
  misc_feature (1)...(151295): n = A,T,C or G

SEQ ID NO: 14570 - DNA, 151295 bp, Human; identical to SEQ ID NO: 14568
  misc_feature (1)...(151295): n = A,T,C or G

SEQ ID NO: 14571 - DNA, 151295 bp, Human; identical to SEQ ID NO: 14568
  misc_feature (1)...(151295): n = A,T,C or G

SEQ ID NO: 14572 - DNA, 151295 bp, Human; identical to SEQ ID NO: 14568
  misc_feature (1)...(151295): n = A,T,C or G

SEQ ID NO: 14573 - DNA, 393753 bp, Human
  misc_feature (1)...(393753): n = A,T,C or G
tcttctagaatcaagagaattggatccatttcccagttctaacacttatcagctatatggcttttaggcaagtcagttaaacatccgagtctcagtgctctcatctgcaaaacagaaaatgtgatgtacttcacagagccagggggaggaataactaaggtggtacatttgtacgtgctttgtaacctgtaaagccctttactgtacacgtgtcatttacagctctgtatcaccatcatgacctagaaaagcagtactgacagaagacttatcttcttgccaatgctaagataactttagccatttctgcatttctaaaggaaggagtctttatcccagtatctatgaagacttggcaggaattgccgtcaatatttagttggtaatataaacgaattaaacaaaaatgcacactaggttttaggaaaattaaagacagaactatcatttgtactcctcttacatttcccaaagtgctaaaactagacaataaatcagtcctcaataaatgcttgtttatcaattttatattcatttatttgttgataatacaacaaagatgtttatatgcagtataatatatatggcaaagatgaaaagtagcaaattcatgaatcaacatcctatttatgcttgagaagacaaagaaagtgttggtgacttcatggtatacataaccttaaggagctcgtgattgagcctgggtctctgctatcaatgtaggatataaatttcaaatgtactatcctttatatgtatgttaatgtagtaaacatagaaaactgatgctactagtgagaatacttttacttgaacaactaaaagtttgtctttaatcccctaagtgcatacacaaaaggaaagtactgtacaaatcaagtacaacagaagaagtaaagtaaaagacaagtgaaggaattatctggaacttagatctggttggctttttctcctgaagtacttagataaattaactcacttttctcttttgctgaagaagtgcaaattaggcaggcatgttattccacgtaggcaaaaggaaaaaagaaagaaaaacataaaatggctatatatttgaccaaacttcgttctgcaagaatcccaatactaaccttctaccatataaactactttcaaaatcaggctatatccttccagtacaaacctggtttgtactactcagagatactactcagaaatactttcagtatttcccttctttcaacttctgatgtgattctatccatattcccctgcctgtctcccagtcaaagagaatgggacacaactctctttagagtccatcagtgatgctttagctgccaaaaatagtgacaatagacattcattgtctgtctaccttacttgttcaacattcagaattctgcatcttaagaggctgtggctgaaaacttgagccagttcttcagaatttctaacatgttatttctgccactttttctcccttactttagcagagtaatttaattcaatttgagagagagagagaaaaaaaaaacttttctagttacacagatcaatccaattgtttggagcttcagaatgaatttttaaacttgttgaacagaagcatacaaatctctaagagcaagtcagataatatacaaagcctccattcattgtgtaggcagaaaggaatgctggtacccggcagctctctgaggaatgttcccttggctttgactattctgctgggaacaaggaaggaaacacatatataaaatgaatttataatgtctctggcttgtaatggcagaatgataagaaaagttggctgtttaatataaactgtcagttgcatattccaggcctcctctctttgaggttcctcccacatccacacgcctggctactgtttagtgcggagtacaaagtggccgtttattattattgactggtgaggcctgtgctccaaaattcattctgtcaacagaatgtaagcaaagttggcattttaaagcagggctctttcagtttctgggttttctcaggattgctatgcaacaggatcagtgctgtagtgcccggttcaagctgaaaatgttacacaggaagacataccatgtaaaggtcagattcttctactataataattttcttgatctgtgtgtatacaagtgaagttgaatgcataacctcttatcataactcttaccaaggtcctatgtactttccacctgtcaagcctaaaaatgtgtattaaatgggaaatcaaaactaataaatgtatgatgctgtactatatgtatgatgctataataccaaggtgaacttaatttgtgttgtcaagaagattttctctcccatgacagactcccaggaatgtgctggtgctgtgggccaagtgcaatcttgtttattagtctctccacgcttttatggtcagagttaactctacagattactacgtaaatagaaaatatgacttgatccatatagtaatgaaattattggcactggggtacactttatcatagaattttattgcctatcacttccataaaataatacattttgtccatagactagaagatataacttgtgaactttataaagttataaatacattactttccaactcataatggcaaggaataaatctattacaactaataagatgcccattttaaatctacataataacaggagaaggcaatacgccaagaaaagggatttgagatgtatcttcttgttagtttagcctgattgaaatgtcttttgaactaataattatttatattttgcaattctccaaattcacattcatcgcttgtttcttttgtttggtaattctgcacatattcttcttcctgctgtcctgtaggacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtaggaaaagatgtggagcaaaaaggccacaaatgaattaaaatggccaaattttcctcattgtcttagcacaagtaactggtatctcacatgtctacgtaaatcatccaatttcagaatgattcactgtattttgaataaatgaatcatttatttgcttggtatggagatgatacttgaggattcagattagattaaagtggtaatgttttataaacataggagacatgcatattaagacatcagagtgaatttaaatgaggagtgcagctattctagtttcataaatttctctcttggcatatcacagggttatacaaaaagtgataaaaaattaacggatatgtattatggaattatttttggcattagtctaaatgcataccagaggacagtctttaaaaccctttataacacattacaattatataatataaaacctgtaacacattataattaacagtttagaggagatagctcctacagttaaagagagactatagcaacttcctgtcttttgcttcctctcagattttgttaaaacacatcctctgtaaactaagcttttagttgtagtatactcacatactttatattttgcccccttctatgtgccagctttctttggagaagttagttaatggatgcatcatagcatctttgtaaaaagggcagagggaagttcttgttataccagttttgcaatagttccgtggaggaacaaaaggatagagatagtaagtaaaacgcccattgtaacttaaatgatctagcaagggcggggaatgaaagccaggcttcctgctttctaagcagttgcctttcttaattcatttctctttattaaaaatattttgtgctttcttctgtgtctagagaaaaagtgataatgaagggaggtagaagatgaccaaatggacttaataatagttatgggagtatacactaaatgacgggagtagttactacctctaggtagaaagattacagaagggagattttttttcttctttatagttcttctaacttgtccaaaattttaacatatatacttctataaggaggaaaatctgcatttttagtaattcagaagcactattgtaaatgtctgcatcaagtatgaaataatgatagcaactaatatttacatgatgtacctacataccacgcaatgccataagcactttccattcattgaccggtttaatgctctcagcaaccctaagaggtagattttattattgaattctttttacatttgaagaaagtgaggcacagagaggctaaataatttccttagggtcacttagcaagtggaagatacaagatgaaaacagggagtctgggtgggccaggcgtagtggctcacgcctgtaatcccagcactttgggaggccgaggcaggtggatcacgaggtcaagagatcgagaccatcctggccaacatggtgaaatcccgtctctaccaaaaatacaaaaattagctgggcatggtggcacgcgcctgtagtcccagctactcaggaggctgaggcaggagaatcgcttgaacccgggaggtggaggttgcagtgagccgagatcgcaccacttcactccagcctaggggacagagtgagactctgtctcaaaagaaaaaagaaaaaagtaaaagaaaaagaaatcagggagtctgacttcagagtctgaacttttaaccaccatatgataccgtagcatataaagaaagaaggaaacttctacaaagaaatgcatactaattgaaaggatgaaatagagagtagattttttctaggagtagaaaaggatttgtttttatgagaagtagattgctaggagtagaacaggtttatttttatgtataaggttttgttttgttttgtttttcacaagtttgcaccctggcttcccagacattgttccttatctccctattttgtatatgaattttgtgtcaacttggtggtggtacactgggagcaacaatggcaatagcattttcaaagatagggaggctctattagctttctacagcttaaactcttaagagaggtcagtatgtgtgatgacgtaggccactttgataaccttcgtcattaaaaaagaatgaaaatgtgagatggaaaaaatattggcaggtcaagttaagttattcttttctgcacaaaagaaaaagaaagatgctataattgttccgagtatcacttagtgccttttctctgcctcatgtgaacttgataaaataaaaggagaattgaaagtggcaaatagcatgtcagccaaaatatggactcttcattctcagcagtttcccatgtcagctaccgcagtttgattcttgctgtcattaatcaggtagaaaacagttagcttatctaaggtgctgccaattctagaatttaaatattcagatcaatggttttggcttttatataggcctatgtaataatacaggatatgttataagcactcataaaaagcaaagaagtaattctccacatcaaagcaatttagcttatttcctgacacttgattgaaattagggtattgatcaatctacagcaaatggcagggttcaattgagagaagtacagtataggcagtaattagggatgattatgaaatagaatagaataacactggaagagttagatatagaaccattagtggcactgataaacctgcattatgaatcttgtcacttcttccatgggggttattttaaaatgaaaagttgccacaattaaaaaatagtttcaatgatatactggaaaaataggcctgtgtttgcccaagttataacatattataaaaaattacagttggcccattgtttggtgagcgattctgaaactgctcttatatttcaaaaaaataaaaccattaatgtgtccatttttaaagaaacaaaattgaatttaaatccaaatgatttcgaagtttccctttgtattccattggctcataagagatatccttgtgcttccaaatacaagtccatattgtatcgttttccttccatttatttttcttctgccatacatcttttctcttcctgtgattaagattcttatttaagtcatcatgttatgccatattgatacatttgcaagaatactctaccttggacgctgtttatatcatattactcttttgttcaaagcttcaatcttgtaggtctccatatctccctcattcatttatttgttcattcaacaaatatttaatgaatgcctactatgtactaggcactcttctgggcacggaggatgcaaccatgaataaaacataccaaaaaaaatcactgctctaatgaagttatatttaatcattagaatctagtagaaccttctctctctgccaactgtgcctaataagtccttgctaactccttcccttctcttttctttttctgcctccagttcctttctcaccaagcatcattctgttactccccaacatagattctctgagccaagagaatcaataaattctattttctaaccccattcctactctccaacaatttcctcactctcccatatgagtatgtacccttgctggttctcacacttgcaacattctctttcctcttattctccaaattttgattcatattccataacaaatcttttcttttctggctgtttcctcactaggtcttcccaatactattctaatttacacttgataacatgtttcttcaagtgttcaagagttgctttatagggctatgcttactgcctccagctaacttatatgaatacaaaaatttcaaactcgaaatatgtgagtatggtagagtagaaagacatgggccagcagctgggcaacccagtttcccttctgttctattctgtcactaactgtcttagcatataatcttgatcaagtcacttaactgcttcagacttcaattttctccttcactgaaatgaagagtttgaccagaaatatggacagtctcttccagttctcttgcaatcgtacaattttattcttttagttctgcaatcacactttatgaacctggaaaattgtttaatttttctaccttggttttcttaattaaaatagaactgattgatttaaaaggcattatataaagtaattaagatgtctttgagagaaaagaaatttaattgaaattgtataatcctatctcataatttaattcaagaaaagtatatgctatcattccacatgcattattacatcacatgttggccaagaggtataaggaagaaaagtaagtagtcagtgataatttaagttccatcaaacaaaacgaaaacattaactgctttaagtgggagaaaaagagaaaattatttacttaaatgtacacacacatgcatacacacacagttactgatgacgttatccaatattaagatggtaattagtcaaagaaagtgtttttcattctaaaattccatatccacaatccttgcatttttaattttagaatattaataacttgagaagtggtcaagtcaattgttttacataagaaatatatatgaagatttcaatttagtctactactagattatttttccagatcattgtatatactattaactatgaaaatcacataatatgttatcaacataatttcagcagaatttacattatgtgagatttttatatttggcagaaaaatttgtaaatgttatataaaatgttcacatttatacaattgtgaacattaagaggcaaggacactgacattatatagtctgtagaagccataaatctattggggagtgcttgctattagaggttagaatagttagtgtctttgtataatggagaacaaaagaagggcaaaaagaggtggggtctacctttgagagaaaactgcaacttggacattgaatatctctgaccttctttctctctcttttagaatgttaattatgtttggatgttggagttcaagacctgtctagaaaaaaaaaatgttgacttctctttgggattctctctatttaaagagatagctcccattttaattctgtggttctttaattttttttgtttctgaagtacaaattcaaattattcatctgttgatgacaccctggagatttttctcagtgttctcttgtagtagtttcatggtttgaggtcttacatttaagtctttaatctactttgatttgatttttgtatatggtgagagataggggtctagattcattctgcatatggatatccagtttttccgcaccatttgttgaagagactgtcttttccccactgtatgttcttggcacctttgtcaaaaatgagttaactgtaggtgtgtggattcgtttttgggttctctagtcttttccatgggtctttgtgtctgtttttatggcagtattgtggttctttattatttctgcattcctcccttttctttctgcatgtttaagtgctattttattacatgagggtactaaagatttatagggatatatcattagttttataaaggaagtcaaagtgaaaaatgaattcaatataacacatttcactttaagaatgcatgcctttcagagtaaagttttattaaggatttcaaactaggcattaaccaaatcacagttgaaatatctgtgtctagagaaataacaatcactttatcagcccctataattcttagtgtcctgacactgaggagttccttaaagaccaagcaatatactccagcacatctaaaggctctgcgttttacctaaaccttacaaattgtggaaattatcagctttttagagattagcacttgccttgttaaacggtagtaacccctaagctcttgtcttcactaataaagattaatagacatagatagaagctaagcatgcccctttgaaccacctcttttattttccgttgagtgggtaggagtaagcagaatatatttgacaattagcaatgttaaaagacaaactttagacaaattccgttttgcagagtttatttgagcaaaaaacaattcatgaatcagacagtactcagaattagaagttcagaaagctccacccagcaaggtgggcaggcagtatttatagatagaaaaaggaagtgacatacagaaacagcttgactggttacagcttagaatttgccttacttgggcatagtgtaaataggcatttgccttatatggacatgagctgatcagtttacagcctgtgattagctgaaacttgactgctgggattggctgaggctcagctatttgttacaagaatgtactcttaagttgcatattgcttacatgccaagctgggttgcagtttgctatgtacagagtcagctttaggcccaatttaatttaatttaacagcaacaagcctttttgttcagagatcaaaaacatttggttaaaaccactaaggtttaaggattttctcatctaacaaaggtttgtaatttctatttcccatatctaaataggacagctcaagttatgtttttcagcagctgttttatacctttgcaatcttgatttctacatatgcaaaacaagaaggttgaactataatctctcaggttccttccaaccccaacagcctatgtatgatataaccagaaaaaaaagtcattacaaatacaaagaaacattttcaggaggagatattccacatgcaaacataggttaatcatttcaaaatatctggtatatacactcatgaaaataaaaatagggcaactgcttccgataaatgtattagaaatgtgacttgaaaacatttcacgggcttaacatggtcaaagaaaatgttttgagctcacaatgttccttacatttagatcttcaaaatcaagtcactgacaaatgccacctttgccctgtggagaccaagaagtaatgtttggggcatatcagaaatgctttaataaatgctttatcaaagaatggttctggagcttacctgtggaattgtgaaggttcttgttgaaagcagagattgttgatagaattatagaaagtctggaggtggcacctagcaatctcaattttaaacaagctactcaaatgtttcttatacacactatagtttgagacccagagctttaggttgaatacatttgtatatgctgttttaattcattctctggctgcctttcacctcttcagttcttactcagtgttctctgtcctttgtaagtttttcgcttcagtttttgtcctcctatcacatttttcctttcactcttgagctttaggagaggaaaaaaatgaagcaatttgatatgtagttaggatgatcaaacattctgaaattttatctaactccacagcttagaaaaaaattaaaggaagtccccttacccagatatgtgagagcttttcgtcttttgaggttccaggtccgtcttctgctgctgtattagctctcttgactgtcctctgtccctggcttctaacaacttccctatttcatgctattaagtttctcttagatcctttagaactgaattcccggctgggtgtggtagcttacgcctctactcccaacactttgggaggctgaggcaggtggatcacctgaggtcaagagttcaagaccagcctggccagcatggcgaaaccccatctctactaaaaataccaaaaattagctgggtgtggtggtgggcgcctgtaatcccagccacttgggaggctgatgcaggagaattgcttgaacccgggaggtggaggtgcagtgagccaagatcgtgccattgcactccagcctgggtgatagatcaagactctgtctcaccaaaaaaaaaaaaaaaaaagaactgaattccctaggtctcagttattttgctctctcttaggggacctaaaggggttcattgacccactaataatgagtcagcaccatttaacctagaactggaattttagcacttccttacataaacaaagccgcagcttgaggtcttaacataggcagcctgcccttcactatatcctcctctagacctctctgccacaaggatattttgtttcctctaccaggcagacagaggccaaacattagtcatcgttatattctctcttcccttcctctctccctactccccaatgtatcctagagacttaggggcagtcaataaatatttatttaatcagtgtcttttctaccatttgctgcttttccatgtctgagccctacctctctccacctacttttcaatatgtcctgcttgacagcctcttttcactctcaaagggaccaagctgtgaattccagacaccccaaggaattcgtttaaccattacacattacatgctattaaacagctaaaatcttgcatggggaattgtcgcttaggcttatcatggaaaagtggtaactgaaaggatggtacagaaacataaaagaactgacctctaattgtatgcaatctgcatgcactattatattcaattcatgacatttatggtatttcacgattcagttcttgggaaataatacccttagagtctggaacaatttaatttatcttatttgatggaaatgccttcatttttcctggacatattgtttatactgcaattatagaaagaaaatcttgacaatttggaaaagtagaaagattaagaaataaatcacctgtaaatctacctctgagggataacctggttgtcattacaaaattttttcctagtcaagcatgtgcatacaaatacatacacatacacaaatgttttagaaaaattcaaaaaatgtatttgttttgtaacctgttttctcatttagtaactgggatgatgaccttttccatatccataaatatttggctatgtcatcatattgaaccttgcaaaggattttactgtatgaatgcaccattatatatgtaataattcccttttaaattaagagctatttaattaaattcatatataaatttcattaatttctaaatttaaagcatatacaagtttcattacatttgaaaacaatcagtaggttggggttttgcatttctcaagcaattccctcatattgaatatttaagttgtttctgttttgttttatcaatcataaatgatgctatatataacatttttccacctatatctttgtatctttttccaatttctttgttagtataatttccttgaatttaagcctgtgggtcattgtctttgcacattttaaagacttttatgtattgtcaaattatccttcagaaagtttggaacaatttaatttcagtagataagtattctttggtgattctgtttgactaaggccaaaaggagaattgtatttgtaatgtcaagctaagttaccaaatggctaagggaaatgttgctccacctggttgctttgctttacatttcaatctttgcagcgttaaagtctttattatatttatgttataggtagcgttattatgaattaattagtaattgctgataatagctgagtgattgagcataatttctaatttacctgaagataaagctttgctaacactgcgtttcctctttgttttctggatgatgatttattttattaatttagcttctcatcttcaagtgaaatgtggattttatagcacagatcattcatttgtgtattcttaaatggcttctaaggattaacgtgttctaaatacagttgacggtaaagcactcagtctcctgcctaaattattcatgttcgggggaagctttcagataaatgtctgattttactcttccatgtgagttgttgtcttagtactttttacacaaaggaaacaaagcagaaaatgttgaaacttggtgaagacaaatcccaggtgcacacaaataaagaagggtagggggaaaggagacgcatttgggaagaggagcagaaaggaacagacgccagatggaagaactcaatggaaaaggctgcctagggtgtagaaatggaaaagtcaaaatgtggggagagacctttccatttctcaaggcaaaaagaattccagtactagcatgagtcacatgaaaacgaagtgtttttcattagtcactgcatccaattttttctaccagaaatattaagaattgttgactacaacagtatggaaaagcaatagattccagtgtgtatttcatgccaaaagtctcagcattctgcatgtggaaataaacatatggctaaacactgccttttctcaaaattgccatcaaactatcctctgttttgtggctctcaaaagtaagtagccagatttttattcaagactgctttgtagttcacaataggtttattgtactttttcaatggaattgttagaatcatcaattacacttctagatattctgacatggtacgctgctgttctttttcaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggtaggacatttttaagcctcgtgccttgcacatgttaagcacatagtaatccagtgactattttaaaattaattttgtttgaaattaagttgaatagaaatcttttttactcttctcacccaagggtcaattataaataatctaagccattacactgtaaatgtcaaacacatttgtgttaataataccctttaagaaatcgtccatctcttttggctatataaaaaaaagcttttcatgatgaaaaatattgaacatatacaaaagtagacagaatgctataataaaactcgtactcatcaagacatcaacaattatcaaatcacgtcagatcttatttattctatagctcttcccagattgttttaaaacaaatatcaggcgtgtgttattttattgttaatatttcaaaaggttaaaagataggattcactcttttaaggtaatcaccttgctactataatgcttttgaaatatcaataatttcatcatatcaaatatccagtccatattcaaatttccatttttctcatacatattatgcattttttaaactttttctggttttggtttaaataaaaattgaaatcagacccacaccttactttggttagttggtctttttattactttttgtttggaagtaattacagattcacagtaagtttctaaaatagaatagtttccctgtatctttcaccctgtttcttttcatcattatatgtcatgcaactgtagtacaattcttattgtcatttcaacatgcaatcaatagaaaaaatgtacatttacagcacatctcaattcaggctcattacattccaagtactcagtagccagatgttgccagtagctaccgattgaacagtgcagttctatagtttgattgtatttgggtttggctttttttggcaagactgcttcacaggtgttcgtgtattcttccatcatcaggaggtggtatataatgccttgttttctctttttgtgtgatgtttaatagctgttcacgatcagtggctaggggttgcagtgtgataattgcctatctctaccattccttcttcatttattcactggggtaggtctatgaaaaaaatgttttgcacttgtctcctattttggtactcagtatacctttcataccgaacaagcaaaatacgtttcaattttaccaatttttataataacaacttgttcactagcatcctccaacgatgaccaattatttctttgtttgtttgttttatttttatttacatttctatcttctctactaagctctgagtgaaaaaggcagagattttgtcttgttcacctccaagaccctagagtctagtaaagtgtctggtgtagagtggatactgataagtgttttggaaatgagaataaaagatacaagaacagaaatgaatagcaaaccaaacaaattactaccaaataataaaaacttgataaaatggtaccacttttgtatgttgagcatgtaaaggaaagatctctgtggagatacagccaaaggtggcatcttgaggaaaggtcaagggtttatattattctggagaagaggatataggaaattataaaaagggaagagaacatgaaagaagacccagggatctttgcaaaaaaaaaaaaaaatgccagggaaactgccagtttctcctttagccatttgccttcatatatttctgaatattaaattagcttttgtggtagggtgaaatgtaatggtgctatgtgttttaaatgttctgactttgaataaacagccaaaacactctggtgtacatatagaaaagcactcattgagaaggatgggccttttttaaaaaatgcattatgcgatatagtgaaatgagacagaatttctacaaaagatgaattttatgctagttccagaaaccaaagaaaatgaatcactggacatgtgcactaggagtcaggagactgagattctagtcatatttcttcataagatggattctgattgctattttgttcttcaactgtaatatgaggaaattggtccaaataattgctgtggtttcttccagccagtattttgttataaatactgcttcactattcctggttattagttttggttgcttgttaagagtggtaaaatgtctgtacttaacgcagtccttactcaggaatctcatgacaaagaacatgacttggggagatggtgatgctagagttatgagtgatactcaccagaatgaagttaatccgtccccacttggttagtgtgcttgctcagatagctacctgttaacctttcgtgaatttcacaggacttccagcccattgattactctgtgttttatacattagttcctctgcccttccatatttacctccttccaaatacaacttagattcaatcatctaaattttaataacttgttttcaaaagtctgaaaccctttgcttctttatctttttgttgctgcaatctacaaaactccaaaactctagctaaatattccgagactctaactaaatattttctcataccagacaacaatgtagttgtctggtacagtaccttttccggatgaccagccttcagccttccactaccaagacatcactgggtcaatttttttttttttttttttttgagactgggtcttgctctgtcaccaggctggagttgcaatggcacaatcttggctcactgcaacctccgcctcctggttcaagcaattctcccgcctcagcctcccgagtagctgggactacaggcacgcgccaccatgcccacctaatgtttgtatttttagtagagacagggtttcaccgtgttggccagatggtctcgatctcttgacctcgtgatctgcctgtcttggcctcccaaagtgctgggattacaggcgtgagccaccgcacctggccaatttaccttcaaaattgtttttgactgtctactattgttatcatcataattataaaagaccatttctcctaacctttctgcatctactcttgccaccctacaatgcaatctctacatttcagtcagaataatctgtgtaaaaaacataaatccaattatatcagtccttatcttaacactatagtagtcttctcagtgctcttggaaaaagaccaaaatcctcaacaagggtgacaaggcactatctggcttgtctggcctcagcctcctctttcctagatgctcttcccttgctgtttggatgccagccatactgcctccatttactttttccaattctgcgtgtccctcttatgtggggctttaaatatgttggtcctctgtctcaaacccttttacctatacccacccactcataatatcctggttatcatctaataatcctttacatcttggctcggacattgtgcaaacttttccctgttgtctacatttgaccagatctttctttacacacttctaaaattgtctacttttctataacatagcgttgtttgtcatcacgtacatgtgttactatttgataaatatcgactactcttgctaaaccatgtccttcaagaagatttttgggagggggaaagctgtcatttttctactcagcacattccaaagtgcctagtatacagtagacactggttagataaaggaaggctattgagaccaagagcagggaaagaaagaatagagtggtattcccttcttatttacaggagttttctgtttatttctaattaagcatctttttgtaaagtgtgtagagctactttgatgcacaggtttttttttattattatactttacattctgggatacatgtgcagaaagtgcaggtttgttacataggtatacatgtgccatggtggtttgccacacccatcaacccgtcatctacattaggtatttctcctaatgctatccctcccctagccccccaccccctgacaggccccagtgtgtgatgttcccctccctgtgtccatatgttttcattgtttatctcccacttatgagtgagaccatgcagtgtttggttttcggttcctctgttagtttgctgagaatgatggtttccagcttcatccatgtccctgcaaaggacatgatctcatccttttttatggcttcacagtattccatggtgtacatgtgccacattttcttaatccagtatatcattgatgggcatttgggttggttccacgcctttgctattgtgaatggtgcttcaataaacatacgacatacagcttttacttgtagtttggcgcaatgctttttcaagcttctcttggtatctttaagaaaaattcttgacacaaaacactctccttcctcaaacaacatcatcgctcctgagtgctgatgagagaacagtttagtagcctgtttgactcaaagttttgtcacatgtatgtggtagccctttcatatatggactgtctagttagtgatgctcttgaagcctatgggcaaaagaacaatggaaaatccttgaaactggatctgcgtatcagatctcctgaactcagttagaaaaagagaaaaagaacagaatcagtacaaaattccatcaagatctaatagttgacagatcttatatttgtggacttttgttttactttgccatgtttccagaattgtacattgtattgctctttatgggtttcttgatttaattgttgtttgtatagaatccttggtatcaagatgggtcactgtaattgtaaacttattccgcaagtatttagagtgccacttttttaaaaagtcatctgcttactctctattctaaattattaatatcctttgctgatgctttttatggggatacaaatcccattaaaatgtcaatagttgaaactaaaatcaaatgttgttcattttcactttcattttctataaatcaggatgtttacaaaacaggtaatttgtgtttttctttgtataccatttcagattagtgataatattttgtagcaaaatattacatatcttgtactcttttcttgtagagaaaatatacagtcaatatcaattgctgtcatggagagatatatggttcttctgtaggtaaaattccaagatactccacagacatatttggggaccatagtctcactcctcaaagcaattttcacacccatgggagtagatctgtgctccccaaaccagctgggcagcataacaactgcaactgaatggctctcaagactaattaataaaataatgctccagatgcggtgaagtgttataaataattaaagctcaaatatgccttagcaaatataaactgaccaatttttatgtcttttgaatacattatcctggcttttacagttcctcattacttgcctcactagactgactcgttttcaattagtgggtgttattctggtccagatatattttaaaaactgacttcctttgttttacttgagcagtcactaaagtgatatttattacttgtctacttctgtgattaacctagagagagttttaaaggagcaaatcatagtggggaatttctaaggagaactgcaataaaacatcagcttattcaactcccttcctcctaccccaaatccaaatggagattagatcttgattgtaacaacagtgtaggtaatgactttttgtttgcctttttactaatgaaattgtttgtcactaggttttcatctttcaattaaaaaaatctctataatcccttccctagagatcattaaggataccttcaaagcttcccgagattttctggttaagatttagatggaagtaatcaatacatacattattaaaagagtggacagaaagccattattgcttggatgctgttgacaaatgaaaaggcttgaataaagtagtttacttgttcatttgtcaggtcatatattatgcatgttcgatttcttcagaagtcaccacaaagtgagagacaggctgagaaattcaataaaattatcctgaaatcatgttgtagattatacatttatttaggctcattctgttatcagtgctggcctgcttacgtgggatacattttagtatgtatgttagcttgacgagttttctgtgttttctttttacagaaagagaaaatatctttggatgtcatttgtgaatgttaagatttaagtcagctctgtgttaagaaaaatgcgttgttccctatcacctctgaaaaacaaccaaaagttgcgatagagtgattcattcttttttcttttctttttatttattttttctttaatttttttttgagatggagtctcgcctgcagcccaggctggagtgcagcggtgcgatctcggctcaccgcaagctccacctcctgggttcacgccattctccttctcctgcctcagctgggactacaggcacccaccaccacacctggctaatgttttgtatttttagtagagacggggtttcaccgtgttagccaggatggtctcgatctcctgacctcgtgatccacccgcctcagcctcccaaagtgctgggattacaggcgtgagccaccgcgcccggccagagtgattcattctaacattcaatgacctggcctcttagagtttctaaaccacttgactgttagttatatctactctaaggtgtctttttagccgcgttggaggaaatagacgtctttttgatctattcttcatcatttttgtataagtttgatatcctatgcagtcatatttagggatgctgaatagaaatgacttaaaaattatttttagaactgcatttctaggcatttgagtcttctgaaaactaagtctaagtcttctgaaaactagctttatcatcaaaactgaagaactgagtcatctaggaattgctgctttgctttaatgactgtaacaagatgagatgtgaataatttacaaactgacttctctaccagtcttctctctcactttgtcaaaatattttgatgtcctgacaaatactctttaaaacagtatctgcatagtgttttgccttgacaaagcacttttacacacattattcatttaattacaaatgatccccttgatttttttctgtgctcttccttttgtcccccaaaaacattattttaggaaaaattataccataactcagattcctagaatttattggttctttcaagaactttttttatgaagagcctactctatgttaagcatatgttagggaacaaaatgagtctctgcccctatggatgtttagattttagtgacagaaatacatagtaaacccataaattaatatatgaaattatgttgggtagtaagtgctatgaagagaaaataaacaaagcatgaatagagaaagattgaggagtactggcctatgtgaggaggttattttggggtaaagacttgtgtgaggccgggtgcagtggctcatgcctgtaatcccagcactttgggtggctgaaacaggcagatccctggacgtcaagagttcgaaaccagcctggccaacatagtgaaactacgtttctaccaaaaactagctgggcgtggtgacacgtgcctgtagtcccagctacccaggaggctgaggtaccagaatcgcttgaacttgggaggcggaggttgaagtgaaccaagattgtgccactgcactctagcctgggtggcagagtgagaccctgtctcaaaaaaacaaacaaacaaaacctgtgtgagtgagtaaaccatgcaaaaaccttgaatgaagaggattctaggcagaagaagcaccaaattcaaaagcccaatggtaagaacaggttttgagtgttgtagaaatagcaagatgagctgtgtatctcaagggaaataagatcagtagacagtgataggttctagaaagagggaaaggccagataatgaatggtcttgcaggccatagtttggaggtggattttattctgtgagtaaagagacatcactggaagtaaggaaacatcactggaaggctctcagcagggatgatgtgatctgatttatgtgtttagaagttgactcttgctgctatggagaattgactataaaaagagcgaaactgaagacacagaaaaggagggtggtggagtcatctcagaaggaaatgattacttggactagagtggaaatgataggtatggtgaataattatttgatcgaagatatatttggagggtagaattgatagaacttaagatagatagaatgtggagtttgagaggaagcaaagagtcaaggaaaattctgaggtcaatggcttgaacaaataaaataatgatgttgccatctgagaaagacttgggaatgatcacgtttgagtgtatgtgcttagaatgaaccagggttccatttttggattatgttgatagacagacacaaagggtatgattcagatattatttaccacttatacttgacaatctcaaattttggctcagtatcttgagaacatacacaaattaatttgtcacagggttttctaataatccattcatttctactaacatttcagaagtaatttccaaatcttaaagtttaggcttaatgacctaagacctaattccctaaatggccacgggaactagattgagttttcaccagtgatctctcaaggtcagctcagaacttaacaacattattgtcagtaggaagtaacttccccagtgattgttggaagcagcccagccttagaattaagagtcaaacagctgttcaagatgctgtgtgcgcagtaaactattcctccatagtatcacagacctgcaagcaggctggactattctagcccgtgcccttgatctcagagaatacaatctttgttttcaaagacttccagaaaaataaatctcaacacagagtttgttaaacacattttccccttatacactcaaaaatgttttttcattgactataattagatttttaaaaaaaaaacataatttcaggcctgaaatatgttcatttacttttcaattttacatcaaatttattcaatctcatttataaattaatattgttgttcatgttgttgactatctgaaacaatgaatggatgtatctgatacttcaatcccttatcttcacttttattcagaagtggagtgaaaataaggcggagctttttgtcatcttatttagatgattatttagtcaaactcatagaagcagagagtagaaaaatggttgccatacattgtaagggcgagttgttgctcaatggatataaagtttcagttatgcaagatgaaaaagttctagaggtctgctgcataacattgtgcctatagttaacaataccgatttgtgcacttaaaaatgtgttaaccgaggtccggagatcaagaccatcctggctaacacggtgaaaccccatctctactaaaaatacaaaaaaagaaaaaattagccgggcatggtagcaggcacctgtagtcccagctactcgggaggctgaggcaggagaatggcgtgaacctgggagacggagcttgcagtgagccgagatcgcgcaccactgcactccagcctgagtgacagagcgagactccgtctcaaaaaaaaaaaaaaatgtgttaacagggtaaagttcatattaagtgttcttatctcaataagaaaagatgattatggccttttctttatagcccagatacccatgttcataacttctgtaatactagctgtctcaaatgactattaagggaaacctctctttctgttgtttgctccattgcctctttcttcaaatttttttcttccatgaacccctatgaatttgctttagattactgggggcaatattcttgccaccctgccatgtacatcctggattgcttgcccttttccaagacctcgcttttaagttaactgagcattgcttgtcccgaagtgagcatttggtaaaatattcttatgtgtttgagactcaataaatatggtggctctttaaataaagaaggtccttttggtgacagaatatattcagcaactttcttgtcagacatagaaacaatacaggagacataaaaaataaggtagaaataacacaggaacaagaatgatgacgtaggatggcaaaactagtaaatacagatcaagttacagatatgactgttaacatcttgttctatgcctgctcggtatccatttgttgaatgaacagaactgttggatcatcctacatttcagagcctgtctagtgtcctctcatctcctacctaatcctgcagactacagaaaaagccccaagcagcagttcaaaccatggaacttctgagtgtttggacatgaaaatctcctttaagaaatcactaggttgaagaaggcaatgctaatgggaccacttcttgaggaaattccacccagtaactcagcagtgacactcagctttggatctggaacatgagtagacctagaataagatctgtccatttttcccaatttacagcattaattttttcacttatgattcatgagtccaggctttcccctgcaagcctgttttgcatctaaatcaacttggccttcatataacacactctagtgttctaactgggtgttctgtatcttagtcaacaatgtttactgagcatttactatatgccaagctatggctatggtttttaagcatcgataataacgatgcttagcagagactctcaaactgccaccatagagcaggcctgtggccgattaatgatcttaacaaattgattatagtatatgagaactggatgttagaacttagataaggttttagcaaatgcccacattttacaaatgaggacacagaggagcaggaagagtttatcaccttttctggatcactgcagccaggttctggcccagcccaggcttgaagcccaaggcttctgccactcagaacagtgctcttttcaccacttcagcctgcctcccaggatgattctaggaagttctgcttacaaatatgggtagtatttctagtcattccatcagattttattctgaaaaacacaaatttaccatttcaatatgaatacaggtaaaattcagcgccaggcaagctgtacatgattgaaagacatctgtgttttgaaaagcacgggcttttactcacatccatagtaatatgatcctaaatccactgtccccaggagaaagcaagatagcttttctccctgtcatgtcattacctatgcccagagttctcctcttgttcctctcatgaagcaaatcaatatctcacctttcatcccctccatacgtggttctgagctacttctatttatggcattatttagatatttttataatataagcaggaagcaagagggacagaaaaaaataatcagtggccaggtgtggtggctcacacttgtaatcccagcactttgcgaggccgaggcaaacggatcacctgaggtcaggagtttgagaccagcttgcccaacatagtgaaaccccgtctctactaaaaatacaaaaaattagcagggtgtggtggcgcgtgcctgtagtcccatctactcaggaggctgaggcaggagaatcacttgaacccaggaggcagaggttgcagtaagccgagatcgtgccactgcactccagactgggtgacagagcgagactccgtctcaaaaataaataaataaataaataaaaataataataatcaataacttggttcttctctattactttcaggaattttttaagtttctgatttcttccatggccattaggattttccacttatgtggcttccaaattattctaagtcagggagattttatgttttgttatcactcactttcagcttcactttagaattgcaagatttagattcaaagtgtgtaattaactgatggccttaggtaaaccctaacttatctgtatctcaatttgcatggatgaaacattcataatataaaagtatacaccacaaatatacctactcaaccaaactattggctccttaatgacaaagattaagtctctatatctttcctaactttgtacctaataggttcaaaataaatattttttgaatgaacaaattagtgagtcaacaatcagtcacccggttggccagtacctatggtgttttaagtgcaatctaccagataattcaaccttcataataaatagatttatcttgagattatcattgctataatagtgtagtagcatacttcatataagtttattttgtgaaccttaagaagctcaaggacaaacatctgtgtagtattcctaacattttctaaattgcatattttattttcatagaggtgctctacgtctttagtattgcttctaattctctcatatcactattttggacccttgggtctggctgtcttggaaaggtgaaaagaaaggtatggggaagaggatgtgttttaacaaagataattttatctgttcaagggattcaggaagtaattatcttaacatctgaatgctaacatctgaatattgtaaatacgtattctgtatgtacatgggagaaaatatctatatctgataccttttctatcatcacataaaggaactgacttctctggtttaaaatattaaccaaaatttatatgacaaaatcagtatatatgagtatatattttctcaaacctctttcaaacaggcctttttgggagacaagacacttatcaaaatcaaggctcttgacattaaatattcttgtttgtctttttttaaaaaaaagtcttcatttttctttcttttaaaatgcaataaattatactacaacatgcagtttatggtgagttattagatactgaaaaattggctttccattattttaatgcagattctacattgctttttttttactacataaagccatttgttttaagctccatgctacaaagaccacagatgttcattgcctagaacagtgtctgatacatagtagttgcttgaagtttgttaagtgactaaattaaagaggatcttacatataaccatgtttaaaattacatattgttatttatagtttttcccacatgataagaattattgccattttctttaacctctgacctccttgaaccaactatttctctctttttgtgggagttttatccttttgtatttaatctgaatcttttgaaattctaaagatacaatcacttaaccctctcttccatccactttcttttcttaatttcaggcaacaatgtgaaaataatggtgcttatgtctttgtaataacagaactttctttgtcttttctttggcctcattttaatcttcaatgactcatatttaagaaatgaactgtgcagctgtggtggatctaagtccttggcaacaactcgatgggcaaacacgtggtctctcacaatggatgctccttagctttgaattatttactgtccagttttaacaatggaattatatcatcaaatagtgccttggactttttaagtttttagtgccttaagtttttaagtttgatgagacctttaagatccatttccggccgggcgtggtggctcacgcctgtaatcccagcactttgggaggccaaggcgggcagatcacgaggttgggagatggagaccatcctggctaacacggtgaaaccccgtctctactaaaaatacaaaaaattagctgggcgtggtggcgggcgcctgtagtcccagctactcgggaggctgaggcaggagaatggcatgaacctgggaggtggagcttgcagtgagccgagattgcgccactgcactccagcctgggcgacagagcgagactccatctcaaaaaaaaaaaaaaaaaaaaaaaagatccatttccttattttacagaccttgttccaacaattatctccaccttctgtcaaggtcgtaacatatatctagggtgaccaactttcctcgttttcctgagactgtccaattttcctgaaactattctggttttaacatcgaaagtctctcatcctgaaaaactcaatgctggacaaaccaagatggttggttaccctactgctagcttccgtctttcactctaggttcaaatcattcctatgctaaaaagaacttcttatccctttgtcttgttatcctctctgtcctcctgtcgtgtcttcctcttttccttctcagaaaaagaaaattgaacatttgattttcacttgaaatacctactccttcttccactcactcctcagctatgcctacttctgaggcttctgccctccactgaaattgctctcagcacatctagtgaacactctgcaatgctgatcttactttacttctgtgtttcattggactcacttggtcaccctcttcctctcaaaattctcactctctccttgaaatttctacactcctcatttcccctaatctctccacctatttgttccttttctatctctcaagagatcctgttcctctgtttgcccattaaactttgatatgtaggcactcaacgtatattagctgaatgagaaaataactcctaagtattttttttctcctcaaacctcagaatttattatttccttgtggaaggaatgttagctttccaagctgagcatatcacagtcccttactctgtcccccatgcacagaacaccccccccacacacacacacacacaccatcatgttgcatttttaatattactcttcaataattttatcctgaatgagcatgaggggttctgaatcagaggcagatttcatttaattaccttacagtaaatattgttgctgtgcccttcctttgcccaaagacttacccctagggcaacatgatgaacgctgatgaaacattttcctacttgagtggctgggtactccataagtgggagactaggaaaaatcattttttctgcttataaaggagaaggaggctgctatccatctctcattctgaaaggttctctgtggaaacataacaggcctgagtcctaattccagcttctgcagaaaccagctagccctatgtgtctcatgttttacaatctggaaatgtctccaaggtatgggcttcatattttttgaaatgtaaatacctagaaagatacccactccagtctttctaacaacatagagttcagcttaggaacctaccctgagctataaccgtttgaccctcttggatcagagaaatgaactagacaaattgctacagatctaatctccatggtgtgggaagtttctcaggaggctagagctttctgtaggtgaactgagacatccaggaaagtttatttcctcatacttagttgaattgcacccagcgtttgctcatctactcaacctagacactaagtgtcattcttgtttctttttctctcttctctccagcatctattcagtcaccaaattttcacacttcagatttttagacatttccctatcctatccctgtcatttttcctggtaccattgccctgagtcaaatcctcataatcttgcactgaattcttacaattgcctcattatctctctgattccatttctgttcttctcaaatacatactctgtatttatatcaggaagatctatttgaagcacacatattcctgtgccactcccttggttaaaaccgttcaaaggttcctgattaccttcaaggcaacacctaagcctcttagtggaccatatgtgatcatagagaggcagagcttcaaattctggtttaaaaatctaatgtatttccagatagcaatagtgtctttttcatctttggacatgccctctccttgttctttatgctctagaaacactggcctgcttgagattccgatacataccatactgcactatgtcctatgactctgcacttgcattttcctcttcttggaatgttctctagcatactcttccttgaataagtcatgttcatgcttttgaattctatgtgattactagcttctcctggaagcttttcccgattttcttccccatattgcgcaagtctatagcactgtctacattgtattgaaattatttacgtgtctgactcttctattatatgttaaatattcctaaatagaaagggctgttttgcattcaactttgtatttccagtttcaggtacaaccactgacacatggtagttcaatagagggagccattattatttttataattagtaatgtcagtattaattgcctcccttcaggtccaaacagagaaactaggcaaaatgataatttacttgaatttgggaaacttaattgtatgaaaaaaaacacaagaatacaacaactgaacacacacacacacacacacacacacacacacacacacacacaaacatggagatttcaagtgaaatatcaggagaatcagctttatatgtaagcagagtaaataactcacgtatctagcatgattttagggtacagaaatatcccattattcagaaagtacttccctatctgtaggctgaatcctaatattctacttacagaactccagtattttggttcaaacgccttccctttctctattgaattgtaaatagctgtggatgatgaatcattttgcaaagtatcagactcaggattcttttgaatggtgaacaccgctaagattttattaataaatgtgtcatacaatacagctctggaacacttctgtaacataatggcatatctgaaattcaaggaagaatactgctaatttgtttttccccagtgaaagaacagggcttaaattcagcaggcaacattgctaaaagacagagttgaaaaaagttacaaaaattaagccctagatcagggcaaatattactgttattgttaaacagttatattagcatttatgtagcatgcacttaatacttttattaataccctcacttctgagatcaaagaatctgggtcaataactctcttcaatggtgtcagagtatccgttaggttattctaggctcacggtatacctcacgatccttttagcactcgattatgtgtgaacttactgttttcactctgcttctagtgttaattttctcccttctttggatctagaaactttttgaaggcagaaactattcattttgtttttctcttgatcccctggataaaggaagattacagattaaagattaattctagatctgttcatttatagaaactagtgtccgcaattcctacatccataatagctcaaaacatttctactattctcaaagaggtcacaatggatgatgtaatgactatttttcaaaagtattgagacttttctcttagcttacctattttataccttgtcagacattttgacagaattaactggtgattgtcagttggattcattgtatactttaatatagcctaaggtcctgcaaatggcccttaaggcttcccattatgttctggatatccactatttggggtatgtttaagtcctcattagccatgctagagttttgcaatatataccttgaaactttagctgtagatttgaagtatggctgtcaggttacataaacaaagcactcttatctcaatgagagggcattaactatccagaatgctccccccatctccccagaatagctttacaaacacagcgctttcctcattaacagatagacccatatagcctttaaaaaaaatcattttataaccatcagtgtataaataaaagagatagaaattgacctgggagtttcataaacaagttctgagcacccaggattaattttgagaagaatgccacaagccaaataagcacttcttttcatctcatttcacaggccttcaagagggaattgaaaactaaagaacctgtaatcatgagtactcttgagactgtacgaatatttctgacagagcagcctttggaaggactagagaaactctaccaggagcccagaggtaattgaatgtggaactataataacatattgatagaaggatcagtggtgacggagcagcccatccattcttgctgccagggtctggatagctctcatattttcttggttaaatagaatcaattcaaattaaacatagatgctgaaaaaaaaataaggactcataaactaccatgcataaatcagtttgtgcattcataaataaacatcaaaagagattagcaatcagttattggaacatttagaaaataataaacaaagggagttatctgtgaggaggaattctattgttgcaaagactacaagttaattttccatttaagagcctgcctgaagtaaattagagcttgtggtatgcatcctaacgtttttctcctcaatagcttaagtgaatcttaaattgtcggattgatataaggtagaaactcaggaagatatactttagatgttctgggctgtatcaaaatttatgccaaagtataaaaaagccgttaatcagtaggttaccctcttgttcaactgtactctttctttcttccagtatgacctttttgacaatgtttaaaaaaaaagaatgtggcctaaaaccttgtcatattgccaatttagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggtaccgtctacttctttgcttcagggccctttgagagactcaaaagagcttctaatctgaacttgagtgcagtgttatcttcccacaaagttaaagctagagaaatcagtccgtctttcacaaattcagtcttcattcacatggtattttctccaagagaagacagtgatctaattatttgtctgtcttcagttatatgaaatgaaatattaaaacagttacagggcaagaaatcactttgactttgatattaagtgattgtactaaagtctgatgtgtgtgtgtgtgtgtgtgtgtgtgtgtgtgtgtattggtgtattgcttgtgttacttagtatcagaatacagaaaaataaaacacttaatcaaaagccaggagtctaggtgttggcccttttgctaaccaaattacatgacttgggtaagttatggtttggtgaaataaggctgttaatgtgttgcccttcccttggaaggcaacatttgtaatacagtttcaagtttcattggcccactgcagaaatgagggaaaatcattatatatttggaagaccactgtctataagaccaaagttaaattcccttgtggcacaaagatggcaaatatattctgtagaaaaaaatacatatttaggagtatcattttgaaatcagcaactactcatctattgtcaaaatcacaaaaatcctcctagattaaaattcaaaagaagttaaattccctcatgcactcagcatgtttgccagcatctcagcatcctcattctagaagttgtcctcttccttggctttcatggaactgttccatccatgttcttcttcctatatttttctagattcttctcctagccacccctcaaatactgttgtgcccaagtttctaaccttagcctaattctcttttgattgtttaaaccctccctgtttgagatggcctggatggtgatgtatctacatctctagtccgcatctctcttctgatctctgaatccatgtggcattacgatcacaaatgcaactattctgaaaccaagttcatttgttctcctgttttccatttccctacttctgtcccctcttatctgaccttttttttcctgtttcctatttcagttaatgaatcatcatccaacaaattttccaggctagaaactttaggttcatccttaaacccttctgcattttcactgatggcacatgatggctcatgttacctcagaatagctcttttgtgttttctctcctcttttaaccaatgtcctttttaatccccagcatcttttacttagatgataacagtatacatctttaaatcccattcacccctctgtgtgcctggcatatctcagatactgcattttaaacatttggtgaattaatggatggatgaatggtttctttgctgatgttcctgcattacccagcttcttccaattccaatccaaactccttgcgggagaatacttgcctagagaatgaaatccaatgaataaggagattacgtggcccttttcttcctagccttgacttaccttctcagccatagctcctattctccagaccatttaatacactctgcccatatgatatatatatatatgtgatggcatatttgggaaaaaggggtgatatgggcagagtgtattgaatgtgtgtgtctgtaaagtatgtgtgtgtgtgtgtgtatatatatatatatatatatatacacacacacacatacatagttagatatatacatagtatatatacatatatacatagatatacacatatatatacacatagatatagatatagatatatctgcctttgcaaatgctgttctctctgtctggatccccctacgttgtctacttggcgaattctcccttcagccctcaaggaccagccaaaatgttacctatctttgttgtctttcctgagtgtctacaaccccccaactcccaccaagcagaagaaactgcttacagttggtactctcatagatcaccaagcatgctaaattgtcacacttaaatttcacatatattgtagcaacttgcttatgcatttttttttctcccagagaaagtgaagttgctaagagcaaggatcatgctgtacatctttgggctgctagcccagggccagcaacatatgaggaatctcattaggtaccttcatttattcactcaacaactgtttatgagtcattatataatgtgctggacaggtagttataaaagaaacagacttgatcattgccttcatgaagcctatggtctaatgttgaattgcatagctcttcattaaaatagtaggtaaaatttttaaaaagaaaagattaaaaatttgactctaatacttgtaaaatcccttctaccccaatgttttatgaccccatgtctaacatttaaagtaagggttaaccttgctgtgtactggaaaactaagggttttgaaatgtattacctagtattttaaaagcattaaatatgttgattttattcaaaaatatagggactaattttttgacagacttctccaaaaatgagaaataagttaggaaaatgtcccagtggaactaaattagttaatatgtcaattaaattgctcaatagataggctgtagagcagacataagggattcatttttagccatacttgtcacacaggtgcatttgtaagatactgagtatggatggagaagagaatgtgtacagcataatttaataattaaaaataactaaaagcataacagttcaagtatcagctggccttcacccaaccctatttgcggtattccttttagtttccctgtcttatctgttcttggtcttaagacaaacttcattttccataccctgattggtaaaactctcattctgatcccaatgatagcaaaacatataaacattaaacatacctttcgaaaaattatatttataacccagcacatctatctttctcagacatatatacacttaagttatggtacttatctgaatttttatgtactggtaatagtagatgtgattgggcttttgaatctgtgttgtattttatgcgtgtttcaaactatgaattacatgaattcatatatatttatctcccttcggtagctcttctttaattttgcagtggaaataaatcatttttctccactgcatcttattgacactgggtttgaaactctgaagctttgggggtagtagtttacaaagaatgagttttattaactaaaatttatttcagaaaaaaagtagaagtgtacttgaaaccactcttcccatttttccactcagcaatttaagccctcagaggattcatgctgtagggaacttttctaataaaccatggtttctctttttttattttattttattttattttattttattttattttattttttttttgcgacagtctcgctctgtcacccaggctggagtgcagtggtgctatctcggctcactgcaacctccacctcctgggctcaagcagttctccgcctcagcctcccaaatagctgggactacaggcgcccaccaccatgcccagctatttttttttttttgtattttttagtagagatggggtttcaccatgttggccaggctagtctcgaacttctgacctcaggtgatccactcaccttggcctcccaaagtggattacagcactgataactaggcagctagctagaagaacattttatatatccatatcagttcattttccttacccctagacactctatcatagtaccccccctccattctgatcttatgtgttaaataacttgttattcaagaaactaagtaatatgtgtttctgtgagatttagcattctgtaattgtattagcaaatgtggcttttggatttaaagaatgggtgaaacaacaatgactaagtccctggcctttatggaaatggcattattgctagctgatcatctgcgggtggtgaacatggtaaattaataaatggaaacacaatattaatattgactatattgctcactaagagaatctcagccttccaaacatagcttccataggaaaaaacagtagaatcaaatttaagttttaaatgcttctttacttttaaaattcatgatttatactgcttatcaaatattttaagggcaagatcatgacttttcactttactgaaaatagcaccagtgcttatttgactagacaaatattctaccttccttgtaatggggaataggaataactttttgaattactaggtgttccacatagatctgtaagtggaatatataaaggctttaataaagtagaataacttttaaacctgtagtctggatacaagatttttgttcttcaggacaatcccaaggtgaaaaggtttgtggattgttgttttctttttttttttttttttgagacagagtctcactctgtcaccaggctggagtgcagtggtgagatctcggctcgctgaacctcctgggttcaagcaattctcctgcctcagcctcctgagtagctgggactacaggcgcgcaccaccacgcccagctgatttttgtaattttagtagagacggggtttcaccatgttggccaggatggtcttgatctcttgatctcgtgatccgcccaccttggcctcccaaagtgctgggattacaggcgtgagccaccgctcccggccagattgctgttttttaatgttttgtttttgttttaataaaccatggtttctctttttttaatttttttttttttgagacagtctcactctgtcacccaggctggagtgcagtggtgctgtctcggctcactgcaacctccgcctcctgggttcaagcaattctctgcctcagcctcctgagtagctgggattacagacatgtgccaccacgcctggctaattttttttttttttttggattttttagtagagatggggtttcaccacgttggccaggctggtctcgaacttctgacctcaggtgatccgttcaccttggcctcccaaagtgctgggattacaggcgtgagccactgcgcccagactataaaccatagtttctctgtaccaaaagtggtatgtccttcttgagccaggaatatttcactgttcttagtttacctgttgactctgaacacagtttttcatacactgtaaataactctcccaggctgccatcttggaatatgcaaatctgtcgcatctatgtagttatgcatatcgcatttttgtcaaacttttaacttgcatttcttactgtgaaaagtcagggcagggattctatgagttttttctttaaagttcctacaatgaaatgttttgattaaaccttttttggcattcaaattgagattgatttaatgatgtgtgtagtaggctagaaattatgatgaagtgacgatgccatccttatttatcttcagcattcacatctaaagttttaagaagaaaactggcaaatccacctttttaggcttaccatcctcagtccctgtggctttgggtttttttgagaaatttgtcaaagaaacgctatgttagaatttgacattgaggaagccaagcatatttcctctgaatagataatgtgaaatgtgatataatgtattagaatttcatcttcactttggcaagcaagatacttgcaaccatgttcatgcaactatcttcccttattgcttttctcttcttaaccttggttctaaagttttcttcttattgtattaattttgttatgcttcccatttatatgagtcaagtcaaccttacttgatttcttatatatgagttatgtaaggaaaacttatcttttcttatagaattaggggatgaatgagcagatagaaccaacatgaacagggcgatcctaaaaatcattcaaaacatgtaagctctcccaactctgaataaacttgtgatatcttcataatgaataaggtatactgcctatagtaggaagaggaaaatttattaatgttttgtgcattgttaaagaactacaaatgaattgccgtgtggaggctttcattgttgttgttgtaaaaatgctatgtgtattaagtaagcctttgatggagaagaaaaaacaaagaaaaaatatttaatccttcataaatctgggttaaatatgaagctaattcctgttatttggagtaaccagggttttatctagtttacaaagcatgcaattgcaatgtttaaaagcatatgatttggcctttaatatctgaaaatatgtctatcaaaggccatattatagcgagtgtcactccatactttataagtacggtatatttttaatagaatgtttatgtactggtgataagagatgttactgggtttctaaaccagtactgtattaaggattttatgctattgtaagattatggattatgtgaattcatatatattgatttactttcagtagcttttcaatagaatatctagggtttaatacagcttagaaactaaagcaggaattattcatctttaaaatcctgaccaaagaagtggctggcaagatggctgaataggaacagctcaggtgcgcagcccctagtgagatcaacacagaaggtgggtgatttctgcatttccaactgcagtacccggctcatctcactgggactggttagacagtgggtgcagcccacagagggcgcagaagcacggtgggatgtcgcctcaccccggaagcacaaggggtcagggaattccctcccctagccaacagaagccgtgagggactgtgccctgaggaacggagcattccagcccagacactatgcttttcccacagcctccgcaacatgcagaccaggagattccctcgggtgcctacgccaccagggccctgggtttcaagcacaaaattgggcagctgtttgggcagacaccgagctagctgcaggcgtttttttcatatcccagcgtcacctggaacaccagcgagatagaaccattcactcccctggaaaggggactgaagtcagggagccaagtggtctagctcagtggatcccacccccaacggagcccagccagctaagatccactggcttgaaattctcgctgccagcacagcagtctgaagtggacctgggatactcaagcttagtgtggggaggggcacctgccattactgaagcttgagtaggcagttttcccctcacagtgtaaacaaagccgtcaagaagttctaactgggcggagctcaccgcagctcggcaaagccactgtagccagattgcctctctagattccttctctctgggcagggcatctctgaaagaaaggcagcagccccagtcaggggcttatagataaaactcccatctccctgggacagagcaccacggggaaggggcagctgtgggtgcagcatcagcagacttaaacgttcctgcctgctggctctgaagagagcagcagatctcccagcacagcactcgagctctgctaagggacagactgccttctcaagtggggtcctgacccccgtgcctcctgactgggagacacctcccagcaggggttgacagacaccctcatacaggagagctctggctggcatctggcaggtgcccctctgggatgaagcttccagaggaaggaacagacagcaatctttgctgttctgcagcttctgctggtgatactcaggcaaacagggtctggagtggacctccagcaaattccagcagacctgcagcagagggttcctgactgctagcatcaacatcaacaaaaaggacgtccacacaaaaaccccatctgaaggtcaccaacatcaaagaccaaaggtagataaatccacgaagatgaggaaaaaccagcacaaaaagcctgaaaattccaaaaaccggaacgcctcttctcctccaaatgatcacaactcctctccagcaagggaacaaaactggatggagaatgagtttgacgaattgacggaagtaggcttcagaaggtgggtaataacaaactcttacgagctaaaggagcgtgttctaacccaatgcaaggaagctaagaaccttaaaaaaaaggttagaggaattgctaactagaataaccagtttagagaggaacataaatgacctgaaggagctgagaaacacagcacgagaactttgtgaagcatacacaagtatcaatagccaaatcgaccaagcaaaagaaaggatatcagagactgaagatcaacttaatgaaataaagcatgaagagaagattactgaaaaaagaatgaaaaggaacaaacaaagccttcaagaaatatgggacgatgtgaaaagaccaaacctacatttgattggtgtacctgaaagtgatggggagaatggaaccaagttggaaaacactcttcaggttattatccaggagaacttccccaacctagcaagacaggccaacattcaaattcaggaaatatggagaacaccacaaagatactccttgagaagagcaacccaagacacataataatcggattcaccaaggttgaaatgaaggaaaaaatgttaagggcagccagagagaaaggtcaggctaccccaaaggaaagcccatcagactaacagcggatcatttggcagaaaccctacaagccagaagagagtgggggccaatattcaacattcttaaagaaaagaattttcaacccagaatttcatatccagccaaactaagcttcataagcaaagtagaaataaaatcctttacagacaagcaaatgctgagagattttgtcaccaccaggcctgccttacaagagcttctaatgaaggaagcactaaatatggaaaggaaaaactggtaccagccatggtaaaaacataacaaattgtaaagaccatcacactatgaagaaactgcatcaactaacgggcaaagtaaccagctagcatcataatgacaggatcaaattcacacataacaatattaaccttaaatgtaaacaggctaaatgccccaattaaaagacacagactggcaaattggataaagactcaagacccatcagtgtgctgtattcagaagacccacctcatgtgcagagacacacataggctcaaaataaagggatcgatgaatatttaccaagcagcaaatggaaagaaaaaaaaagcaggggttgcaatcctagtctcagacaaaacagactttaaaccaataaagatcaaaaaggacaaaaaaaatggtattacataatggtaaagtgatcaatgcaacaagaagagctaactatcctaaatatatatgcacccaatataggagcacccggattcataaagtaagttcttagagacctacaaagagacatagatgcccatacaataatagtgggagattttaacaccccactgtcaatattagacggatcaacgaaacagaaaattaacaaggatattcaggacttaaactcagctctggaccaagtggacttaatagacatctacagaactccccaccccaaatcaacagaatatacattattctcagcaccacatcacacttattataaaattgaccacataattggaagtaaaacactcctcagcaaatgcaaaaaaacagaaatcataagagtctctcagaccacagtacaatcaaattagaactcaggattaagaaactcactcaaaaccacacaactacatggaaactgagcaacctgctcctgaatgactgctggataaataaggaaattaaggcagaaatgaataagttctttcaaaccaatgagaataaatacacaacggaccagaatctctgggacacagctaaagcagtatttagagggaaatttacagcattaaaatccccacaggagaaagcaggaaatatctaaaattgacaccttaacatcacaattaaaagaagtagagaagcaagagcaaacaaattccaaagctagcagaagagaagaaataactacgatcagagcagaactgaaggagatagagacatgagaaatccttcaaaaaatcaatgaagccaggggctggttttttgaaaagattaacaaaatagatagactgctagccagactaataaagaagaaaagagagaagaatcagacagacacaagaaaaaatgataaaggggatattagctctcatcccacagaaatacaaactaccatcagagaatactataaacacctctacgcaaataaactagaaaatctagaagaaattgattaatttctggacacatacaccctcccaagactaaaccaggaagaaatcgaatccctgaatagaccaataacgagttctgaaattgaggcagtaattaatagcctaccaaccaaaaaaagcccaggaacagatggattcacagctgaattctaccagaggtacaaagaggagctggtaccattccttctgaaactattctaaacaataggaaaagagggactcctccctaactctttttatgaggccagcatcatcctgataccaaaacctggcagagacacaacagacaaagaaaatttcaggccaatatccctgatgaacatcaatgcgaaaatcctcaataaaatactggcaaaccgaatccagcagcacatgaaaaagcttatccagcatgatcaagttggcttcatccctgggatgccaggctggttcaacatacagaaatcaataaacataatccatcacttaaacagaaccaatgacaaaaaccacatgattatctcaatagaagcggaaaaggccttcaataaaattcaacaccccttcatgctaaaaactctcaataaattaggtactgatggaacgtatctcaaaataataagagctacttatgacaaacccacagccattatcatactgaatgggcaaaagctggaagcactccctttaaaaaccggcacaagacaaggatgccctctcccaccactcgtattcaacataatattggaagttttggccaggacaatcaggcaagggaaagaaataaagggtattcaaataggaagagaggaagtcagattgtctctgtttgcagctgacatgattgtatatttagaaaaccccatcgtctcaacccaaaatcttcttaagctgataagcaacttcagcaaagtctcaggatacaaaatcaatgtggaaaaatagtaagcattcctatacgccaataatagacaaagagagtgccaaatcatgagtgaattcccattcacaattgcttcaaagagaataaaatacctaggaatacaacttagaagggatgtgaaagacctcttcaaggagaactacaaaccactgctcaaggaaatgagagaggacaccacaaacaaatggaagaacattccatgctcatggataggaagaatcaatatcgtgaaaatggccatactgtccaaagtaatttatagattcaatgcagtctccatcaagctaccattgactttcttcacataattagaaaaactactttaaatttcatatggaaccaaaaaagagcccacatagccaagtcaatcctaagcaaaaagaacaaagctggaggcatcatgctacctgacttcaaactatactacaaggcttcagtaaccaaaacagtatggtattggtaccaaaacagatatatagaccaatggaacagaggcctcagaaataatgccacacatctacaaccatctgatctttgacaaacctgacaaaaacaagcaatggagaaaggattccctattcagtaaatggtgctgggtaaaccggctagccatctacagaaaactgaaactggaccccttccttacaccttatacaaaaattaactcaagacttaaacataaaacctaaaaccataaaaaccctagaagaaaacctaggcaataccattcaggatataggcatgggcaaagacttcacgactaaaacaccaaaagcaatggcaacaaaagccaaaattgacaaatggaatctaattaaactaaagagcttctgcacagcaaaagaaactatcatcagagtgaacaagcaacctacagaatgggagaaaatgtttgccatctattcatctgacaaagggctgatatccagaatctacaaggaacttaaacaaatttacaagaaaaaacctaatcaaaaattgggcaaaggatatgaacagacacttctcaaagtaagacatttatgcggccaacaaacatgaaaaaaagctcatcatcactggtgattagagaaatgcaaatcaaaacacaccagttacaatggcgatcattaaaaagtcaggaaacatcaggtgctggggaagatgtggagaaataggtgtgcttttacactgttggtgggagtgtaaattagttcaaccattgtggaagacagtgtggcaattcctcaaggatctagaaccagaagtaccatttgatccagcaatcccattactggttatatacccaaaggattataaatcattctactataaagacacatgcacatgtatgtttgttgcagcactgttcacaatagcaaagacttggaaccaacccaaatgctcatcaatgatagactggataaagaaaacgtggcacagatacaccatggaatactatgcagccataagaaaggatgagttcatgtccttggcagggacatggatgaagctggaagccatcaatctcagcaaactaacacaggaacagaaaaccaggcaccgcatgttctcactcgtaagtgggagttgaacaacgagagcccatggacacagggacgggaacatcacacaccggggcctgtcgaggggtgggaggttaggggagggatagcagtaagagaaatacctaatgtagatgacaggttgatgggtgcagcaaaccaccatggcatgtgtatacctatgtaacaaacctgcacgttctgcacatgtatcccagaacttaaagtataataataataaaaaaaaaatcctgaccaaattatttattcaatgtgaaattaattgtaagttagtgttgccaggagagcttattacttagttaccatgtattccctctcatctcctgctttgtttataaagctaaaagcaaattacttaggacagcaatgtcaaatcactttctttccccaaagcatctgattttagatagcgctgtgtgtgttttaaaagcccctacctcgacttaggcaaacagaaccttcgtttaccatgctattcccatcccgcctttgaaacttctgaaaaggcagagcggagtaattgtttcagacatctgcttagcatactttgaagtgcatataagttctttttcagtttcatttgaaccccagctgtcttcaccgaagtctataatcaatctgaattaagttgtcctacttctcctaataagtctcttattaagttctgcatcagcctcttagggagacttaaaagctaattcatgtagaattgccattttctactaattcacttgtcagctctccaaattccaacaaaaacaattgcaaagactattaatttggctcttcataaacaacttatgtaagtgtagtatacattggaaccaaacaaacgatttaaaacagtgggtgggaggaaatgagttgatggcattcaaaacgcttccttttttgactgttatgaaatgccttccacatcgaaagcataaagccatttatttaataagggaaacatccttctgcttttactttcatagatgagataatgactgaatgaactttgcttaaagacaggaaaaggctttagaacagttggaaaaggaacatgttctttttgtcattgaacttattttaatttggacttctttgtgttattttgatggactgtgataaaagaaggagctagaattggttattattgttattggattaaatcagagttgtacagctactcttctggtcatgggatatttaggagaacacgggtaatcaaaatgttcagctaatgagttcatctgattctactcaagaagtgtttaatcagataataaaaatttctccaaataataccatccttcctactatttgaaaacaaccatatcaacatctgatcctataatatgccaatcctgtttgctaggattttctgaaagctttgtttgtggtgggtaataactagaaatactattcctcaagagtctcgggtaataaaagattattcaaaaaacttaagtaatatactctcagtattagaggatatacaaatgcactcattcattaattcatgatatgattgaaacctatacccagagaagtctgatctcattatagagtgtgaacatttaatttatttcaaaaacaaaaattatattgagagttgtatagatggcatcttagttttcctgggaatattattatttagcaccaagctgagggagcaagaatttgtattagcttgtgtatacatgtgcatgtaccacattaactagaaacagtgctaaaatgtgagttatttatttaactgaaattccatatttcctaagaaaatggaatcacacagccaatatatatttttaattattttttgacatctaccaaagttgtgacaagaataaagttcacaattctgttactctcctaccgttcagtaaaacaggaaatgctttaagatcaaataacccaaggagttcgcttcttcctgtcatgcttgacaattacaattttcaaaatttaacagttagcattgacaccagtattatgccttacacaacctgaaattaactaagttaagtaatggcattgaataatttttcttggtaaatcagttttctgggtattatgggaacagttgtgtctgtgatactaatgtctctctcattttaatggggcctaagaaagaactttttcataataagattttttcatgttaaaataatatttttagttatagtttacacttactgcaggtttttctatttaaaagcatcttccgagagcagtgattcttaaacttatttacttcagttatcttaacagcatagaagacatagcctgacatctcccgcttccacttacctatctcctttttccatgagcatgaaatttctttgatgttcttgttttattttttaaatctcacatcaattttatggtattttccataatggattcatcatgttttaatatgaagatgctttttcttcaaattctgaagtaaggaatctttcagcacattcacctatggacatgaaagcgtaagttgagaatcacagtataaaggattgcccagtttttgcaggctttatctttttccatcaacttctgtcttttatgtacacagacaaaaagagcagacccttgctatttcaaatttatcttttgcaggttcatctgattattgtgatccaaagttccatgactagcagctcttaattttgaacatgtattatttcaagcttttgtgcatagtcacttaactaatgagttaaatggcattttaagtcaggttccatgaacgcagaccctgagaacaggggtctaggtgcctgtgatttatagagggtctgctctcaggagaagcctgtattggagttagggaaacaatacaggagaagaaagagcccagcaagtatgccatttcaggtgaaacctcacattgtgtctgatccagagagagagcaagccctcgagcagaaacctcgctgtggagttgtactctttattttattttatttttttgagatggagtttcgctcttgttgcccaggctggagtgcaatctcagctcactgcaacctccgcctcccaggttcaagtgattctcctgcctcagcctcctgagtagctgggattacaggcatgcaccgccacgcctggctaatttttgtgtttttagtagagatggggtttcaccatgttagtcaggctggtcttgaactcctgacctcaggtgatctgcccacctcagcctcccaaagtgctgggattacaggcgtaagccacaacaccgagccggagttgtgcctttataccagtcattgtctgtgtcactgaagtgctggcaaatatttgtcgactagctctgaggtgggatgaatcctggtgtgtatcaaaaccagttttcgtggtgtaaatactccctctaccactgatctccagctaccgacataatgccactgagtatggaattgggaggagatgcacacaattggctcttgggctctgctgcagcacaccactggctgtggtccactcctgggatatgggttacttcctgggctagggggctcccataagcagaggtcacatgtggagaaggcaggtagctataagacattaatagtcaaccatcacagcagctgaaggatggatgcccaggttaggtaaagtgtcccctgcaactaataagtaaacctagtaatccactcactcttcatattcaacttggctttttttaatgctgttttgtttttgcatgtacagtaattctttataaataatgagaattttgtttctttatggaaaatccacctaccctccaccctaccatgaatagcttgatagctgttcatcagaattagtgatggaagagaagagttaatgaatgaaaaagtctaagaaagtgatcactattagtaagaaaatggcctcataagtgagtttggctttatagttatggaatctgtaaatgtctaggcattcagacatgtccagacatcattgagaatgtcaagaattttcagtggcaatggttctcacctcagcatacatcagaatcacctggagggcttgtagaaactcaggttggtgaaccccttccccagagttcctgattcaaaatgtctggggcaaggctaagaagtcccaacttgttcccaggtgttcatgatgctgctggttcagagatacattctgagaaccaatattccatagtaaagctactgtgtatgtacctgaagacatattttgtgtagtgttagcgtttcttcaattacaagtaataaatatatcatttattatttcttttatatttatcaatatccagaagatttagtttaaaaatgaatgcaggcacacagcctcttgttggattgattaatagtttagatatgggagcatcatagggagcattgtttcgcttaggaaccttgaaatgaataaatggcttcttttctaaatctcacttgtggaagactttgacggtggtttatttcattttttcctgttggtattttaatgacactggtacaattttggggttgcttcagatgaccaacagcataacttgccttcccagtattaatttttaacgttaaaaatatttagtcatggccggccgtggtggctcacgcctgtaatcccagcactttgggaggccgaggtgggtgggttgcatgagctcaggagtttaagaccagcctggacaacatagtgaaacctcgtttggacaaaaaatacaaaaattaaccaggtgtggtggcatgtgtctgtagtcccagctacccgaaaggctggggcaggaggactgtttgagcacaggaggttgaggctgcagtgtgccctgttcactccactgtactccaggctgagtgacaaagcaagaccttgtctcaaactatatatatatttagtcacataacttttcactttgtgtaaatattttttgcatttaccaataaaaacaattacatttaaaaattctccttacacttttctaccaaacatactgatgataaaatagtactttatagagtttctgaatctaggatattaaaaatagttgggatcagtcaacactttttaagtaaaatctacttgctagatatgaatagctaacagcttctccaggagtgcctacattttataacttactttgtccaccccttgaggctctgtgttcagggggagggtatatttttgtgtatagaaatagagatgaggtgaaatagagatgaaatagagatgatgtgggatcaactgggagaaagtagaaaagagtcttagctgaagtggttgaggaaggaggatttttcccaaaatggtgcaaaaaacaatgtattaaatatctgtgaaaaagttcatggttgtggtatagggtgagtggtatatgaaaagagaattatgggataaactaatggaaacagatgtcttaaaatttgcttttaactttaaacaagagacatgaaacttaaacttttcccttatcctagaatctgggagaggagaaggatgagaaaaaatgaaattttacattagaagcaatttgattaatgttcaatggaaaatggaaatagctatggtcaaacccactcaaatcaagtgtacattaaataattgagttaactgaattaggcagagtaagggcacattgattttcagtgttgttgaaaattggtccacatatcattgttatgctttttgtttgtaaacctcaatatttattaagtttccacagtgtgctcagccctgaaacgccaaattctcttaaccagaatgaggctggaggatctaacactaagacagatttctattttcttttaaggaattgatttttatggtaattttttttcttcataaagttaagaacctgccagtcctgtttcgaaacacacttatttttagaagtttggttttccgggattatgcatcattatagactcaaatgactcatttagaacttttccctatcaaatattcacattctatcatcatgatcttaacacggcataagcaagttagtgaacagagtgaagtcaatttattggcaatatatgccgaagtacaggaattaagtagaaacaaaagtgaatgagagtctttggcaatacattgatgtgttttttttagaaccaatgataaactactgctgagtttcctttcatttacttttttcctactcttaaaacattgtaacccattttgagatctatccattgttgtgaacctaaagcctattaggtcttattaaataatacccatttaactgacctgtgatttaagtttcttatctgcccccaagcaagcagactgtatgcaacggcattttacctgcttcaccttctgcttgccagttggtttttggtcttcacatgtttctagcagggatggggctaaagcaagggagagaatggtccattgttttagactttcacaaacccaatatactagaatctccacaaaggttatccaatatcagggtgacttttgtgcatccaataaagcataaggttaaaagaaatacaggctaaacaaatgagcataaattactccgttggcttatgctgtgaataaaatattacctttggaaccatctcaattttttttttgtataaaggttgaaggaagacatttgcaaagtcgtttctcctataaaactgcctagggtttggggttgattgttgtatgcaagaggggtcttggtgaaatctgacccactttgaatctaaaattactgaattattagtgaaaagattattttaaaaagagttttgaactctttttcctactgaaattgtattctcctttagataatcaatgcagcatcacccccacagatttttgagggcactaaatcatactcctattttgaaaaagaaaaaagtctattactattaaatatatctgttagttgaatatcaatcactttttctaaagggtagatttggccaatgagtgatttttttttttttttttttttggaaatcacatctgagaacgttgtttagacagcttgacacttagactcatttgtgtaagtagtaatttattcatcatttgcatgtacttaactggacattatcatgatagcagttgtcataacagactattacaggatatgaatttagatattaccttaagatgtgatcataaaaatcagaataatatcttgaaaatatcaattttatggtgagaaaaatgacaaactgaataaactcttgactcaagaagctagacttttcacaacctcatgtattcacagaagtaaaaataacaactaataatgtgtccagagggcccacattgctcagaaatgaatacataagactttcttttcagcctcagaatatgatgaaaagaagatgaaccattatgatgttgcatagattttaatgaagaaaattcgttttctgttcctttcgtttgactttaagtagttgaacatcctgcttttttattttgtttgcaagaaataagaccattttagaaaggctaaaaacattaattacatttaggaactacaataatctgaaagtaaaattggatattaaaggacgtttttgcaatcctttttagccctcttctgtgtattatttttatcactgctcttaaaaatttgtattaatctttggttcatttctgccttagtatttctaagttaataatatattgaatgaaaaatcaaatcagtaaaaatccattttgtttcagtagtgagtgccttccccctagaaccaaaactaaataaatgtgctccatataaagcaaaccaggtacagcatattgcacgggtaactcacaattctagattcctctattaatcattattcagacatgcagaggtagcttaatttgctttaataagtgaaaacagaatctctttgagactgctatctgcaatattatactttgtcctgcattttcttggtcaaaaattgtattttatagccatgatatattttggcttggaatttgcttctttataagcctagttattaatagtcatcatttaaatgaaatgatatccattagccttaagctgcatgattacagagacttggtctatcttacgctgtatttccagtgcctagaacattccctggcatataataggtacccaataatagtttttggaataaatgaataaacaaatttgtgcaaaagcatagggcaaaatgctatcttttagatagcgtgacccttaaaaattattttgcaaataatttgctccatttgccaccagcttatttctggccattgttacttcttgtctctgcatacaaacactctgtgtctcttctcctttccacaatgaccacaagttatactgatctacttgagattttccaggtgactatttcatgtccagaggaacatgcctcttctagtgttcccctctgtgaatgatttcagtcaccttatctactcaggaggtctctcttcccctccatcagcatctttctctgcaccttccaaacccctatgactcaacttctcataatatggattgcattttttttaatgacccattaaattgtgtacctctgctaatgattgtgagtgtgttgagacttccatttttccagtggatgataggtatataatatatatatatatacacacacacacacacacacacacacacacacacacacatatatgtgggcacagtatctagtggatataaagtaagtgttttcaagtgagtagtaattaaatctaagagttgccgagaaaatgccattcccgttttgtggacatcttcattctacattgtaaaggccacctcattcaagacccaccacaatcttgatcccagaaaacacccatgattcatcttttacagctgccctgtacttcatattttaagttattaaaggctatttgcttttcctcagacacacattaaactttcctacctcttaccctttgttcaagttctgaacacatatctttcttccccacactatgcttcctctttatcagtttcatgtacctactttccaatgtctagttcgaggagacgtttataaggctacatgatagaggttgcccctggggcgatgtgagaaatcagctccaaaaaggtagctacccggcaaaggatcttagtctgtgactctctcatggatgaacttattacctactgctttgcagagtctccctggactagcctgaataggaacttgtgtgactatatgtgaactaaaagaaggagaaatatgcctaaacttctcatccatctttgtaacagccctaaagtatgcatgttactatcccttttctacacaagtggaaaatatttgtaaatgaacttcgttacagtctaatatttgatgacttcttagttcatatcattatttaagtaacttttctttagtggaaaagcccaaaaattagggaggcagggagagagagagagagagagagagggatcatctgtaatctcagccccagcatctataatcccaatccctgcaagggcctctttgggcaaagaagaaaaaggcactgtgtttttgaagagatccccggtcctatgccaagcctaaccaatttggtagtagagcccaggctggatttcagttggtttgtagtcttctagtcttttcatatgtaaatatttttaatgcttttattcagtgttgttaaaatgccctccaaaagatgcactaacttgtgccaccaccaccaagcagaatatattttccttgaataggctacttcctctttttttcccactcactccatttttattttaaaaatccctggtagagaccaaaaactgaaatgttatattcttgcccaaagaatgagagatgcttcagaaattagcaaatgctccaatataaatcaagtgatagatataaataattcagatatgggataaggaaaatgggtagctttctcttatttaggaactctatgtcaggtttctgtgagaaactgtttacgaagcagtctgacaatagctattggtctgaagtattagtaattagtacagaagtgcctaattctcttgactgcttgttctttaataaaaatgtattgagggattatcatgtactatggcttggcatatactggtgaaaaacaataatgtaggattgccttaataaattttctggtcttgggaaggaacagacaatgaataaatgaataggcaaatatatatgtacttgcaaattgtgatcagggttcagaaggaaaatagggtgttgagagtcaaggaaaaaggagacactttacgtagggcaaccaactgggaataggctatctttaaaagtcacatctaactgagatcagaagtatatgaataagagccagctaggcataaagtggatatataaaactccaagcagagggaacagtgtatctgaaggttctaagtcaagagtaagcttgggccaggcacggtggctcatgcttgtaatcccaacactttgggaggccgaagtgggaggatcacttgagcccaggagtttgagaccagcctggaaaacatagagagatcccatctcgcaaaaaaaaaaaaaaaaaagaaaaagaaaaaactaacttaaaaatatatatatatcaatgccagtggtgtgtgcttgtagtcctggctaacttgggaggctgaagcaggaggatcgcttgagcccaggagtttgaggctgcagtgagctatgatcgcactgctgcactccagcctgggcgacagaaagaggccctgtctgaaaaataaaataaaaataaataaagaaataaaaagcttgatgagttctaggaactcaacattttctaacttcttattagaaatgccaaattctcaggcccaccttacacccactgaatcaaaagcactaagtgggactcagcagtctctgtgttaacaagccttccacatgacaatgagatgcacactattgtgtgagaatcactgccttagactgatgttttgagctatttaggggagggagagggcccattcagggacaatggtggttaacacatgtggctcagaccaagaaatgattgcaagcccaaaaacttgttaaatgtaaaacttcaggcgcagtggctcacgcctgtaatcccagcactttgggaggccgaggcgggtggatcatctgatgtcaggagttcaagaccagcctggccaacaaggtgaaacccagtctctagtaaaaatagaaaaattagccaggcatggtggtggtgtgcgcctgtaatcccagctacttgggaggttgaagcaggagaatcgcttgaacccacgaggcggaggttgcagtgagcccagatcgcaccattgcactccagccggggcgacaagagcaaaactctatctcaaaaaaaaagtaaaacttcatctgtctgaagtaacttctgaatttgaagataaacatcctcatggttgatattttaatggtttatggattattacttacttttaaggaagttaataggtttcattaactgccattttgcttcattttgtcacatataattaaaatttttcagacagaaaatattggtattttttctgtttccttagcaacctaaagcatgacctgcttaaatgacttatttgtgctcattaaaagcctttttgtgttaattgtgtatattttgtatttagcctctgtgaaacactcatgaactatctttttatttgttttaattgtgtcattggaaagcttgaagtattttgtggttttttttttttttttttttttttttgcttgttttttgtctataaaggggagataactggcagttgcagttaggattatagaaacattttcccaaggaaattaataaaatttgttcaagtttcttcttttacaaattgtacttatttttgattttttaaatagtggtaaaatacaaattacatgaagtttactatcttggctctatttaaatgtatacttccatggcattacatacatttacgttgttctgctgccatcaccaccatccatctccagaactcttctcatcttgcaaaactgaaactctatgtctattcaacgataatccccaccaggcatggtggctcacacctgtaatctcaacactttgggaggccaaggcaggcggatcacctgaggccaggagttcgagaccagcctggccaacatggtaaaaccccatctctactaaaaatacaaaaattagctgggcgtggtggtgcacacctgtaatcccagctacttgggaggctgaggcagcagaattgcttgaacctgggaggcggaggttgcagtgagctgagatcgagatcacaccactgcactccagcctgggcaacagagcgagactccatctcaaaaggaacaaaaaagaaaaaaccacagtaattccccattgcttcctgcccccagcccctggaaaccaccattctatttcctgtctataaatctgaatactcatttctatatcttctttggagaaatgtctattcaggttacttgctcattttttagtcaggtgatttgttttcttgctattgagttgtaggagttccttgtgtattttgaatactgaccccttaccgggtgtatggtttgcaaaatatcaattgctcctgctatgttcaacttgttcttaaaaataaaaacttttcctttgtggtcaatacttccctgttcctcatttccaaattttatacatgaaggaaatgtgagcacccagaaaagaaagaagatagacactgttaatatggccaagatataattcggcttttattataagaacattggagttacaagcttcatagaaagccatgtcctaaaagatgaagaattatgatcagtgcaaagagaaaatgttaaaaagaaaaagttatccttttatgtttgggtatatattctttttcgatattgtaaagagaaactagagttttttgttcttgtttttgagacagagttttgctcttgttgcccaggctggagtgcaatgttgcaatctcagctcactgcaacctccacctcccgggttcaagcaattctcctgcctcagcctccagagtggctgggattacaggtgtgcaccaccatgcccggctaatttttctgtttttagtagagacagggtttcactgtgttggccaggctcgtctgtaactcctgacctcaggtgatccacccacctcagcctcccaaagtgataggattacaggcgtgagccaccgcacctggttgagattgttttttataaaaagatgtggattctttatggaaaacacagagcagttaattgctatttttttaatgtcacaaatttggaagcgtgttgagtctgagaagaaaccatagttaaaatataattactgataatcgcttgggaaataaaagccctaaatttcttcatgcctacaaacttaatattgttttcccaagatcttttttttgactttaacctttcttaagtgtttctgattatgctaaatctaggccattagttctgagtctgtttcattatttatattgttattcagtttactcgtcaaaagtgatcatgcccaaatatgaaagtttacaagaattgccctgaaaactgaacggaaggagacaacgaaaagaaactgcataatattttgccttcaggctatcacaataaaaactgttgctggaaaaaaatgcaatcacatcccttttttttttttaaagtacgtttcaatggcataatttattgtcgagaatgtctctaccagaagcataagtgatactaaaggcagagggttgtattcgctcagtctgcaaagtatcccctttgtcttagctccacacagtccctcagaatttggcagaaatgagggactcaactttcgagaaagggtgacaatcccagttttgttggagagctatgaaatagccccatagtgttagtaatgaaaattcacttaagaagtctcctgcaggcccggcacggtggctcaggcctgtaatcccagcactttgggaggcctacgtgggtggatcacctgaggtcaagagttcaagaccagcctggccaacatggtgaaaccccatctcttctaaaaatacaaaattagccaggcgtggtggcgggcacctgtaatcccagctactcaggaggctgaggcaggagaatcacttgaacccaggaggtagaagttgcagtgagccgagatcgtgccattgtactccagcctgggcagcaagagtgaaactccaccttggaaaaaaaaaaaaaaaaggaaagaaaggaaggaaaggaaggaaggaaggaaggaaagaaaaaagagaaagaagtctcttgaaaaaaagaaaggaagaaagaaagaaagaaagaagtctcctgtataaaaaaaggaaagaaagaaaagaaggaaggaaggaagaaaagaaaagaaaagtctcctgaaaaaaaaaaaaaaacaaaatataagtgcttgacaactgaagttcaagggtaaaggctattgggaaagcagatgaagttaatctaagtaatggatgctgttggtgccccagtcagattcgttcactgggttggtgcacccattcctcagtgactctgagtattagctgctaaagcctcatggtttcacccctttccagagaacctccctcagccaaaaggaagccaccttgactggcatgtcccaccacaccttctctcttaaaaccaccaggggtacaaagggaaaacccctttgcctcatcatggcacctgctgttgtacaatttgtgatctgggaattcccatggggccagattgatgctggtctccagcccataccacatcccaacttaactttcttgccctgtcttcctgcttctctcactccctttttcttaagagcactcagactctgcttctcttaaacctggctgaaggcagtaggtatctgaaagaaaagctgtacctacattctgggcatcagagcagtcagggaaccaaccagaatgaaaagtcaaaaattacagataatgatggaagtctctgagcctgatacatttcatgaagggcttgcttacagctcaacttgtgtttctttttaattgtttcaacagcatttgagtagctcattccgcccaggtatttgagagattccagtaggcctctgatcctctggaaaaagcaagatacagtccttgactctcttggccccatgaggatgatatatctgctgagaaatgcaggagctgcaaaacatagctgggctgtacctgctgccaattcccgggtaattgcattctgtgagggcttccctgaaccacgaggaagagccccggaataagtactaaacaccagtatttataggacatgatttctaattgctcatccttgccttctcatgactagctcagcatgaagaatgctgggacttttctttcctagcacctcctctttttaggctgttttccaagagtcttggttaacaaacatttgtttgacaaggattcatggtagacagcaatgccattagtccctacttaagtaatatttgtaacataaatttctctgcacgtgtatgtagcccaagaataacacttcatttttggaacctagtaattttgaattcctagtaagtgagataggacgtctatgagttagcaggttaagattttaggaggaatatttaatatccctaagaagggaagtttttcaaacactgagtagcactatatatatttatatatatatagccagatttctatctatctatctatctatatatatatatatatatatatatatatatatatatcacaccatttataaataaactcataagtggcaaatccagtagagctaatctgagcatcccagagtctcccctctctgtcgcttgtttgtgcagctactcctgctgtggccttttatggattatcctggacttctacaactgacccctctactttctctccatctacaagcttcattttgctttgctttcctcctaatccagtttagattccacagtatattttttcaattacatcctggctaatatcgaaactcccttatccctaaatgtgtgagccacagtcatctgacgaaaccccaaacctggatcaactgttttccccatgcttacatgcaacactgttggagaaaatgagaaagtcaggcagattggttctgctaaaaaatgttgaacctcatcctcaagtgggccctcaacactgtttgccaacctcattacatctcttaggtcaactccctctcacagtctctattacgattaattcaaatgttcccacttacccttaattcatgttttcattcagtgactattcattgcacaccaggcactgcacgctatgccaggcactgcagactatgccaggtctgttgattcctacttcacagaggaaataaaacccctccaagcagaattccctcaatttactctttctagtctttccaactgaccttctgtgctttgcagtaggaatgttctcttaactgtcaagtcaaaattcctccctcaaaaataagattcccttgttaatagacaattcctttattttcttagaaaagtagtagatgactataattttaaatgtgtatttgaacaaatccttagctacataaagataagcaaagatatgacaggcaatttaattttatatgaagaaaaacttattatatcagacttacctatcattctaaatcagtacttttgtatctataatcagacaacatttaatgaactgaaaattctgcctgtgagaaactagtcataataaaattagacttggtttgctctttcatggagaacatattccagatgtttaagtgattcaaagaaaacccacaatataatggctttcttcaatgttttctcacttactgcttccaaactagaaaaaaaacctaatgcaatcctgatatcacttaaatagcacctcgtattgctcagcgttaactgtgctttttgacattttaggtgtagtgtttaataatttaaacacaaatttatgtgtgtcatattaaaagctctaatctgtgaaatatagccaaaccaatgtcacatctatttaaatagcaaagtacctgtgttcaccctttacagggtgaaggtcttgtgactctgtgtttaggcggccatacttcttgttatgtatgctgctgggcactgagagcccacagtggtgagccatccttgggtggtaaaagctgctaccaaaacctaaatcaaatgccaaagtgaagactgacatgagcattctcctgcctccttttcctttttatctttcctaccatctgttatctcctttcttccaccttcatgcgttgagtgccctcatgatgatttctagctgactgaagtcctttagtctgctcaaccccatctagagacttccccaaagtgaacctttgcccccagttatctgtttatcaactgacctcacaccagtcaaagcttccattgtcaaatattttaacagaaatttaggaattcagattaaactgaatatttggcattttttcttttttttttttttttttttttggagacagagtcttgctgggtcacccaggctggagtgagtgcagtggtgccatcttggctcactgcaacctccacctcccaggttcaagcgcttctcatgcctcagccccctgagtagctggtactacaggcatgtgccaccacgcccgaataatttttgtatctttagtagagacagggtttcaccatgttggccagtctggtctcgaactgctgacctcaagtgatccacccatccacccacctcagcctcccaaagtgctgggattacagtcttgagccaccccacctggtctgggttgttttcttcatctttagcagttgtcttgttcacaactacttcaacaatatttattttctttttctttttgaagcaactctccagagtatttggcctggtttttatagaaataataacttttttcttttctttttaaactaatatttttatgatttaggaaatctttctttattaaattacataatcacaacagttactggcaaagataggtttgagaacatacacacaactgacggttgtaacaagtcaactgatgggagcagaaggtccacacatactgacaggcacctcgaacattttattgaggctgtgagaggttcccatcactgctgtttcacaaagagaatgaagactttggctaatttggtgagtcttaagtggagattagttcagagaacttccactatcattgcttgaaagaagcaaaaaaaaaaaaaaaaaaaaaaaaaatcccaagatcttatggtaaagtttaaagaagaaaagtaaattttaaaaagaaaaaaaaagaggaaaagggagagcattgcaattaattatgagtaccaaaacttatttttgaatccccttcatcctccaaaacattgaagcaggattaatatgtgtgctcaggaatttgggagagaaaatgaaaatcaaaatattctaataagagacatttgaaaatgtacattgtgtcacctaaagggaactgaaatctagctatggcttaacgaggtaggataatcaacttaatggcttgagagtcttgcttgtaaagagagatgattagcacaaaggactcacctgtatcactgaaagatgctgcctgctggcttgccctctctgcagaggttcctgtttacagtttcccctcacatgatatttatttgtggctactagaaatgcacgttattatccagaagagaatgatttcattttgtaaccgttgtccttgtccaagtttcccccattgacatttaagaaatctgttttctaacctttctattatgcaaaacaaaattaatatggatcatttccttttagagataagtattcatatatatggatttaaaccacctttctccatgggcccttattctgatacttttaatccatgtatttattcataaggaaatggaacaatatttactatccacccctataaaactttctgaatttcacactgattccagtgacattccactaacacgaagttgaatacagatgaatacatcacatatgattttttttttgcatgtgtatggtcagaaggggctctcttttgtttgtttttattaatatataattcacatactttaaaattcactctttcaaagtgtacaattcagtggtgtttagtatattcacaagattgtgccaccatcaccattgtttaataccagaacattttcgttatcgtccaaaagaaaccccctgattgcttaacgtaatgtttttaatgaccactttttaaaactttaagttcaacagagtgattatcacaatgttttgtattatctaagaactacacaacagtgttatgctctatacagcaccacggtttactgatgaagtattcaggttgatttgagaggataatgtcgttcttattttgaatgttcatactggctccttttatttggagtgggaggaaatgcaaggcttataaatgaggtcagtgtaaccaatggttttatcaacatagtgaaccagacagagaaataacacctgcccagatcaagcaagtcaaaacaacacgtatagtcaagtggtgctgtccttgtacacagacattacattacacaaactgttctcctaagtgagggaatttgtcccttagaaattgcttattggaacatttggacatcatgcatcatgttaaagatccataaatgccatctcgatagggtagatatgaggcgtggtaatatcctccccatatctgcatagggttcttctgctcaacggattgctatgatgtattgcatcagagactcctgctctagtgcttcaaagacagctgagaagccccacgggagccttctgaagtcattgctacaagggctaaaataccaggagatcaggaagtcattctgaggacttgacaaaataccctactccctaaatgaaactgttatgatgtggttggtgcaaagtatgcatgcaatattttatgactgaatatatctttctattgtaaaaaataaggatccatttctggttgtgacatgagtagaatttagaatccagcagcaatatatttttcttgttactttgccaatccagaatttcttaggggaagcatataacataatagttaagaatatatattctagaggcaggcaaacctgcatataggtatcccaggttcctcaatttttacccatgagagcttggcaaggtttgtttgttttgaaaacaaacctctgcaagtttgttttctcatgtataaaattagaattctccaactactggcctcataggattgttgggtagaaataaaatcagtttatgtatgaatagagctcatcatggcattaggcacctaggaagtgctcaacaaatagtagttatcattattcccccattaacaaatatccattgttataatactaccacaagagactgtcttagtctgttccagctgctataatagaaatgccataaattggatagcttgtgaaacaacaaaaacttatttctcactgttctggaggttgagaagtccaagatcaaaataccagcagatttggtgtctggggaaggcccattcctcatacaaagcaccttctcactgcaccctcacatgctgaaaggagctagctagctctctgaggtctcttttataagggcgctaatcccaaaaatcacctccctaaaggccccatctcctaataccattgccttaggtgttttgatttcgtttcctttttattttttaggatttcaacataggaatttgaggggggacacaaacattcaaaccgtagcatagagcaaacattactggcactgcaccctaaagagaataagcccaggtatcagttcttcttgttttaaatattctcatcttccaatttgcttttgactattgcacacaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtaagcacattgtaaacattgttgtcctttgttacagtaaaataatatacagataaaatttgtaaagaacaatgaaagtacttttttcatgtaatgttcatggtaatatttgtgaggataggatattttatattagtttataattcccatctaaacattttcaaattattaatattaattttggaagcaactaagacttagtatatgtcttagtctgtttagtgttgctataaaagaatacttggggctgggtaattcataaagaacaggtgtttatttggctcagttctgcaggctgtacaagaagcatctgcttctggcgagggcgtcaggctgcttccactcatggcagaaggcaaaggggagctggtgtacaaagatcacacggcaagagaggaggagaaaaagagggaggggaggtgccagttctcatgaaaactgctagagcaaaacctcgctcactaccgtgagaatggcaccaaaccattcatgagggattcactcctacaacccagacaccttccactaggcctcaccaccaacacgggggatcagatttcaacacgcgagttagagggaacatccaaactctgtgtagcagtattcttacgataaacagaaaataatgctgaatcatgatggaagatgtgaattgccaccatgcagttcctttgtactcttactgcttggattctcaaaaacatctttccctttagaatcctaatttaaacaagagtcaatagtaagatgtgtccaaaagtcatttaaagaaagagcatcctatcacaaacttacatgtggaagtttttcgtaggtttgcgtaataaatacaggcaatgtaagtgtgctgctcaaggtcacacttactagccatgggacctggagcaaattacttaacctttctgagcctcagtctttcatcaaaaaaaaaaaaatgcgataataaaattctctgcaatatcagtttattattaggatgaataagtcaaaataaatggaaagtgctcgggagcgaacatgccaaatgataaacactctacaaattctagctcttgatgttgttattattattattattacagtacacaggttttggaatccaacatattagctgagtgaccttgaggccacttaatctctgtggttgtccatttactcatctctaacatggttactgtaacatcgaatgagttaattcatgcagagtaatggttgtagtggtggaagaggtgcgtctaccttctcagtgtgaaggacaccatgttataccccaaaaccctaaaattagtttaaccgtagaattagagaatcattttctctcctttccaattttctcctttccaacaggatgcagaaggtatgcctctgaggaaactgggtttaaaactatttggttttaactttttaataagaaaaatataataaaccaaatcactttcctattgtcagtccatttaggggtgtgattgagaggcctgttaaagaattgctagatctttaataaagataagttgcaaatcccagacctcttgagatctcacataatttaattcttgttgtgatggatagtcctgaaagatttgtattctagattgttataagtggcatcgactaaagcaaggcgatatagctaagtgattatatgcctttctctgtttgctccatagtagttgagtactattaaaattttatctgttccatccttagtatgtttttcatcttaagtataaataaggaaagtaataaatgtccaaagaaaaccaatggccacattagtcccatataagtgttctagaagtatattttataatttcttttagagagcagaatgccacgtttgctttcagaacgtggtaaaagatttgtgacagtggcaggtagatttccaaatgaggtcaaaggattatgactagtaagaaaagtttttttttttttaatcaatgctaagtgatccattctagttgcactatttatttgcatttaaggtatcaaaaacagtaaatagcttactatgtagccattctttacaatgagtaaaaacttggttataagtacaggaaaacacatgtaaggagatagtatgatatagcgaaaagagcattggattgactattaggaggtctaacttcaaacttaagctcagccattatttgaccgtgttattgtgagaaagccatttaacctctctcagctttaattctcctcatttttaaaatgcagaaatctattttgtctaaggtcacatacagttcaatcttatgattctgtctctagatatctgggggagatacacatttgacagaatttagtttaaaaccaatgaagttcctttctttattcataatacaaatgtggtttgttgaaattatatttctccttgtataactctaacttttaatctcttcttccctaaacccacatatacacagccttctcctattaaacagttcagtttgtggtgtctgctctatattgtagcaaatttcatgtttctatttttgaacatgaccttaaagatatgcttaaaaagtgtttttagcagaaagctgataaatccaaggttttggtttgcatataaccgagtcaagttagttccattcttttctttgatagtaattctgctacattataaatgtgaggccttgttcagaaagagaagaaagcaagaaatgaggttcacatcaagcaatttttttcccattactggaaaagcaattcatacatcctgttgagaatattttatatttagaacaatgtatgtgaggctaacgcattatccaagttctatggcgggaagcttgagcccaccaccattatgacatcatatttttttaaatagtaaatgtcaaaaaagacatatttctatgaaaataaagaatttagtcacaatgctatgtcaatctttaaatcgtgataaaaaccaagtacaagttcatctttgcctctgtccactaagacaaagaacaatcaaaaagtaaagaactctctgggcatggtggctcacgcctgtaatcccagcactttgggaggccgaggcaggcggatcacttgaggtcaggagtttgacaccagcctgaccagcatggtgaaacctcatctctactaaaaatacaaaacttacctgggtgtggtggtgcgtgcctgtaatcctagctactctggaggctgaggcaggagaattgcttgaaaccaggaggcagaggttgcagtgagctgagatcgtgccactgcactccagcctgggcgacagagccagactcggtctcaaaaataaaataaaataaaataaaaatagagaactggagtagtagaaaggcagatgtaaacctgagaaaagaagaagagtcttaaatttgggcaaaatagtataatagaaagattagagttacatactatcaggccgtgtctacttgatatcagaatatcctgggttctttgcattatccattcatttaattttcaaggaaagccatgctagttttttagctgtctgtaatatcagtcaaaatggtgaaaccagttaagggatgtgagcaccaacaatacagtcaaacccagtcacaatttacctatgtatagaatcataatgtatagagaattccaaactgactttgaatcttctaatagaaatgtaagagacattggtttgcctgtttgaaattttctgtgggaatgaagtcctattttcttcctcaaagtagacacattggtatgcatgttactatttgaccatttgactttttgtggtgtaggaaaccatcactccttgcagttagaaaaagtcctcatgtgcattctctcatctaagaatcacaaccttgtgattttgtattatgattatgattacctattatcattattcccttttacgtgtaaggaaaccgaggcttagaaacatgaagtaccacagtcacagtcacataacttgtatcagtcaagatctgagtcaggtttttcgaactgctattcccatgctctttttgtctcctcttctcaaaatcctattacgtttggacttaacaaagcaataatggctgggtgtggtggctcacgcctgtaatcccagtactttgggagggtgaggcgggtggatcacttgagatcaggagttcaagaccggcctggccaacacatagtgaaaccccatcactactaaaaatacaaaaattagctgggtgtggtggcgcacgcttgtagatcagctacttgggaagctgaggcaggagaatcgcttgaacccgggaggcggatgttgcagtaagctgagatcatgccactgcactccagcctgggcaacagagcaagacaccatttccaaaaaaaaaaaaaaaaagcaatactttaaaactattttggacaatacaggtgtaaaatacttcacttttttacatgtatcttcttttttgaaatgattcttaggtatattaacttttaaatcttccttttataaaccaatggattaatgaacccagttcagtgtaccccttagaaatcacacttgtttcaaatataaaattttaaagcattatattcctcattgcctttagaactcagcaattgtactaaaatcagccaaaagtgatttcagtgaatcagctcttaaagccaaactaatgctaatatttgaccaagtagaaacgaatatctaaaccaggtgagaaaaaagttaaaatgatgataaacctttctaattttgaaatagtacacacactgagtaatgcagtcaatctctttattcaccaagcgcaagtagtatataaaggaatattataccatttttctttactcatgagtaaacccacaaatagcacaaaagctgcaaaaacactttaacataaggagtatttgttttattgactgtaggaactcatggaatgcaaacacctttaaaatctgaataatatgaaggcatttccagctattagattctttacatatgtcaaagaacagtatcataaattatgtatgttttttaaaggtttcctaagcttcttccaaagtcatgtagacatcattacactccatctgtatacctctgtggtaacttgctgtcgcagggatctagagcctcatcttttgcaaacttcattccttctttcatccctttgttctttcattcagtcagcactgattgagcatctactgtgtacctagaagacattgtaatgatcctgtttggtccaaggacatactaaacaaaactccctttactgcttatgctatattaagtaaagctttaaagatgggttctcttttattacttccatgatggcccacccctctcatcctttctcagtgttaaaaaccagaaatatacatacttacatactatcataacactgatactacaaaagcagtacccattattatctctggtttacaaattattcaataatttcttactggaaacttggtctatatagtcatagtagtaagctttgtgagaggatgtgatgggatcatagttagctaaacaataggagtatttgtgtggcttcattttaaaaaaactaaccagtttttttccaacaagcaattcttatatcagaaccatttatattctttactttggtgagataggattttctaagcaggtcttttatctgtatctatgtatgtttgttcttaccatcattgagcacaggatttgatcctttaaatgtgttgacagattttgaacattttcctcatatctttcttttttgttttttaatgatcctgtactaatcattttgcattatggggtcacttctggacagagagcctagccatctgctcttacaaataatgtcggcctatcactaactggggataaggagaagacatctaccgatgtctttctagcatgtccttcttgactttttctttctttaagaagactaaaatgattcagcttgtggttctaccacagaactcaggagaaaatgataaatatgaggccattctccaaataaatatgttttcctacattagtggttctcaaattttaacaagcatcaaattcacctggaaggcttattaaaacacagataactgggctccacataccaagtttcaaatgattcagtgggtctggtgtggagcttgagaatctgcatctctaacaaactttcaagtgaggctaatgctgctgaatcatggaccacactttgataacccctgttctatgttaagtacttgtcaggtacagacaaatttaaaagttaaaaaaatatatatatgacttctgtaagacactgtgaagggtttagactctggggaaattaagtataatgccatcccaaaaactctgtgttggaggagtgttcaagtgctgcaggatcatggagaaccaagcacttaacttttctatgaggcagaaagaggaagataaagggaaacgtggaggatgaagggaaactgttaatagatccccagaaacacaatttgctgctatatggatttatatttactgtatttcaaatcacatggtctagaactgtgctgtccaatatgatagctacatatggccattgagcccttcaatgtagccagtcgaaagtgagatgtgtagtaagcgtaatatatacacatgtaatatgtatatgttatatatatgatatagatgtaatatgtatgttatatatatgatatatatgtaatatgtatatgttatatatatatatatatatcaggatgcaaagacttagtaccaaaaaaagaatgtaaaatatctcattatttttatattgattacatgttgaaatgatagtatttttatgtatttgcttgggtaaaatgtcataatgaatttcactcatttattatgattattcaaacttggttatttttcttgaaaatgaatgaagtgagcctgttgcttcggctacaacaatgggcagtgtttctgcaaaatttttacatgtgcctactagaacatttaaaattgtacatgtagcactcattatatttctgttggatagcattggcctaaaagttttcaaaatctagcatggataagaatcacctgcaaagcttgttaaaccaatccgcccccagaaatttagtatcgggtgaggcctgcaattctgcatttctatcatgctcccaggagatgctgtctatttgtaaccacatatagaaattcattcccaaactacagatgatagagttttacagagaggtgcaaaaatatatttttgcatcaagcattgtctgtagcttgaatacaaaattatgttgcccatataccactggtttttgtaagtaaagcagttgtgttacaaagcatacaagtttttatcagctaatagccttttctcaattagcagatactaagtagtacttttattatgtggcaattctccagtttttggaatgttattgagaaatacacagggttaaaacaaattagaaagcacctctcccaaaatactgcagtaagatgtaggaaaaactgctctaacatattctaaactataggttgctcttatgtaaatatttcaactataatatctagtctgatgtgcccactggccagagttttgtaaaagctaaaagtaaaggaaataaaaaaaagaaagaagtatgtgtttgtttttgaaaaggttaggtcacagaaggatttgttgatattaggaatagaatgacccgtgaaaaaaggacaattaagttccaggaaaacatcttttcagtaaggagagaataatcatttatgcttaacctcaactctgttaggaaaaaaaggatgtaaacaaaaccctttaaagaattgaagaaggagagtataaatttaaatgcccaggttagtgaccacccttagagcatactgaggtcaaagcgtactgtcaagcttaagaacatttggttttcaatgtttgtacaactaattgtactttagtcaagaggactgttatcgaaattgctcaggtagccttgaaactaatatggcccaaatattccagagtctgtctttctcaccctaggagaagaatggtctggttttcaagggaattctctattttttttttttgaaggcatcaggatgtgtgaaactacagggggataaatgaacgatgtacagaatgtgatgaaaaaattatatgaagtataaaatgggaatgaagccatcaggagccaaagaaatatttatgaatttaagagaatgaaaagcatattattattttcagatattttataaagtgaacccaaatcattataaagtattaattaggctacttgattgcttgatctttatatactaatttctaatttgttttaatcgggaactatttttgctagttctaaggctagctattatggtaatccatgtaagtgtgtttattattgtttttaaaaatggaatgtgttcctagtaaatgtgtttaaatagcaaaatgtatttatgcatgcatgtatttattttagtttcctgagacctctagttccttactagaaacatgtatataattccaggcatttaaaattgccatgatggtcatgttttcttgtccttttcccttattctgcaactgacatttgcccttgtctccaatttctcactgctttattctttgttcttgtaagtgttcttgtctctctgggctgacctctctccttccctggagtttgaccccgccccaccctttcttctgcatttgtttgcactggttgttttcttcattgcctttcccactgccccgctgcgctgcatgtgaaacactccgccagtagctgctcacagttcccatgctacatcatacccagcattcaaagagctgctgttctcacatggccgccagtaagattcccgactcctccttcacagcacattcctctagaaagtagaaagaatcccctttcaggccacatgagaagctgcgtgttaaagccaactccataaaggggaatggaaactagcgtatgaaattcagaaatgctacttttaaaggtaaataccacaaagtgaatttcaaattcatacagtttatcataatacttctttatttttataaatgctataatgtccttaatataatgatcactgtgatataagttgtcctctcccttaatatattaattaatttactaaaggagacgggagggtggaaatataataaattagaagatgattcttatatcagaagtacagcctttatacatagttttactttattcagacaatcaatgtagtcatatggtataaatttgaaaataattttagtgagcattacgcttactgagattaatagtgagaacttacctagcacttactgtatgccattcacaattataagcacttttgcatgtgctaatgcttttaagcctcacgtaacccagtgagggaggtacaattttaacctcattttacaggttagaaaaatgaggagcccaagggttaagtgacttgcctgtggtcatatatcaggtaagtgagagagccaggatttgaacccagacagtctgcctggggaatctgtcagaactcctaactatgcagtaccactcctctgataaaaagttgaattgacatgacaacatttcctattcatttatgattcgaccctttaaacaaaaagaacagcatcattctcacatttattaatttgtcaggaatcacctggatcatgagttgaggaaatttaaagtaggagggttgtatgaatttcagaccacgatctcaagaattgcctgtttaactcagagcctgaatcattcacagactaaaaactagaatcactcttctgtaggaccaagagggttgaatcatcaaagtcttgctgaagtgaacggaaatcctcctttgttcaatcattcattcaataattatttttttctggtgtctactctttaccaaactctgtttgagatgatagggattcagtcatagacagaccttctctgccctcatggaggttatggtttcttgggatgacagacagtaattttttaaatctcataaaataattacaaatgtgtcaggaaagaaaatacaggacactaccagaatatatagtaaggacctaaatgtgtgtgtgtgtgtgtgtgtgtgtgtgtgtgtgtgtgtgtgtgtgtgtgtgtgtgcgcgcgcgctgcagtaagggtgagaggcaggaaagggcaatcaggacaccctcccaataaaagtgacctttgaccgagatctgaaggatgaagacaagctgagtgactcttctattcatctatatcttttgttttaaatggcctgaagcctgggactaactaaacagggttgtaaaattccagtatgtaaattgaataactagggatcatttgaagtaatggactgcagagttaatgtataattaagtcacatctagggaagatttcccatcattatcacagagagcatcctgtttgctttcttcacagcacttacgaaaatctatagctatgtgtttggtggcttgtttaatgaaagtctgtttcccctatctgaatgtgagctccataaggacagaggccctgaataccacatctactgacatttggcagtgtctttcatatagtaagcattctataaatgtcttgaatagatgaatgcataaaactaagttaaaatgttactgaaaactataaaaataagcagaaagttataccagaggagaaaaattaggggaaaaaaactataatttctgaagacgtagtacttacatctaaatttgtggcttcataaggttaaccaacacttaaatagttttgccaaaactccaagaaaaaaatgaccgggtgtcgtggctcacgcctgtgatcccagcactttgggaggtcgaggtgggtggatcacctgaggttaggagttcgagaccagcctggccaacatggtgaaaccctatctctactaaaaatacaaaaaaattagccgggcatggtggcagacacctgtaatcccagttactcggaaggctgaggcaggagaaccacttgaacataggaggcggaggttgcagtgagccgagatcatgccactgcactccagcctgggcaacagagcaagactctgtctcaaaaaaaaaaaaaagaaagaaagaaaaaaaagaactaccatttgacccagcacttccattacttggtatgtacccaaagaaatataaatttttctaccaaaaagacgtgcgctcatatgttcattgcagcactattcacaatagcaaagacataaagtcaacctaggtgcccatcaatggtggattggataaagaaaacgtggcatatatgcaccatggaatactacacagctatgaaaaagaaggaaatcatgtcctctgtagcaacatggttggaactggaggtcattatcctaagcgaattaaagcagaaacagaaaaccaaataatgcatgtgctcacttataagcaggagctaacctttgggtacacatggatgtaaagttgggaacaacaggcactagtgacaagggcaggagggtgtgggacaagggctgaaaaaactacctatcgagtactatactcactacctgggtgacaggttcaactgtactccaaacctcagtgtcacacaatatacccatgtaataaacctgcacatgtaccccttgagtctaaaataaaaattgaaatctaaaaatataaaatatcaaatcataaaaataaataagaaaacaattgaatctactgatatgtttcattgcttttaaaatatccactttgaattactgaatattttaatatttttagttttacacttcagcacagaaagtccagaaatccaacccttgagtttacaaagacaccacatgatagttcatagttcacacagctagttagttgtggaactagaacccaaaatttgctctctatgtctctcacataccttttccctttattctaataaaggcatttgtcagtctaaatgtacaatattcgaagacattttttaaaggaactacttatccaaatcccacctgtcttacaaggtccatgtgaagcaatgagataaggtctgtgaaactgcttccgaaactatcaaatgttataaaaatgttaagttttattattagaactgcagttcatctctatgaaacctttctaaactttctcacttttctgaacttgactacgcagcgtcttttctaatctatttgttctccctttataagaagaatttaatcctttccgccctgctgggttgtaagaaaaaggactctcttcttttctataatctattgatatttgattatattacacatctaatgggttcccaataaatacatagtgaatagaattgaaccaaatttctttctagacatgtgaaaaaaaatcctgatctttaaatagaaagggtactttcaaagattatatatagaacctcttggtattttgtatttgcaatgaaaatattttaatttgggccaggtgcggtggctcacacctgtggtcccagcactctgggaggccgaggtgagcagatcatgaggtcaggcgttcgagaccagcctgaccaacatggtaaaaccccgtctcaatcaaaaatacaaaaattagccaggcatggtgacgcatgcctgtaatcccaactactcaggaggctgaggcaggagaatcacttgaacccgggaggtggaggttgcagtgagctgagatcatgccactgcactccagcctgggtagagagggagactccatctaaaaaagaaagaaagagagagagagaaagaaaagaaaagaaagaaaatattttaatttgtcttatgttcaacagttgcatcatatctgcatccttttgttaaaattgaacaggcttctagtttcatataataatttctggccaggcgcagtggctcacgcctgtaatcccagcactttgggaggccgaggcgggtggatcacctgaggtccggagttcgagaccagcctgaccaacatggagaaaccccatctctactaaaaatacaaaattagctgggcgtggtggcacatgcctgtaatctcagctactcgggaggctgaggcaggagaatggcttgaacccaggaggcggaggttgctgtgagccaagatcacgccattgcactccagccggggcaacaagagcgaaactccgtctcaaaataataataatcataatcatcatcatcataataataatttctaccaacagctggcaggaaaaaaatatgagagcatagtcatgaacttcagattccactccccttacttttggcattccattcctctgaattatagcttatatttctttattatctcagtttgatttagtctttctaaatattcacctctgtttccatccataaatatcgactgaactaccttttaatatactatctttttgtaacagagaaaatcaagtgtaggtggattattgtaagtgacactgaggaaatataaaaagaccttgacttgtccaggcgcggtggctcacgcctgtaatcccaccactttgggaggccgaggcgggtgaattacgagatcaggagatcaagaccatcctgaccaaatggtgaaatcctgtctctactgaaatacaaaacattagccgggcatggtggcaggcgcctgtagtcccagctacttgggaggctgaggctggagaatggcatgaacctgggaggcggagcttgcagtgagctgagatcatgccactgcactccagactggtgacagagtgagactccctctcaaaaaaaaaaaaaaaaaaaaaaaaaaaagaccttaacttgcttcaaacaagtcaggacccccaattccaattcttaggtctggcattcccatcagacacttaaactgtaggggcagtaaagttgcccatgtggctacagcttttgtggctgtgctgtacttgggaattttaatgttaccctctttgaattaggtccttcattgatcatgcatctcaaagtatctcagtgccacataaaaattttctttcagagtcatattttcccattatgaatgctacctactgcttatctgttgagtgtacacttttaaaccttctgtgggtggtggcccctttgccactgggtgagttagatgctgatcctggtcattatcgctgcctttccagccttttctgctcttacaccaagcacaagaattctctgctgatagtcaggatctagggctgggaaaatgggatgagttgtcctgttagacaggcccaaaaggagtattgtttaatccccagggtgtggggaagaaagatactcttgttttcttttccccaaatgtgtccatatacacccttctcctttgctggcagccaccaggcttgttgaggatctaccctcctctgcatatcatgtgcatcaagggaagccccaacccaagggaatacataatgatagtcctgagctatttcatggtgctctcgcagtcttgattgccctcttcggaattggacatggtcatattacgcaattttaggtaataaaatacaaagggcattcagctaagggaccttctgagaaaggtttttctcgtctagagaactaaacaggcatccttctccgggcactatgcgtagttctttattctacctggaacattctttctccagaaatctttgtgactaactctgtcatttccttcaagtcttattcaaatctcaacttaaaaaaaaaaaaaaccttcttaaaatttgaccacactaattagacagcaactgccccatctccctcttcccagccatctgaatccatttcccacttacctttttatgatagctcttctaggaaggcactccctcctccctgtgaatcatgtctccaggcaattgttccttgtgtagaggaacacaccaaatctgggctgctcctgtacaacaaactgaaggaggtagaattgattctgcaagaagttcaaagctaaataagaaggagtcttgtagcttctgtcttggtcttctggaatgctcactctggggaaagtgatctgccctgtactaagtctactctaaggccactgtgctgtctacatgaagaagccacaaatctaagctagccacatggggaagctgcatggaaagacaaatacgtggctagcccccagctgttggccgaagatccgcagccatcccaagtgaggagccagatgtacaagtgaaaaaactgtaacagccattccaatggagccttcagatcaattcagctttggctactatctgactgcaaacacatgaaagaacccaagcaagaaacacccacctgagcacagtcaactcacagaaccatgagcaatactgataaatggttatttttagccagtaagttctagggtgatatatagcaaaaggaacatctgtcctgttttttctggtttttcctatcatacactcattctgcaggattaacatgtgtaatatactttttttttttttttgagatggagtctcaatctgtcgcccaggctggagtgcagtggcatgatctcagctcactgcaacctccgcctgctgggttcaagtaattctcctgcctcagcctcccgagtagctgggactacaggcatccaccaccacgcccagctagtttttttttatttttagtagagacggggtttcaccatgctggccaggctggtctcgaactcctgacctcgtgatctgcccgccttggcctcccaagtgctgggattacaggcatgagccaccactcccggcctaatatacttttttaaattgtctttcactatgagaaggtgagctccatgaggccagggatattgtctgttttgttagctaatgtatccaaattacctaagaatagatcttagcgtggtaaatatttgttgaatgaacgagtgaatagatcagaatttcagtagctacgttgtgagtatgtggacagttcaccaagaatggcagaatggaaggatgggaggaacctggaataatgtcattgtgcttctggattacccagtcctggagcagctttgcctctgtgggccttgactagtcaagacattttgtgttgggtttttatgttaattccatttgcatcactataaaggaatacctgaggctgggtaatttataaggaaaagagatttcattggctcatggttctgcaggctgtacaggaagtgtggtgacagcctctgcttctggtgagggcttcagcaagcttacaatcatggtggaaggtgaaaggagaaccagcgtgtcacatggtgagagatggagtgagggggtgggaggtgccacactcttttaaacagtcagatcccacatgaactcactctgagtgagaactcacttattactgcaagaatggcactgagccattcgtgagggatccagccccatgatccagtctcccccaccgggccccacatccaacactggggattacatttcagcatgagatttgaagggaacaaacatccaacccatatcagttttctacaacctgcagcagaaagcatctcatctggcacatggtcttgcaaataattctgacttagatgcatgggactcagatatgactgaaccagaagataaatctaagtagcagacaccacagtattctcaaaaccactctttctctttctcttgttgaccgaggcttttctactgagcaaagcacctggtttataatatgttctttcattacgccttctcctaagagacctccttagtgtccctgcaatggatgtctggggagccaccaatctcttagagatgactagacatgtagccccagaaatggttacaccttgagcttttctctcagtgcagatgagatacattgcccatcccaccaatttgccacatttatctaaatttctgtgttaagctgggacctctaccactcaagctgggatgcccctcaccaccaccacactgcaaaaactaaacatttttcattagcctcctacttgcaattaagtacataaaacctgcaaaacaagtaataaaattaaggcactatttggttaatgccttttctcagaaatcacttttgcatgaagttcagttcagtattttatcagtgactacattagtctcgagaccctctacccaataggagggacaaagatgtacatgacacaggctcccttcaaagatgattaatacatgaactacatacagtattacaagggctccactagagatgtgagccccccagaaatgatattaatgtgcagaagagttagcaataaattttgcacaaggggtgacatttgagcttagactcgagcaatgagtagggttccaagaggtaaagaaaaaaatggaatggttttctaggaagaaaaccaggtctgggaagatctgatataacctgaggtagtttataagtctggaatgactgagttatcgggtatatggtggggaaggcagcagaggtgaaataagtaatatctaagcaaatgaaaaacatgtaattaggggagatgaaatataattaaattatttaccttaattcctcttttgactctttacatttgtcattcataaggaaacaatttcactaagattgttttgacctttttaccttatttggccaagtaaacaagggacagaaagtttttaatgtaaaatattcattcaacctgaaagaacattgatgattccagaccatttaaagttaaatattttagagttctcaattatttctatttggatgagtagaaccttttttcagacttcaggaatatatgtttagtttttaacagactaattgttcctgctttcatgccagcctcatgggcatcagcaggttcaaggttagtaggtaggaatctgccccctaagaatgcagcctaagagttaaggaatgcatgattacccctgtaattacttgagaggggctctgaaattctggcagggttggtgaggccaccagataacactgatcaagaatgtacacgaggttaggaattcagactgtagctgaagtggggagttcgggtaaacaggctctgaatggaaaagatcaggaattcaaatagacagttaagtcaagaaaccaacatcttagaaatgtaaacctcactttaagtcaaaggctctccaagctaagacttcataatatatttgccaaggcaagagctagtatctgcttacctgagtggtcctggagctgcggccagttgaaacaggagattgcagatggaatgtcagttagaatactttcagaggccagtaacagatacctgactttaaagttcttaagtttgtctttcccaaggttttctggtcataagaatcaccaggggcacttgattaaattattaattcacaagccccttcactggagattctgatgcaatagacttgggaatatatttttttttaacacgaactccagtggaatcaggcaagaagtgaaaaccctatcgttaataatagacacattagaaataatagagacatttgataatctagcacagttcccaaactttagtatgcatcagaatcccctgggggcttgttaaactacaggctggcaggctgctcccagcgtttctgatgcagtaggtccagcgtggagtccgagattctacatttctagtaggttgccaagttatgctgctactcctgtggtcaggaactgcactttgagaaccactaatcaaaataaactgaagtccaaagaccatcagacctagagctggttaattcaacagattagctatatcaagacttgaggtcagcttctctgggattctcttgtctttttcctcatggtcccaagatggcttcccactgcgccaagcaacatatccgcagacaacaataaccaaggcaagaaggaataaggttcaaggataactgtattgtgtgcgtgtgtgtgtgtgtgtactcatgcctgtgtgtctgtgtttggaaaagcaaacgtttcccagaagctccccaacaaatttcttcttatgtgtcaactagaactggatctcactgaacctctttaagccaatcactggctatgagaaacaagcttactgtgattggcttagaccagattttaattttttcctcagagctgtgtcctttgttgcccaatatctgaacataattgagcttctttaccaaggaacaagaagtaaatagctgttagttaggcaaatagctgggtatgtccacaaatgggttctgaaacaagtgtgattataatgaggttcagaattgaaaatattagtacaaatgctagtaaataatgtatgatattggctttcttatcaccatttgcaacagaataacagtctcatgaagaatttggcacagccattgtagaaaaagtgccttttcagagctcacagtatgcatgtactcatcttgcttttattatacctgtatatggaattgcaagctgtcccttcaggtaatgaaatttagacaagttggaacctgtataacagcaaatcaatactgaaattataggcaaagcctgtacttgtgcagactaacacataggatagaaagactttgtgatcaaaattcaacaaatcccacatttataggtatccaacatagagagaaaactatatatagtggtgtgtctttttatgtgtttgcgtttttctccttattcattcctgaaagtgtattttcttttaacagactcacaactcagctacaccccatatgcccacagtcaacacagtggaaaactgagttgtttatttgagcctcaagtcatccaaatacttcgttaaacgttgtagtaaaaggtctcccctgaattcaaggaggatgccctaagttttctgcatccttttgatagaggaaagtattaactaatgtcagactatctgttgttttattttcctttacagcactagattttgttaaggacattgataattttgaaagagaagctaagctaaggtgacaaatatatcttctgttggtcaatatctaaaattatgtattatttcttttttgactacaccttacagtggttagtttgcactttacgtaaaaaactgatgtctaccatcttccatctttgtaagcaccatccagcctaatagttgttggtttgaataatgccacaagctttgtccagaaaccaaaaacctgatttccaaagactagtctatgtagctgagcccttcattccataatcattaaactatggttaggacacagtatccagtctcccctcaaccttgtccaatcacagtctatgcagagatcatgtaactcgattaaaatctagaaccatagagacatttcccttccctggggcaaatgggaattgcacatgggggaaaatggtgtggataagcaaaaaacggaagtttccaaagtgcaacagaatattgataattttagtacatttcaacatacagtgagtgtaatgacggcattttcctactgcttccttagttgtgaagattttgttttttcttctgggttcactgccgggaaaagagcagaaaatgttttagagcctctgccagcagagggggcatttaccatttgtgcataaggtctctggcactgtgccctggggttctcttttctatatgtttctaacagtcacacacagcagtgtgactgtttacagatactttaccgtcttctctgattgaagcagggactggtttgccagcaacttttggttgtttttgtttttttgaagaccatgcaactaacagatgtttgttgttggctccatatctacattctttgaaagctggagaatcaaattgctgacattcagacaacactaattcccatatccagggagcctaatttgccgtccctgagatcctgattcctggtgttcacgggtttaaaaaccatttcagtgacacaatataagaatgggcttgggagatgcagcgctgtctccactaaagataatcacattttataaacatctgcgtcattactggtatgattcatctctaagctgtatacagctgtgtttccagtttcaattaacaatcccttaattgcatatccatctcatgttactaatttagttaatttattcataattaagagtattctgttttctaccaaggtttgtcgagctcagaacattataaagaaaaatattttaaggcagcatctccgagggattttgtttcttataatcacatcacagtaaaatgtcattcatgcgcccaaaggaagatgaattgctaagggatttttttttccagtaaaataagaagctttgggaagctgcagtgtgttgtgtttttaaaccaagttaaatgcgatgcattttgttcttttctttctccttccctgacatcctctcaaaaaaattatcattttatttgtattattgcttaagtatcacagcaaatccagtcaccagtgcaaataaaactgtcattaccctgtcaggtaatggtgtctcttaaaatctaagctataaagtctgtacattttagaggacattaagatcaagaatttttaaattgcctaagtctaagcaagtggagtacacccttgtggaaaatggaaggcagatgaaaacatgatgccaggcagtgaattcattttagtttgatcttttctacaaaaatacatatatccgtgcagcaagagtcttgcctgtgttagtacatgtgtctgtgtgtcattcaaagcagcaataacaaaaaattaagaccatttctcactttgtttattgttcaagaactcccacctatagccttgacctgtgtttgagcttaaaaaaaaaaaaagtcttataactgcccagtggtttggagattttacacaatagaaataataagccatcttttgcctcacatgaattctactaaaatcaaaactccataggatactttccaaagtaactggtgaaaggaaaagtgtggtagtataggtatgcatattatccccatcactttatttctgagctcttctattttttaaaaattttaatttgtatcttaaaagggcaaaacataagaagaggtaggagtattctaaatttcagtgacaacaaattcatttattttacaatttaaccattgcccgtcaacatttacttaaaatttcagcatgggaggttttaaacacttctagagtcccatcttaccccatttccacgatgcttttcttctccatgtgttgctgcagtttaatattgtctgcgtgttttaatatgttaaacgagttaaacatagagtaggaagttaaaactgttagcagctatatgtttcccaagattgatgaaaattcaggtaacactccaacctgttaaagatacctgcaatctggccaggtgcggtggcccatgcctataatcccagcactttgagaggccaaggcaggcagatcacctgaggccaggagttcgagaccagcttggccaacatggtgaaaccccgtctctactaaaaatacaaaaaacatttagccgggtgtggtggcatgcacccatagtcccagctactcgggaggctgaggtgggagaattgcttgaacccggagcctgggtgacagagtaagactctgtctcaaaaagaaaaagaaaaaaaaaatatatatatatatatatgtgtgtgtgtttatatatatatatatgtgtgtgtatatatacatatatatatgtgtatatatatatgtgtatatatatatatatatgtgtgtgtatatatatatatatatatatgtgtgtgtgtgtgtatatatatatatagaaagagagagagagagagagagagagagtaagcagggaggggttgaagccagaaaagactagaaattatctaggccaaaccctttaatttatagattaggaaatagtttctggttgacttagctgagacgttctcatttgttaaaagcaagatcagaaatcagacacaattcaacgctcttcactacaccttgtttttctctttgtggaaaacaagacgtatcctgttcaaaaatttatgctgtttatctgaaagcccaaaatgcctgtttacatcatattttccattttgcaatagcagctcattttggggattattttctgatgaaatctctaggtttagttgtacttgaatatctttttatctgtacacactggaatatgcatataataattgatagaaatgtggattttaaaagtagagatgatcattattattttatgatcctttaagttaataaaattcacctagaataaaataaacaagtttaactaaagttctcgcattttcccagaaatcgtagactagaaactagtcttatttgcttattttattccaaagcttattttacctctattattttgtggttctataaaatatttctgtgtattcctccaaagaacctcttggaaaagaaagtaaacatcacatctgaaaaatagctgggcattttttcattatctctgcaaggggaggggacgtgaaaggcaaccccatatagaaactcaactccctgctttttacaatgaatgaagtttttccactgcactgtcagaatggtaattcttgctaactactcacctatttcacaacattaacagagttccaggattcatgctttaatattgcataatggtccatgttttgaacatgaggagtggcagcggagattacactttgattccttggatttcatgtggcactggatgggagcaaggcactgattttaagttgagataaaaaggagaagtcagtcaatgcctgcagccagacaggactcttgtaatagctagggagtatgcctcatttggatatgcatgactgccgggcaaggacactgccatgaatcgctaatggcagcagttgtatgacataagagagatgtgtatcagcaactcacaagttgactttgttacatgttatgaacacattcctgtgggcactcattcatagaagtgagaaatgtggacaccacagtgtcccaggcctttgttaccttatggcctgggaatatcttgctttgctggaacatgaagccacgtctggttataagaagaagtttgatctgggagcaaaattgcctgttcacgcatgtctttctcacttctttaaaactaacttgctataagggtgattaaaaaaaacagatgtcaggtgagagttttgctttgcatcaacttcctacttgtagaggtaataacataaaccttgcctggcaatcattatttgtcatccagctgagggtgtttactcttgagaaagaagtaatggacaaaattgacttggattctggttctatgtttcccattaattgactctggacatatacatgcaatttaatccatcttactaaaaacatgaccaactcacaggatgtaaattctattctatagaaagggctttccctcagtagttagtcaagggacggttcctaactcctgtctttattgagcttattttccaaaataaatgtattattttctactttgttcacagagcaaggcagcataaagaaattaagcaacaaaacaatagtgtatttttacccaactttctagaaaacacccatttttcttaagttttgatatttttttgccaacaggcagtcaaaaagaagataaataaaactgggttaagttggtaatgacacaataaataaatgagatgaagaaagaggcaataaatatgagtggataccaacaagaaacatgttcaagccctgaaaaaataatgagaaaaggtagaactattaataatacatcccgctctcgtatcacaccttgctccccagatacatcctatctgtcctggcaccatgttgatgctgttgttctgtaagctatgccaatgaacatgttggatgacctactccagctctacctcaagatttccaaataagaaaaggacccagggatctccttgctgaggtctttatccatttactcaggtcacaagtactaattaagcagctcttatgtgcaaaatgttattgcttcaggtcagtttttcctatactgctgttctataagagaggaagaaggtccctgccctcagaaagccctagaatacagatctagagatgggttcaacatctttgttatgcaattatttcattccaattgtaatgagtacttagaaaggacaaaagcagagtgctgagagagtataacagagggacttgacctggtgtagtaggcctggaaagtttcctggggaagtggtattttagacaaacaacacacacatacacccatgaatgtatacgtgtggagaatgtattctaagtaactatgatgaatgtatttcttactgtaggtcatggtcaaagtttgaaaactattgttctaactagtattataattccagggatagtagaggtcatgtgacctgtttagcacatgcctgccttaacagtatctagtaggccaggcaatgtggctcacacctgtaatcccagcactttgggaggccaaggcaggtggatcacttgaggccaggagtctgagaccagcctggccaccacggtgaaaccgtgtctctgctaaaaatacaaaaattagccaggtgtggtggtggtgcctgtagtcccatctactggggaggctgaggcaggagaattgcttgaacccgggaggcggaagttgccgtgagctgagatcatgccactgcactccggcctgggccacagagtgagactctctggaaaaaaacaaaaaacaaaaaaaaagaatgtctagtaaataagtcagtgccaagcaactacctgataactgttaccaccttagtcatcaccgaaggcagaaggtcttgcattcattggaggagagttaccaatctaagacatttgcatgaaaatgtgcacagagccctcacctgataatcaaagcatgttccaacacttctctttggataaaataagagttacatctcaatgaaatcacttgtggatcaagttctcatcctttcgtaaataaagagaggggcagcaagaaatggaagtgagcacatataagtgtgggaacctgtactttcctaacctataaagcattggatgtagtttttgctattggtgcgcatggagtcatgtggccttggagcagttaggtaccttccctgatgataggggagaaggcaaagaaattgatgatacatctctctcattgtcattccctagtatattacacttaaatctaactgccctattttgtgattgccttactgctgtggcttgaatatttgtgtctccccaaaattcatatgtggaaacctaattccatatatgatggtattaggaggtaggccccttgggaggtgattagatcatgagggcagagcccacatgaatgagattagaacccttataaaagagacccagagagctgctttgccctttttgccatgagaacacaagaaggtgctatctatgaacaagaaagcaggccttcaccaaacactgaatctgccagcgccttgatatcagacttcctagccttcagaattgtgagaaaaaaactttggttgtctataagccacccagtttatgatattttgttatagcattccaacggactaaaacattcattttccagaaaatctactccatttataagccagcattcttttttttttttttttaattttctacagatctctgcagaaacatgcagagtaataatagggccaggcacggtggctcacgcctgtaatcccagcactttgggaggccacagtgggtggatcacctgaggtcaggagttcgagaccagcctggccaacatggtggaaccccgtctctactaaaaatacaaaaaattagccgggcatggtggtgggtacctataatcctagctactcaggaggctgaggcaggagaatcacttgaactcaggaggcagaggttgcagtgagccaagatcccaccattgcactctagcctggacaagaatagtgaaactgtctccaaaaaaaaaaaaaagaagtgataatatatttgctgtatatattagttatagatagttatattgcagtactatcagaagctatgccacatattatttacgtatttcttaagatatagaaaacatccctcccctgcagtcattagtacttttgcattcaaacttcaaatgaaacaggactttagaaattataggcttggtgccatcctggccaacatggtgaaactcgtctctactaaaaatacaaaaattagctgggcgtggtggtgcacacccgtagtcccagctactcgggaggctgaggcaggagaatcacttgaacctgggaggaggaggttgcagtgagccgagatcgcgccactgcactccagcctggcgacagagcgagactccgtctcaaaaaaaaaagaaaaaaaagaaaaaaagaaaagaaaaaagaaattataggcttggtgatttctcaggcattaactcaagaaagcagcctttataccgattacctacattcacccagcacttaccccattaatttctaatgttgcttggaacaaatgaacattcctggaatgcaagctaaatgaaagagccccgaagaagaacagggcatttcctggttcctcatattgacaaatttaaaagcctgtgctataatatgggctcctgtttcctttcaagtttgtctttgaataagtggacagagtagctgaaagcagagtatttaaagctttgaaacgaccactttatttcagtctctgttcttgctgggaccactcttataaatgaggagattagaaaatcacctagaactatttaatcgttgtgcagaagaccctcttaccccaaatatttacttaccgctcattttattggcacactgcctcaaattccacctgctgtgaactgacctaagtgaatttaggtcacgtgcaactattaggttctttttgggaaataatggagaaccacagatgtgtttgaggtggatgaggaatggctacctcaagccgcagcttcatgcttcatgctgaagtcctccacaagtgcaatcatgtcgttaaccaacatttgttagaaggcaggcagaagtcagcttacagcctgttctacaatttttatgaagtgtaggattttaggcttaaattgacaccattgcaaatacagtattctcttacctttagatttggcatcaggtcacaagaattcttcctaagccaatggttggatacaaggccattggagaccagacgtaaaattaaaagcccaagcaacaggttttgctggattcttatatcctgtttatgcaatgttaggggatgtcattaaaatattttagttaatccatgtatcttgattgtcttaaattttactaatgagatcctatagggatattcattgcaatccactatttccctcagcaaaaacacatttgcgatatctattacatgcattacaaaatcctccaaggttcacagagatatatagtagtagcagtctctgggttttggcctttttcataagatgaaggctgtgctgtcctagaatatgaattcctaattaaaataaccatttgcctcaagcctctagagttgaaggttgcactaactgcacatataaaatatccaactatctatgttgagatatttaaaattaattacagatattgtaacaccattatttaacttaaattccattacaggtcctttgagtatgcaaaatatttctttgagatgtggtaacccctttaactgatcaggaaataaacctttattatcaagttgttatcccaccttgacaggcctaaagcgcagaccacatatcagaatcccctgggcagcttataaagctcctcatgcccaggctgcatctcagaccaattcaatctctgggggtgggctccaagcatcagcatttgttgaaaatccccaggattacaaagtgcggtgaagtttgcaaacccttgtaataagagaatgggaggagggatggctgtttgccaagcagaaccaggaatgaggaaggatattggtaaacaaaatttatccataattgacttttcatgaatcacagtcctactgagacccagccttgtctcatgagactttggctacgatgatgagtgagaaaaggactcctcctaatttaccagactcttgattagaagcaaatgaaattttggaaaagagacaagtcactttcaaaagaccccagcctgtacctgaccctacctctggactccatagtaatggcaggtagtggtcattcctggagtaactctgtatttcttaaaggaacatttgcataatgaacctacagcaatctggaagacgactggggtaaatagagaatttgttgattttagatggctgaatactatccgtgcagagcaattaaaaggacaactgtcagaatcaagtaagagaaaggaaataagagaagtctcatgttagtagaccttgtttgatcaatgtgttttcatcttgtatatgattaataaaataagtttgggagttaggatcaacctttgtttactcactggagaataacttgcatatagaatgaagctgggattgtccaggctggtttttttccatttggaagtttggatacaatacaaggaagcctgaattccaaactgtttctcttaaagagtgcctttctgagccgctattaaggaatgcttattgtttcgaaaatggtagcacagaagtgttataactagagtacaccttgtgcctgcaattaattacccagtgtcttcaaaaattcttgtcttttgctggtagaaaacctttgaaactatagttgtctgtggtattcactgcagcaccttagatataaagagagaaatttattttcagaggaatcttgagacagtttgtgtgtgtgtgtgcatgcctgcttacacatctattggttttccccaaggattgtagaaatcccattaaaattccagcttcttaaggagctactgaaactccagtttttcatattttcttttataatatttggatgcgtttaggtaaacttgcagcattttaattatgtctgtatcagatgagcggaagaaatgtaaaagggtttggggagagatttaattttagatagcggcgtaattaatagcatttggaaaaactagtggaactttaattaaatgtctctacattaatttagtcatttaattgaacatgtagtgggatagtccttacaatttttcacccttactctttgaggaaaaatgatttttgaataacaaagcatcagtatgactactttttattatttagctgtatgttcactacttggcactttgtttaatttttccccccatatgtttcgagctttttaaaacattaatttggcttgtcgcttttatcttaaaaactataaatctgggggccgggtgcagtggctcatgcctgtaatcccagcactttgggaggccgaggtgggtagatcatttgatgtcaggagttcaagaccagcctgaccaacatgacgaaaccctgtctctactgaatacaaaaaaaactagccgggtgtggtggtgcatgcctgtaatcccagctacttgggaggctgaggcaggagaattgctggaacccagggggctaaggttgcagtgagcagatattgcaccactgcactccagcctgggcaacagagtgaaactccatctcaaaaaataataataaaataaagaaataaagaaaactataaatctgggagaaaccgtatttggaaacattgagcaactgtttcttttcctttattttagactttaatattcactagagtcatgttgtaaagttttcaccttaatattgtaggctttttttttttttttactttgccaacttaactggcttttttaaagtggtgttatgctgcagcagtgtatctgaatttcagcagtgccttttacgtggctgctcacaatcttattaaactacatgaattatacatggagagaaatataatttggtaaatttggtgatgtttcaataaccatgcccaaggaggaatgttgtgttaaactgtcaatttgagaagtgttttgtggtgctaaccacagagtgaattcagttctacttcatttcacaaccctccataaatagtgccccctaaaagtggtgcctccttgcctgtactttgacccagatttttgtcatttttctagataagcatatacattgtgcacttattaatttttcaaatgacacaaaggtgagaatgggagtcaacacactgaaagatcaaaatcaagactcaaaataagattataacagactgggatactgtaccaaaataaaaaaattaaaataaaatttaacaagaacaagcaagatgtcctgcctttaagatttttaaagtcttttgtacaaatataggctgaggaacatctgactttgtggcgctttatatgaaaaacaaattgggattttaaataaccacaaggactgtattaatctccagtatgatctggtgtggcttactgtacgaggcaatacagtattagattgcattaatgaaattcacaaatgttccattaatctcttcactagttaaaccacatctgcagtcatattgacttatgagcatcacgtatgatgagaacactgaaaaatcataatacattgacagcagggcaaccaagattgtgaaaggtatagcgatggttatatgacaaatatttgaaagaatctagaatgttcagtaagaagataacatgaaaatacaggacagcttcttcatgcatctggggagggtgggtaaaggacacagcacacttaattaagtaagattgtagaagagaactatgggcaagtgttacagtggagcttactctgagtaaggaaaatgtaaacgttagagttgttattaagtggcatgggctgcttcacaaatttccatcattttttaatctgattcatctgctaataggacaaactgtaacaatagcttaaacaatagagaaatgtaggtctctctcatgtacaagcccagaactaggtagatcaggcctccttccgctattctgcttcactaagtccgaagtcctcctttaccttgtcctgccatggtggcctcaattctcgttgtcaccacatggtccaatatgtctgcttcagctccagccaacacatctgagttccagcccccagcaacatggaagaaggaaggaggcacagagagggcgtgtgtcagcagtgttgtgagaaaatctttcagaaactgtcatgaaatgtatcccctgatagttccttcaccagaactttgtcccatgattatatttacatctatgtgaggctaagaaatatattctttccttcaggcatctacatacccaactgaaaattatgagttctattgccacaggaaaaaatggaaaatatatggggacaatcaacagtacttgcacaaagatgttttacagagaattactcttttacctgggaattttacaagataaactttaagatcctatcaactctctctctctctttttttttttttttttttttgagacaagagtctcgctctgtcacccaggctggaatgtagtggtgcgatctcggctcactgtaacctccacctcccgggttcaagtgattcttctgcctcagcctcccgagtagctgggactgcaggcgcccgccaccatgcctggctaatttttgtatttttagtagagacggggtttcaccgtgttggccaggctggtctcgaactcctgacctcaggtgactcgcccgcctcgacctccctaagtgctgggattgggattacaggcatgagccaccacgcccagccagatcatctctggaggcagggggatcacttgaggtcaggagtttgaggccagtccggccaacatgacgaaaccctgtctctactaaaagtacaaaaattagctgggtgtggtggcaggcaactgtagtcccagctactcgggaggctgaggcaggagaatagcttgaacccaggaggccaaggttacagtgagccgagatcgtgccactgcactccagcctgggtgacagtgagactctaactcaaaaaacaaacaaaaagagtctatgatcctataatttatagacaacatacaacctcctttctctacaaagagaattggttctcaagggctgtttggaaattcatttccttttaagtccaaaatgacatacaaaagtgaccaatatatacaatgtacacccttctacaataagttctcttttgttgccgtagtaatcgcatgtcttttcttaaaggaacacttttttgactcttttgtacttttgaacatagcggtgttaataataatatttataaaacattatgaaaatatgcacacaaaacacaacacaggctaagaaaacctaatggtggcctaaagtaagttctgatgtcctctgttggtggtattcttcattgccatgcttctgctgtgcctgggacctttattgctacctatgggaagttgtaagtagagaagtttctttactacagggatgtgaacaatcattgtaagtaaggaataatgaattcacataagttcacagagcatgtttttctgccctggtaatactgcatttctcactttgcatttaaagtacctacgcccttacacagaaaaagttatcggggttgggtgcagtggctcacgcctgtaatcccaacactttgggaggccgaagcagggggatcacttgaggtcaggagttcgagaccagcctgggcaacatggtgacaccctgtctctactgaaaaaaaaaaaaaaaaaaaaaaacacacacacagaaaaaattagccaggtatggcggtacatgcctgtagtcccagctacttgggaggctgatgtggaagaatcgcttgaacctgagaggtggaggttgcagtgagccgagatcgcaccacttcactccagcctgagtgacagagtgagattccatctcataaatatataaatatatatatataattatcgattgattaatattattatatggtccccattactctaaactctcaaaatgtaatgtaggtcaaaatcagaaaaaggccatactgtctactccttcctctgtttcattccaactataagagaaagggagagggcaaaacaaagatgacaggaggccaaattgtacatagaattcatggaaattcttacccaacatgtaaaattatgatagtataaggaaaagtatactgcaaaaattaaacttctacattgtgaaatggagaacatttttacatctagctctattgcttctccctgtggagctgttctaagcacaaagttcccattacataatgaacaactccttaaatactgtgcaactatttctcactagaagcacgatgcagcaaactctgtttctcagtaaccatttatatcatacctagtggtaccgagttctataataaaagggtgatatgtgcatattttgtggtcatagagtgcaaagttgacatctacagtttaaagcattgcattgcatgaataaggtcaaaatttaaatacttttctatgatcatgttctttacattaaaggttaaagatgcatgccgctttaaaaatggtttaagggccggacacggtgactcacgtctataatcctggcactttgggaggctgaggtgggcagatcacccgaggtcagacgttcaagaccagcctggccaacatggcaaaaccctgtctctactaaaaaatacaaaaattagtcaggcatggtggcgggcgcctgtaatcccagctactcgggaggctgaggcaggacaatctctggaacccggaaggcagaggttgcagtgagcagagatcgtgtcactgccctccagcctgggcgatagagcaagactctatctatctcaaaaaaataaatgaataaaataaaataaaaatggtttaagaacttcaaaccatctggcaccagaaaacacctaaattgaattaaaaatctggaaatttaatttcacaacttgtcctttttcaagcctaccctaagttttgtttacttaatggggagaatctgttttatttgttcctatgtagaagactgctgattttatcatgattgtattagggcccaaggatatttaaaatatttcagtagctattacttatactttatatctgcattgcactttagagttgactgagcattttcaaagtattatcttaccaaattgccacaatagtcttgagaggctagtaaatcatgggagaagcccccatttccccactggaaagcagagaaaacccccattgtagtaaaggaggggttccctccagagctcttgtggttgtgttgaggaggaagtattaatgctgctgggcatgacttacaagaaataagtcaattcacttaagcaaaagtgctatgatcctgtataccatgtgagcagctctaggatggggtcacccagcattttggagcagacattagaacatctggagggagtaaacgcaaagaaaatgggctagatacctttccttggatgggaaaggataacattaagataccaagatcaaatgttcaaagagcacatatacaccatagaatactatgcagccataaaaaatgatgaattcatgtcctttgtagggacatggatgaagctggaaaccatcattctcagcaaactatcacaaggaccaaaaaccaaacaccccatgttctcactcataggtgggaattgaacaatgagaacacatggacaaaggaaggggaacatcacacaccggggaatgttttggggttgggggagtggggagggatagcattaggagatatacgtaacgctaaatgatgagttaatgggtgcagcacaccagcatggcacatgtatacatatgtaacaaacctgcacgttgtgcacatgtaccctaaaactttaagtataataataataaaattttttgtaaaagcattgtataataaaagtagtaagataaaccagtaaaaacaaaacaaaacaaaaaaaacaaaaaaaagttcaaagaggccgggtgcagtggctcacgcctgtaatcccagcactttgggaggccgaggcaggcggatcacttgaagtcaggacttcgagaccagcctggccaacacggtgaaacctcgtttccactaaaaatacaaaaattagctggatatgatggtgcgtacctgtaatcccagctacactgaggcatgagaatcacttaaacctgggaggcagaggttgcagtgagctgagattgcaccactgcactctaatgtgggcaacaaagcaagactctgtctcaaattaaaaaaaaaaaaagtttaaagaaaaataagttatttctccatgcttcaggagatatgtttcgcaggagaaagaggcttaatagagaaaacagatccctacaaacatttgtggtttttaaaactgccccattggttactaagtggataacatgagcgtgatgccagattcagtactctagtgagccatgcagctttgctgtgctctgcacctgatgagtgtggcctcacttcttataaatgcctgtcattgctaacaggggtccttgctgaaacaacagggctggactaatgctctagttcccttcctggaaaacctatcccaaagctgagatcctcatgatgccttctctcatatatgaatgattgcaggttacgctatcatcattaaatcgaaacattttagaccactttgcgtttgtttgtttgtttgtctcattatgtccagttttatcctgtttcataatttaataaatttttattgggtctgtcttctggttaaatgttgtgtgtataaaaaataaagtcaagagagagaacaggagttatggaactaatgacaaatccatccttcagctaaataaaattatactatggatgatttgagctgtacgttgagtgataatttttaaaaataagatagatcgggtgcggtggctcatgcctaaaatcccagcactttgagaggccgaggcggatggatcacgaggtcaggagttcgagaccatcctggctaacatggtgaaaccccatctctacttaaaaaaaaaaaatacaaaaaattagccaggcgtggtggtgggtgcctgtagtcccagctactcgggaggctgaggcaggagaatggcgtgaacccaggaggtgaagctcgcagtgagccaagattgcaccactgcactccagcctgggcaacagagccagactctgtctcaaaaaaaaaaagaaaaaaaaaagggccaagcatgctggctcacacctgtaatcccagcactttgagaggccgaggtgggtggatcacctgaggtcaggaattcgagaccagcctggccaacatagtgaaaccctgtctctactaaaaatacaaaaaattagctggacgtggtgacaggcacctgtaatcacagctactagggaggctgaggcaggagaattgcttgaacccaggaggcagaggttgcagtgagccgagattgtgccattgcactccagcctgggcaacaagaacgaaactctgtctcaaataaaatgaaataaaataataataaaaaataagataaagtatcacaagtaagatgtagttgaaacttcatgcatttttctatgatgcctatgatattcaaaagataactgaatttcatgagcagagttcaagaacttctgagtatacttttcattgatgacttaatgtaatggatttctatgatgatggcactatattcttttggtgtttatggtattaataaaaaattgtggtaaagcttgtggaaatgaacatgccttggattagggtgccttaaatgtgcctttgtaaatgcagctaggagactccaagtcacccttctagtctaactgctactcctttcttttacaaactacatgccaactaaactgaccttgatctgtttatggaaaggcggtataggaacaggggctctgcaattggacagatccaattctaatcaatccactccattgatagatatataaccttgagtccttcctgtgcctcagtttcctcatctgtaaaatggaattaaaaaccaacttcgtgaggcttttggagaatgaaaatgacataactcaaagattattgggtatcagaaacaataatgttatctatcactgtctttactgttattattattattgtcattattattattttctctacctggaacaccaattccacaaactcttaatgtcaagaccatgctgtatcatggagccttccctgattcctccatatgaaaataattaattctcatattaataatattacttttctacttgtattttctttttttagcttttattttaggtttgacggtacatgtgaaggtttgttacataggtaaacacatgtcatggaggtttgttgtacacattattttatcacccagatattaagcccagtactcaatagttatcttttctgcctactcgtattttcattatccccaagtatactatacatatcttaaaattaggatccatgttgaaaaaacattgatatttcctatggcttctaacacagtacattgcacttagatattcagcaactctgtattgaatgtatgggtacaatctgctcttagtttctaatttggtattaatatgttcaagcctcaagagctcatgtaaatgatggtttgactatattgcccatcttttgttaagttgaaaagctgaaattcatgcactgtttgttagtgtagtaatttttgacaacgtctagctattaagtcttttctaggtataaaacctttatatctgtcattgttcccctcttgtgtttttgctttaatatcgttgaaagcatctattattggaactttcacttctgaatagtacttttgagaacctgtatagaatttcagaggccttagaaaattgtcatagattgcttttagtatatggtttaccactgtggtctcttaacttttcaaaaagtatttccaaagggcacttacatccataaatggaaattgatttacatctattattgctgattgttcactattctgaacttcggctaaacaggtgatttaggcagaatttttttaaatattagattttttcctactttctaaatattttgtagctctttcttattaatttgagtcaacttatgctcgcttttttttgtcaattatagatggttgtcaggggtttggcaaatgtcatatgaaggtaattctttaaaagttgggatttttgaactgtttatttctactacttttgattttgctggaaattatcattctattaaagggacaaaagggtgctcagaaatatgcattgaaaaatttcttacagatttatcaaccattgccctcaggcactgatattcagccagtatgttccaatacatccatgtctttccattttaaaccttttaattctgttctaatttttcattgcctgtgcctgattgttctgtatccatctgatacgaatggttaagtacaacatgttaaatatcactcttgcctatacatattatttttcttgtcagatgatataattgtagtcattacatgtttcttaagcacaactgaaatcttaatttaaatcaataagtcttgtttctgtggccattgtttcccagaactctccggatttctaagcatggtggttattcttccaggaatagtgccgagagtcttcagcagcatgcatttctctctaattgacattatttcacactctccattttccttactattgaaaactgtatttcattggtattttgccaaggatcctgctctgtttcataataatgttctgttcgcactctctgcactgacaaatacctattccatgcatcaattgcataaatggcaatttgaaagcatttaaccacagctggatatttttcattgattcttttcatctgaagatcattcattaggcttctccctcctgtttcttctcacatccatacctcctttcctcctatgtacatagtgtcttttgcattttctgtatttaagtgtaaattgctgactacagttatgcttttacctcattccatggtcataatgaaatcacaaatttaaaaatgtactactttttaaacctgttttctgacttgtccatctaaatgcaattttataattcttcgacattcagcctcctggtgaatgatttctgcaatctctccaagacatctgtgcagtgttatggattatattgattgcattttgtccatgttcaaatttgcagaatgtaacctacagaatatatattgactaataaagaaatgcatccacatggtggatggttgtaaagagaaaatatatattggtgtgcagcaggcgcccacacaaatgaaatctagaaaacagcagcttgccatgtcagagttgcaaatgaaggctgtggctacaaaacacaggaagtctggagtgtatgaaaggtttttcttccaaattcattcacacataaaaatgaaaaaattgaaaaatcatatatgtgcaccttaatttttatatcgcattggtgtttgggcatacgaccctgagattttcataccctcgatttttttaatataaccacctgagcgtttcttcccatggggttactttagaagatggggggtgtacacactacgtatgtatgtcaataaagaaatgaaggaataaaggaggaaagaagtgaagaaggctgggggtaggaagggagggagaaattcagtgattcattacttattcatcatcctaaactggcatataaaataatatgtttaaatcagtctaaaattttcattgtataatctctgaaataactagtccccactccctaaactgtttggtgtaaatatttatctatgtctaatcatttctatgcaaaatagccttatatatattttcattttcataagatcatctaagaatcaaaggaaaagctattttaggcaatgaacataggcagtgatttcaaaatagaatttgagaaatgcaaggatagatggaatcacaaaagatgatctcattcatggtgttttaaaccctacaaatagatttctgtttagttgacctcatttcaatagcttctcatttttttcagaagtgtatttgatgtgtatatttctaataaacttatttttctttttgtacccagtattaaggagcacagcatttatatccactgaacaaaggataactgaaaggaaactccttgatatccaacttggagtatttgtttctcgaatgaatatgagtttatataagtagtttttttcacatacataaaattagaatttgtttgtattattgatattatttcagaacagcggatttaacgtcatagatgatctagatgtgtcctttccttagaaatctttaaaatgaatcacatagtctagaaacagatccagatactacatgctctcatcagaaaggactttcttctcttcgtgtcaagttcagtgttggcaccgtatagacaaagcgtgttaaaatagcagggttcttgttctctgacacattacaagagaggcaagattataaaactgctatgtgtctcattataattcccattagtttcatttgcttcaaaacattcacttctgtgctttttgcaaaagctttcaaacttattttttgatgattctaaaagtaattcttctatgtcttttcctagtgatactagcattagttttcttttccaattgtactaggaggcatgagagattatcgatgccctattttcttgtctaaataggcaacccaaataatcatagtgacctgttcatttatattatctttatttcttgcctcatacttcttcatatttcttcatttcccatgtttccttattctttggagccagaaacgatcacgttaatcactctttccattagttttctcctatacattttctgatctttctctgatccagttaagagtcattcagccatttgataatggacactagtttactttgaccttgcaaacacaaataccctgtttgatctttatttgctgagagcagtaagacagaagaattacaataaactttttagcacccttctgttcaattctttttcagaaatcgttccctcaaaaagcctattctaggctctttcttttggcagtttcctagaattttcctttgcttttcaccaactggaacattatcactagaagtaaactaagggaccatctaattcaacaccctcgttttgtactttaggatactgaagccaagagaagctaatttttttgcctgccataacacaactagttagtgaagcagccaaaactataagggatcttgccaccataagctttatcggcccatccgtttatctcctcaaagcagccctatacctgatttccttatttctgttctctaagtaagccaagctcagaccttagagtgaccttcccctaatccaccctgcctgacatccaataaactgacaaatccagttgattatgaagctacagtgtttttcaaaccataccataattgtctaggctgttgccatgctctacacaccagttttcttattccagtccctccctgccccagtcccagttcactctactcagcctctctactgcaatggataaaatcacagtttccagattcacaaagctcacagctctgccactttctagccttgtatttgtgtttcagttgctgctgaaactctctaagcctattttccatctataaaatggaaaccaacccagaggctcgttgtattacagagatattgcatgaaaagcatttagcgcagtgtctggcccataagaagtcctcagtaaatagtagtcttggggaagcagtagggtgttgtagtaagagagcagagcaggggacagcaaactacaggtctcagtacaaattcaacatggggcctgggttttttttaatagcaggggagctaaaaacagtttacttgttttaataagttgtacgaaacccaaagaagaatatgtaacggagatttatgtgttcctcaaagccagaaatatttactttctggccctttacagagaactttcattaattcctgttgacagctgtcagggtatgaatcctctctaccacttagaaactgtgtaaccttgggcaaatgttttaacctctccaaggtttggtttccctgactgtgaatagtacctatgttacagggttgttatgagaattaaatgagatcatttatatcaggtgcttagctcactagctgaaataggatttaataaatgttagctgacatggttacgtctactcattgttgcagataaatagcctctaagtgcagctttaatagtgattgtttcttaaaatttttgaacaaagtttttctatttcttatccaattaaataaatattccacattctggcattcaatatttctaacgacatcaagcaactctaaaatcattgaatgttttaaagcaacaggaaaccttagaaataactcatctaaactcatatcatagatatggaaactaagggccaataaaaccaaggcttctaggacctgaaatcagatcctctctttttaggtagtgtgatcttcatcgtgcttctgccatgcaatctcagaatttaaagggatttaagaatcattcattttcttcctaaggcaggattcgaccctataaaatccctgtcagtttggtcattcaaacccagtttgagtacagtcattgatgataaatcacccttttcccagggagcagttctggttgtttcaaagtctttataataaatgaaaattggctttcctgaaatctctatatattgatctattcctgcccactggagccaaagagaaacgtcacttctctacatctgtaaaatactcgttgtcaattttcgtatcttctctaagcatcctcgtttcaagctgatgtgaactagttgggtttttgattgttttcattgtcctgctaagtcgaaaagctaagaaaagcttggctctttcatcactgttatatatcccactgtgtaacagaacttgagttcagggtatacactctaaataactgcttttgtaaaagtattcaattatattgatttttttcgttccctctgttgttcctcataattaccctcagtcaagactttcatcttcgtctttatcttcctctgcaagaattaacagtggtcccttttgtgaacttcaaatatctgagactggtctcagttaatttaggaagtttattttgccaaggttgagaatatgcacccatgaaacagcctcaggaggttctaacgacatgtgcccaaggtgtttggggcacagcttggttttatatatatttagggagacatgagacatcaaccaatatatgtaagatgtacatttgttccatccagaagggtgggacaacttgaagcaaggaggggcttccaggtcacaggtaggtgagagataaatggttgcattcttttgagtatctgattcgcctttccaaaggaggcaatcagataagcatctatctcagtgagcagagggatgactttgaatagaatgggagacaggtttgccctaagcagttcccagcttgacttttccctttagtttggtgattttgaggccccaagatttattttcctttcacactttcaatataagctatccagaactgatgataatattccagatatggcccaaccaatggaaatgattgtgtttcctacataccatatcacaatcaaacctgttttgcaccttgcatttactttctttattaatgatgtcattgcaatttagaaaatttggggccacatttacttcttcctctctattatcttcagtttttatttggtcactaaattctgtttgctgactcttatatctaaaaataaaaacactcaaatccagctattcctctctaactactctgcccttccctcagtcctttctcagtgactattaatgatttggccttctaatgattagcctccctgtccccagacttttatccatctttatcactatggctagttatcttgctaaacaacagatctaatcctagtaccccattatattaaaaaaatcttctatagctacagctttctctccctccaggtcagtatccatagcctgtcaagatgtggctttgataaaggacagaaggcagggaaattctgggcagaagagggcaggtccccattgaggacccaccctcaagccaaaaagcctggaaccatggcccaaagtgagaacttacatccctgttttccctcttgaagggtgccttttccaaaaccatccattaccccccacccaccccccaacctgtgcctataaaaaccccagagctcagctggcagaaggaggagaagcagatggatgtcagaaactacagttggacatcaaagagaagcggcttgactttagagggacagtttgacagcatagctttggagaggagtccagctgtggatggtcagactccaggggaagattaccttcccactccatccccttttcagctccccttcccactgagagccactttcattggcaataaaatcccccatatttaccatcttcaatttgttcatgtgacctcattcctcctggatgctggacaagaacttgggtgccatgcgtgtgggtgaaaaaggctgtcacactgaccctccactgagctgttaacacttaagccatctgtgaatggcaaagctaaaagggcgctgtaacacttcctcatgggcaccctcccctagaggctgctgcagggcccgtacggtgttcactcttgccagcactcaaaaatgctggccccagctgctgcacctgctcacctgtgctcccccttccatgaggggtggaccagcgagtgagtggagtttgctcccctccagttcccacccacgaagggatcagggaaatatcctccttcagctccagtgaggcacagtggtatacacctatagtcccaactactgaagaggctgaggtgggaggatctcttgaacccagaagtttgaggctgtaggcactgtggttgtacctgtgaatagccactgccctccagccttggcaacatagcaagatctcatctctaaaaaagaaaaaatatatatgatgtggctccaattcactgatctagcctcttaactgaattccttcctcctggctgggcacagtggcttatgcctgtaatcctagcactttgagaggccaagacaggagaattgcttgagcccaggagttcaagaccagcctgggaaacatagtgagacttcatatctacaacacattttttcaaaaagaattttttcctccctgctccccaccctacccccttgcaaccttatttactcttcggcctctggccctctcgctatgtctttctcagcttcatgcctttgaaaatactctttctatgcctggaaagcccttataaacctggaaattcctattcttattcaactctgagccagtccattttagtggcttagttcagaggctctagatttaaattgcaattctgtcagattctgtctgctttgccaacctcaatcaagttatgtactatgcctcagtttcctcatcagtagaatgaaaataatacagtagtgcttttttcatagggttgtagtgaggattaaatgagatgaagcgtataatcctcatgtacataacacagtacatactatatgtgttgcacatagtaagtgctcagttctttttctttgcattattcttagcacataagtcaagttacatttgctctcccttacgcaaggtcaattgttcttttttatgtgtttacccgttactttgttcatgcatttgttataaccactgccatcataaagcaacttgctatctttgttcataaaacaaatcccagattcactgagctcaaagtgagagaaggaaactttgcattatgtgcagttcctatgcttttctccaaatttcacatctccgttggggatctctcactagttatccttgccatacccccacaccagccttacaattttgcattatgtttcctacatcatgattctaaacggtcctcctgttcgctttctctccatcccatatcgttgcagatagctatttcctctttttaagacagaaacacatttgcattttgcctaagctacatttgtaaattttacagtattttcgaaagacacaatggaatctaggaaagatgcaacagataaagagattaactggccaatttttgagagcaccatccgtaaagtccacgaacaagtgaggcttccttgtcggagaaagcaattcagtcaccataaatgatcattcaagcctgatctcattccctcttgaaactggaaattgaaagcttgttcctctgacagttgtgttgtcagtggatatgcccagtgtgcaaaggactggacaaagggcaaaagtacacatatcccatctggaattctgagtcatccctgagacatcattttggatttgtctactgagatgaaattaaaacatgagtaatcaagcccacacttcttccccctcaaactcatctctttggtatcatcaagaaaatcaaatgctaatagccattgacctcctaattctagtgctcttagctatgataaaacagtcattaacttaatctaaatgttgcaaataaaggagccccatcaaagctgaagccccaaaattatacaaatgagttaactgggaaggcatgggggaaacaacagttttcataagacacactctaaatctagtttattctcttaggaagacttttctcatcaatagagagccacataaagatgccttacctgcctttcacggggactatatcaattggctgtactgtcactcactccaaaactctcaaaatgcctaacacagattcttgattttattgattgcattagatgttacgttttctaaattttcagcaccctggaggtcacctcaggaaatcatgcagtttttgaatgattttccttagaaatacacgtgtagctatacatatgcccatgcgttatttaatcagttagtgaaaggaggaaaacagcatttctattattgacctttctcaatctctgaggagactgtatgtcttgcctacagtccaggattgaaagcaaaagaaaaaggcactgacaaaatagcattttattttaatagcacattatggagagacaaaaaaaaaaaaaaaaaaaccctgggatttcctttgtctaagtagaattgacgtatgggtgagatcagtctctattttactcagtacaagtgcacacatatttatgtacacacatataattgtcatctttgggccgggcgcggtggctcacgcctgtaatcccagcactttgggaggccgaggcgggcggatcacgaggtcaggagatggagaccatcctggctaacacggtgaaaccccgtctctactaaaaatacaaaaaattagccgggcgtggttgcgggcgcctgtagtcccagctactcaggaggctgaggcaggagaatggcgtgaacccgggaggcggagcttgcagtgagccgagatcgcgccactgcactccagcctgggccacagagcgagactccgtctcaaaaaaaaaaaaaaaaaattgtcatctttggaagctaagggccctgtatcagagtatcagaatatacctatatccaggatgcagtgttctccagttttgcattaacatcagctacaaggttcactgccatctaagactaatcaacagtaatagctaaaggacaaaggtcagttcctgagagatatgcctaaattcatctggctatatcttctgttcctcccaaaccctaaccccataaattcttcattgtttagaaggattcatattttttgtttgtttttcatattcccattttattggctggggttagaattgcaatggcagcaaaaaacacagaagctatctacagtggcttaaataaatagagttttatttatctccaatattaagatgtctggaaataaggtgctttgggcccaacagtatcaggactggcatctgtatattttttattgacttttcctcatgcaatatagcagccaccattatttcacagggtgaaaaagagaaggcaaaaagggtgtactatctgagtcttatcatttttataaagccaaaaatttcccagaaaccttttttgaaagacttctacttgtatatcattgtatagaactgtgtcacatgacagccaccaacaaaaagatggctagggagaagtggttttcaacaggtattgaagtagctaaccggcagtgtctgccggtcttcagttataaacaccagcagctaactctggctaattcaagtcagggaaaacaaaggggatggggtaggggctctttatttaaaagatactcatagaaatgaacgaagtaatttgaaaactaggtctcagaataggacatgaagtataagagttctaaaatctcaaaagcaggaacacatgcatcttctttttaagtgttgtctttgaaatactaagctccaaagtctttccaaccttgtattattttcttcctttgtcagcttcctgagtggcagagtctgagtaacctatggggtctttgaactctttaggggaattgaggaaggcaaaaaggtaccatgattggcagctctactagagtcacaagaaatatggggaaagcgattcctcaaaggaaaaacaaaaacagaaacaacaaccaggcagttagtagaaggatgaaatactggacccacaaagacaacatatgtcttctcaccacacttggtctctctctctctctctctctctctctctctctctctctctctcacccttctctctctctcatagtaatgaaactaaagctgcaaaactaaggcctagctattcattgtgatccttatgagatcataaaaaaaatctgtatttaagtggagaaaaataaatggaatatcaactttaaaaaattttttttgagacagagtctcgctccgtggcccagactggagtccaatggcatgatctcagctcactgcaacctctggctcccgggttcaagcaattctcctgcctcagcctcctgagtagctgggactacaggcacgtgccaccacacccagctaatttttgtattttcagtagagacagagtttcaccatgttggccaggctgttccgaaactcctgacctcaggtgatccacccacctcgacctcccaaagtgctgggattacaggcacgagccactgcacccagctggaatatcgatttaattgtaagagaaaaatgcactagtttaaaaatgtgtcctctttatcctcaggttttaaaaatatttttaaggtagtttagaaaaactgaagtgattatttgataaataaatttcaaatgctatcaatggaacaagaatggatattagatatcctgctaacaaggatcatatttttacaagttgtttctccaaagagaacagagctacagctgagattctggtgcgcataaacctttccatcagagctgtagtcacctaacaattcttatatcacaatcttcatatctcaatcccttttccaaataacttcatctttcttaagttgcatacaaatgttataatctaatatttttgagatggatatcatgtgtcataaaaagaaagccattgtaatattaccaataccaagtattagcaaatattgacatagctttagaataaaaataaacagagctcagggtctggctctgccatagctagctagatttatcttaagacttcagtttcctcatatacaaaatgttgatagtatcatcatcttgtaagccttgttgtaaagagcaatttagctaacagtaacagtgtttaacatgcataaagtgaaggctcctttctgggctgataagaacgctagtttattcatttgcttatttctatatttttaagcttagagtctgaaaattttcagagtctgggagtcaacgtgtggggtgtgaattggaacttcaccacttactaacaactcccttttgtagtgcttccatttatttatctgttcaataggagtaataatagcactcgctcaaagagttgtctgaggattagatgagacaatgcttgcaaaatgcaaagtggagcacctggtgtatagttggtattcaataatttctagttgttgatatgatgatgacgatgatgatgtattctcttgatatgtgaatgctcatcacaccatcctatggaatatttgattttaagaaaaagttgggtttgttttttttttttgtttttttttttttttgagatggagtctcactctgtcgcccaggccagagtgcagtggcgcaatctcggctcactgcaacctctgtctcctgggtttaagcaattcccctgcctcagcctccagagtagctgggactacaggcgtccgccaccatgcccggctaatttttgtatttttagtggagaccgggtttcaccatatttggccaggctggtctcgaactcctgatcttgtgatccacctgcctcggcctcccaaagtgctgggatgacaggcatgagccaccatgcccagccaagaaaaaatattttaaacaagttaagatcatttactatactgtgccctaagatgaggtgaacatgtagatcatgagatctaattgattttagatgcagttcagttttttaaaagaatgacctgctttccatattaaaatttcaaaacaatgatatgtggagatgatgacagaatatggctgaatgaggtaccttgttatcctcaaccttttggctcagagacctcttccttgctggaaactttcctaaccttttaatgatttattaacattttgcatgcactctttatacctttcattaatgactagttcactgcaaatttttctttgctttatttcctattcttggtgtgacattcattctctatctgtttctatggaagcttttgtgatgcctcagagagaaagaattctgagtctttgaaataatgaaaacattactaaaccataaaacctagatttcaggagcctaatagaggattagagctttattacgtacagccatcttacagtttagccttcaagtctcaattgtggaatgatcttttgtcctttctctccagtgtgcatgtgtgcatacacatatagacacagttcgcgcttcagtcatataaatgggaagccacaaagcttcctagagtacccagatgcagaattagaagacccaatcttgacaccagggtcaggggatctgtggtttggggggacttgtgctggctatattgttgtcacagcaggaacagtttgtgtcggtatagaggctttaacttctagtaaagggatatataatgaaaatgtaagcaaccatcgtttatttttctcacataataggaatttaagagaaagatatacccaaaattggtttattagctcaacagtttcattcagaatccaatgtctttccatctttgcatttgctatccttagcctttggctttggtctttggaattgtcacgcgatggttataaaatggctgccacactccaggaattgcatcatgacagtgtgaatggaaaataaaggaagagtggcagttcttgtcatgtttcagaagcaacagcatgtctccctaacatctctttggccagaactaggtcaagtagctgcatctacctgcaagggaaactaagaaattgactatcagtgctttttaaacttttttttgtgtgtgtggaaatagataatcactagagaaaaaagggagagtggaatggttgttgatgaggcaaccaacagtgtctaccactctatttataaaccttttcttgatttttcctactaaatgtgtggccgttttttttgcttgctttttgttttttgtttttgagatggagcctcactctctcccccaggctggagtgcagtggcgtgatctcggctcactgcaacctccgcctcccaggttcaagcaattctcctgcctcagcctcctgagtagctgggattacaggtgtgtgccaccacgcccagctaatttttgtatttttaggagacatggggtttcaccatgttgatcatgctggtctcgaactccagacctcgtgatccgcccatctcagcctcccaaagtgctgggattacaggtgtgagtcaccgcacccagccaatgtgtagccttttagttcaaggacctttcattataaatcttcatagtccaaacacccggcatattgtctggcacaaaataggaagaaatatttttggacgtgccaaggaatttgcaagacagtgagacaaatagccagtaaaaatgttagcattaatatattattaaaaatagtgagaaatgctccaggcgcagtggctcatgcctgtaatcccagcactttgggaccccgaggcgggcggatcacttgaggtcaggagttcaagaccagcctgaccaacatggtgaaaccctgtctgtacttccagctacttaagaggctgaggccggagaattgctggaacccaagaggcggaggttgcagtgagccgagatcacgtcactgtgctccagcctgggtgatagggcaagactctgtctcaaaaaaataaaaataaaataaaaagaaaaatagtgagaaatgttatgaagacaaagaataggctactttggaagaataatagtgggaacttcttcatagtctaggaaggcctctctgaaaaggatatatttaagctaaaatctgaaggttaggtcagtcatatgaacagggaggggaatggaataatattttcaagacaatgacctaaaaggaggcaagtatggctaggagctaatgactgagggggtgagtggtacaggacaaggctggagagtttattttatgggtaagcagagaaataatataatctgacgtacctgtgaaagtacacctgagctgatgtacctgcaaaacatcatacaatctgatggacctgctgtataaatgagagattgaatgtggcaagagtagaagcaaagaggccaggtaagaggcatttgcagttgtcttgatgaaagaaaatgactactgggagtaagatggcggcaatggaaatagagagaaatgaacagatttgagatgtattttcgagacaaaatctgtatgacttggtgatggattagatgtcaggcatgagggattgaggatgactcccaagttttttttgtttgatcaacttgttgtactgtttgctgaggtgataaagatggaggaggaagcagatttggaaaagatcaacagttcagttttagacatgttcagtttgaaatgtgtgtgatatgtccaagtgcagaagtcaaattcaattatagctcaaaggagagacccgagctagaagcgtaaatgagaaaaatattgatacaaaatggaatttagagcatccagaatggaaatcacttagcatgtaaagagggaagggaagatggcctaggaccaaaccttgataaacttcaagaaaaagaagtcaagcagaggtaggagaagagaagtcagtcaaaaatcaaaagaatatgacatctcagaattcaaggatgtgaataaatgtgtaagtgatggatggctttcggtctgggctttttgttttttttttccattttaagttccaactttgctacaatccggctacgaatcccacaccctcccaaattatctgaggatgttaattgatacttgatcagaaagcagtgatttttaaaatcatatacttctaaattatctgagatatgaagcaatgagatagggaagtggctgaaatatgtttctctggctcagctgtcatgagggcttgctctagaatggcactcaagcacatgtttatccactgagctctatatcatttattccattagctgaagaaggaatctctcacactctaacttcagttctgttggacatgggaataaaagttagatgtatacagactaaactaaacagatggtagaaaaacaaaggattcttaaagtatattggagaaatgcatttctatggtcaattttcttgaatatcctaagatcaggtttcatgtatataattctttacatttcacaaagcacctttagatgtgtctattccatttaaccctcatcctaactgtgtgaagtagggcacagaagtgtagaaatgattttttaaaactcactaagctaatcaatggataatctgtgattataatagaatctgagtttcggcatctttatcttattccttactgcactatatctggaatggtaaatattgttcatctcacaagcaagctcttattgactgatatcagctgcctagagtggtttattgtaaaagagcataaagcaaattggggaagactacaatacagtgccataggctgattagtaatttctaccattggtattaaatgagaaaataatggtacaagtgctttacatttgtctgccattcctaaactaaggcacctcctgttatttataaggaagaatattctgagaagtttaaaagtctcttgttaaatcatttgatgacgttggataaaatggcttaaaataagaatatgcctgttgcacaaataatctacactcccccaagataatgaataagtcagctggagcatctcaagtttcaatatgtagaggatcaaaatgaaatagtcataaaaccccttgcagacatttcttgggcaggcaaactaatttcctagtaaaagaagttggaagttggacaaattgtatatgggaactttctatactacttttgcaaattttctgtaagtttaacttttcctaataggatgctgagattcagatcttccaatggtctcaaatgttttttggttttgttttgttttgttttttgagacggagtctcactctgtcacccaggctggagtgcagtggcgtgatcttggctcactgcaacctccacctcacgggttcaagcaattctcctgcctcagcctcccaagcagctgggattacaagtgcctgccaccatgcctggctaatttttgtatttttagtagagacgggattttgccatgttggtcaggctggtctcaaactcctgacctcaggtgatccgcccaccttggcctcctaaagtgctgggattacaggcatgagccaccgctcctggcctcatttaaccattttgactttcactttttctgtcttcaaaatgaggtattgagctaggtaaacttaatgtcttttttcgctttaattatctaataattctgtgattctcaacttggtgtgttaaaccagattacacctaagaaaccctgaagactttttagctaggagtttaaatattcacttagtcattcaattaatatctattgtgggtctgttatatgccaggcgccattttaggtattgataataaagcagcaaacaagacaaaacccctgccctcaggagagcttacattcttgtaaagaagacagatgataggccgggcgtggtggctcactcctgtaatctcagcactttgggaggccaaggcgggtggatcacgaggtcaggagatcgagaccgtcctggctaacatggtgaaactccgtctctactaaaaatacaaaaaaaaaattagccgggcttggtggtgggcacctgtagtcccagctactcgggaggctgaggcaggagaatggcatgaacctgggagctggagattgcagtgagccgagatcgtgccactgcactccagcctgggtgactgagcaagattccatctcaaaaaaaaaaaaaaccgaaaaacaaagaagaaagatgataaacaagtacacaattatcatataacaattttaaatagtgacagcatgttgaaataaataaagcaaggaagacgctagagagttgttcatggaaggaattgtcattttatataaggtgatcagggaaggttccactgaggaggtgacatttgaggaaagacctgaaagaagtggggagggagacccgaaagttcatgaggaattgtgtcccaaacagggcaacacataaaaagtccttgaggcaagactaagctgattatataacatttaaaagaattaggccaggtgtggtggctcacacctgtaatcccagcacttttggaggccaaggcgggtggatcacctgaggtcaggagttcaagaccagcctggccaacatggcaaaaccgcgtctctactaaaaatacaaaacttagccaggcatagtggtgcatgcccatagtcccggctacttgggaggctgaggcaggagagtcacatgaacccaggaggcagaggatgcagtgagccaagattgcaccactgtactccagcctgggtgacagagcgagactctgtctcaaacaaaaaaaaaaagaattaatttacatatcatgagatcatctagtctaacacccttactagacaagttcaaaaaggttaagacttggccaagatgacacagctatttaatgtgatatctgggttagaattcacctcatctgaattcctctcaaattgtgctctttgaggtcaatgtgccttttaaaaaatgacagaaagcatggctgtagatttcagatcataccaaatttgatggaacaatgaccatttttagcttcctatagagtctaagacttgaacttgccaagggagtcacagctggatttgtaagcatcaaatccacaaatgtacttaatgtcaaccaaggattttgtgtcacctgtaatgctcccccaggaagcccccaagtccactagtcctaatcactgtgtttggcttcataacctgttggcccaaacattacgcaaaaaagagcaatattcccaaggtggtcatgttagttgtggtgagatgtcaaccataagtagatctgaccgaggaaatgccttaaggaagcagctcaggaacacctgagtatatgtgtctagaatgaagcctattaaaaaaactactgcagagctaaagacagctgaaagccattatgacagtcacaactacttgatagattgaaaccaaagagttcctttgtgattagatagatcaggactctaaatcatgtttttacttcatgtgttcattcattcatcatacagtcagtgattcagtaaacaatattgagcatccattatgtgccaagcactgtgttaaattctggaaacacagagatggattagacccctgtccccagggagcataaagactagcagagttagacctccctcccatatgaagaaattaaatgaggtaaggcattaaaagtgctatgattacataatacagaacccaaaggggaaggcattttctgaaaaacagaaaactgaaaataccagcttttcagcctcacacagacataggaaaaccaacccccatcaacatcatctcttcttttttttttattattactatagtttaagttctagggtacatgtgcacaacgtgcaggtttgttacatatgtatacatgtgccatgttggtgtgctgcacccattaactcgtcatttacattaggtatatctcctaatgctatccctcctccctcccctcaccccaaaacagtccccggtgtgtgatgttctccttcctgtgtccatgtgttctcattgttcaattcccacttatgagtgagaacatgcaatgtttggttttctgtccttgtgatagtttgctgagaatgatggtttccagcttcatccatgtccctacaaaggatatgaattcatccttttttatggctgcatagtattccatggtgtatatgtgccacattttcttaatccagtctatcattgatggacatttgggttggttccaaatctttgctattgtgaacagtgccgcaataaacatatgtgtgcatgtgtcttcatagcagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgctatttctccacatcctctctggcatctgttgtttcctgacttttgaatgatagccattctaactggtgtgagatggtacctcattgtggttttgatttgcatttctctgaacatcatctcttaatataaaaagcataatgtgctgatttcacattgcatgcctgtatcaaaacatctcatatgctctataaatatatacgcttaatgtgtacctacaaaaattataagaattttttttaaagcaacaataaatatcttcattagtcaaccaaattaaatctattaatatatccatgtttgtgaacaggatggccacagaaccctgtggatgcttaccacttaaacatttcctgaaacaaatatgtttccaaaacatcttgcctgtctaatctgacaactgcagacatcctaactaggctctgaaggtgctctccatagcactgatgttattgattcagttgttaacagcgcaggcataaatgactgatgataactctctaaacgtcccttcctactgccgttgaaatggctctgggctttatccaagcagggctgctaaatgaatagtagatgtaccagcagaggagaaattggtcctgaggtgaattaactctcctgaggtagatttgtttgtgcttccaacaacctgtacgttaaaccttgtgaaccttcatgtaggaattttgaggagaaatgggcaatttttggaaagcctaatgttttatcagccgctttttcttctcattgagacctgtgtattctcaagggactttggaagtttgccattttaagaacagacttgatgagaattatttgaagtcctccacgtttccatttatcagttttcctaatacagacatcctacgcacatcgttgaaagaatgttctttttgcctcacaggtagatcacaaaagtgggcccataatcattgggtagagggtttctcagctctgagttaaattgcagctgggtattgtttttctgtaataggatcttctctgagtgaatggtgaaacatgcccatttttgaggtcatgagagcagagctttccacatcatggacagaaaagggcaaccggccatggtttcagttatacagggagaggaaacaataggttttgtctctgctttgctattgcttcaacagcagcatactgttggacactcagacattagggcacaatttagacttgtttcacagctgtcatttctttcctcaaaaacaacaaacctgcatgggggaaatgagtctacatttcagggtttttcaagaattgataacataacatgtacttcaccatgaatttatattccacaggtccctgttctcttctctggtcatcagagtacaaaatcacaaccaaaaagcaagaattgatatctatgaagctaaagtagtagtagtagtagtagtagtagtagtagtagtagtagtagtggtgaagcaggatattaccctgatcccctcgcgggcgggaactggactgcatagccgcttcggtgctggcaggggcagactccactggctcagtctcactgagttccacccctcatgggagaggaagcacaggtgagtgggtacaggagccagggtgagtgcttttgggcgccagcaggaacaaaactctgtgtgggccccatggcagtgtctaggagggtgcccgcgacccttgaatccccagaaggagtgttacagggcccttttatctttgccatctgcagatggcttaagtgttaacagctcagtggagggtcagtgtgacagccttctgtactcgcacttgtggcacctcagatcttgcccattttccaggaggaatgaggtcacacaaactaattggagatggtaaatgcgggggattttattgctgatgaaagtggctctcagcaggaaaaggagctgaaaaggggacagagcaggaaggtaatcttcacctcgagtccagctgtccgcaatcagactcctctctgaagctatgctgccaggctgtccctcggaagtcaagccacttctctccaatgcacaaccatagtttccaacatccagctgcttctcctctgtgccggctgagcctgggatttttacaggcacaggatggagggcagggtgggctatgggtggttttggaaaaggcaacatttgagcaggaaaacagggatgtaagttctcactttgggccacagttccaggcttttaggcttaagggtggggcccttgccagagacccgccctcttctgtccagaatttccctgcctcctgtccctatcagtagtaatagtagtagtagtagcagcagcaacagaagtaatactaactactacataccaagcattatctacgtacttcatatctattcaccaacctaattgttacaactttcactcgcgtccgtgtgaagagaccaccaaacagtctttgtgtgagcaataaagctttgtaatcacctgggtgcaggcgagctgagtccgaaaagagtcagcgaagggagataggggtagggccgttctataagatttgggtaggttaaggaaaattacagtcaaaggggggttgtcctctggtgggcaggagtggggatcacaaggtgctcagtgggggagcttttgagccaggaagagccaggagaaggaatttcacaaggtaatgtcatcagttaaggcaaggaccggccattttcacttcttttgtggtggaatgtcatcagttaaggcaggaacaggccatttaaatttcacttcttttgtgatttttcagttacttcaggccatctggatgtatatgtgtaggtcacaggggatatgatggcttagcttgggctcagaggcctgacattcctgtcttcttatattaataagaaaaataaaacaaaatagtgttgaagtgttggggcggcgaaaattttcggggtggtgtggagagataatgggtgatgtttctcagggctgcttcgaggtggatcaggggtggcgtgggaacctagagtgggagggattaagctgaaggaagattttgtggtaaggggtgatattgtggggttgttagaagaaacatttgtcatgtagaattattggtgatggcctggatacggttttgtatgaattgaaaaactaaacggaataagagaaggagaaaaacaggtattaaaggacgaagaattgggaggacctaggacgtctaattagagagtgcctaaggaggttcagcatagccttgccagcaaagattatttactttaagagttaagagtggtggtttggggatagcaccaagagatatcagctgtgatggcttggagaaacagtgtaaaccagcagtgtaaacaagagcagggcatttatgactagttgagactggtgaataggagtatgactagacagaagataggagggatgacaagttttttggggtgcagtctaagttggtctggtgtctggaatgagactggggcctaataaaaaggagcgtccatacaggagcttaaatgggctgtaccttgtagcattctgaggacaggcctgaattctgagaagggcaagtggtaaaagtattgtccagtcctttttaagttggtggctgagcttggtgaggtgtgtttttaaaagaccattagttcactgaatactaagagcctgagaaactgcttgggtgatttgactaataaagtccagtctgttataggaccgtatagaggtgggaaggccaaaccgaggaattatgtttccctgtgggaaaggcctctacctatccagtgaaagtgtctacctagaccaagaggtattttagtttcttgtctcggggcatgtttagtaaagccaatttgccagtcctgggcgggggcaaatcctcgaaccttgatgtgtgggaagggagggggcctgaataatccctgaggagtagtagaatagcagatggaacactgagaagttatttctttgaggatagatttccacgatggaaaggaaatgagaagttctaagaggcaggctagtggcttgtactatagcatagcctgcctttgctggtgtgtggccattaggcctggtggaactgccatcaataaaccaagtgtgatcagggtgaggaacaggaaagaaggaaatatggggaaatggggtgaatgtctggtggatcagagagatacagtcatgggggtcaggcgtggtatcaggaataatgtgggaggccggattgaagtctgggccaggaacaatggtaattgtgggagactcaacaaagagtgagtacagctgaaggagccggggagcagaaagcatatgcgtcaggtgtgaggaagaaaatagattttggaagttatgagaactgtagagagtgagttgagcatagtttgtgattttgagggcctctaaaagtattagggtggtggcggctgccgcacgcagacatgagggctaggcaaaacagtaaggtcaagttgtttggataaaaaggctacaggacgtgatcccagtccttatgtaagaatcctgactgcacagccctgcacttcagcggtgtgtaatgaaaagggttgggatgagtcagggagagctcgggtgggagcagtctctaaagctgtcttcaaggaatggaaagaggagtggggaaaggatttaggatctatggggtcagctaggtttccttttgtgagtttatataatggttttgttaggatggcaaaaccaggtatctaaagtcgaaagtatctaaccatgcctaggaggaaaaaacttgttgttttctagaagggattggggtttgggagattagtcagacatgatcagcagggagagcacgtgtgtttttatgagaattatgccgagataggtaacaggtgaggaagaaatttgggcttgactgaagtaatgggggctgtctgtgaagccttgaggcagtacagcccaggtaatttgctgagcctgatgggtgtcagggtcagtccaagtgaaagtgaagagaggctggggtgaagggtgcaaaggaatagtgaagaaagcatgtttgagatccagaacagaataatgggttgtggagggaggtattgaggacaggagagtatatgggtttggcaccacagggttgataggcaaaacaatttggttgataaggtgcagatcctgaactaacctgtaaaccttgtctgcttttaggacaggtaaaatgggggaattgtaaggggagtttataggctttaaaaggccatgctgtagcaggcgagtgataacagactgtaatccttttaaagcgtgctgtgggatgggatgttggcattgagcggagtaagggtgattaggttttaatgggatggtaaggggtgcatgattggtcgctaaggagggagtagaggtgtcttatgcttgtgggttaaggtggggagatacaaggggagatgtgaaggaggctttgaactgggggaaaaggcggcaatgaggtgtggctctagcctaggaatagtcagggaagcagatcatttagttaaagtgtctcggcctaatagggaactgggcaggtggggataactaaaaaggagtgcttaaaagagtatcgtctaagttggcaccagagtttgggagttttaagaggtttagaagcctggccgtcaatacctacaacagttatggaggtaagggaaacaggcccttgaaaagaaggtaatgtggagtgggtagcctccgtattgattaagaaggggacggacttaccctccactgtgagagttacctgaagatcggcatctgtgatggtctagggggcttctgaggcaatcgggcagcgtcagtcttcagccactaaaccgagaagatctgggaaggagtcagagagccttgggccagagttccaggggctctgggagtggctgccaggtgagttgaacagtccgattatcagtggggtcctccacagatgggacatggcttaggaggaatcccgggctgcgggcattccttggcccagtggccagatttctggcacttgtagcaagctcctgggggaggccattctggaggaacccctcgcagctgcagttcaggcatttggagttcttctgtgctggagatatggctggggtttgtctcacagtggagggaaggaattgcaactcagaaatacattgctacttggctgcctctactttattattgtacaccttgaaggcgaggttaattaagtcttgtggggtttgagggctggaatttaatttttggagtttaatgtcgggagcagattgggtaataaaatatatattgagaataagacggccttttgaccttttagggtctagggctgtaaagcatctcagggttgttgccaaacgagccatgaactgggcttgtttttttatttgatgaaaaagagcctaaacgctatctgatttgggataaagaaaaaggagcattaaccttgactatgcctttagctccagccacctttttaagaggaaattgctgggcaggtgggggagggctagtcatggaaggaaactgtaagccggaccgggtgtgaggagcggaggtgataaaaggattatagggtggaggagcagaggctgaggaataattgggcctggcgaggaggggagaggtcagatgggtctgtagaaaaggaagattagaaagactgagcgatgcttggggttgggactgaggggacaggtgggagggaaagaaggaagatttggaaggagttgcattgggaacagagactggggaggggcagatgtgtaaaagaatgcctggacatcaggcacctcagaccgtttgcctattttatgacaagaattatttagagcttgtaggatggaaaaattgaaagtgccgttttctggctatttggaactactgtcaagtttgtactggggtcaagtggcatcgcagaagaaaataaggcatttaggttttaggtcaggtgtgagttgaagaggttttaagttcttgagagcacaggctaagggagaaaaaggaggaatggagggtggaaggttgcccatagtgaaggaggcaagcccagagaaaagggagtagagacacggagagaaggggtggggggttcttgtcccccagaaaagcggagaaggggtagagacatggagagaagggttggggggttcttgcccccgagaaaagcggtacttgccgctaaaggtgaaggaccaaggcaggcgtccccgtgtggtcagacacctctgaaatgtgggtgaataatcaggcaggcatccccgcgtgattaaataccaagggaagactcttccgagtccgtgaccggtgccggagttttgggtccacggataaaacgcatctcctgtctctaccagaaaaggaaaggaactgaagttaagagaagggagagattgaagtggggcgccaagattgaaaggagaaagaggttgagggatagtgagaggttggaggagagagtaaaaagaggccgcttacctgatttaaaattggtgtgatgttccttgggctggttagtctgaggaccagaggtcgtaggtggatctttctcacagagcaaggagcaggaggacaggggatagatctcccaagggaggtcccctgatccgagtgatggcaccaaatttcatgcgcgtccgtgtgaagagaccaccaaacaggctttgtgtgagcaataaaactttttaatcacctggatgcaggcgggctgagtccaaaaagagtcagcaaagggagacaggggtggggccgttttataagatttgggtaggtaaaggaaaattacagtcaaatggggggtggttttctggcgggcaggagtgggagtcacaaggtgctcagtggggaagctttttgagccaggatgagccagggaaaggaatttcacaaggtaatgtcatcagttaaggcaaggaccggccattttcacttcttttgtggtggaatgtcatcagttaaggcaggaacaggccattttcacttcttttgtgatttttcagttacttcaggccttctggatgtatacgtgcaggtcacaggggatatgatggcttagcttgggctcagaggcctgacaacaacgatcttgtagataggtactgttgtaattcccagtttacaaataagaagactaaggtatagagagattgagtaatttgcccaaagcccacagctagtaagaagccaagattcaaacccaggtaatatggctgcagacctggtaatcctaaccattacattaggctgactctcgatagttaacttatttaagctagtgttaatcacatcttaacaagtttgagtaataaaatcttaggttgaaaggggccttcaagatctagtctaaatcctttcaggagttcttccacatttctgctagaaaacactttggcctaggcttaaaacttagtgatggggaactcctcactttgtaaagcagcctgttcagttcacaaacaccctaataattaggctgttatctcttgcattgagctgaagttgatcttcccataacctctgcctttctgtctatatgtatgctttggaaatatacacagtaagtgtaaaccctcttggcaaagacagcccttcaaatacttgggaggcattcaattccccccgccacctcccgctctactctcactaccaagtctttagaatagagtacaggtatcaaaatcaaaacaaacagggagtagaaacttagtgccagactttaagtattttttacttataaaatctttttgtgtaacgagtagagcaactcctaactgcatatatgtactaagtttgcaaatggggcaatttgtttttccccatgcactggcatcagaggtggtaaatgctggcctgtcagattcaatgcattttgctgggttagaaccgcaagggctttccaggggaccaagctctctctgctgtaatcattaaaacctgcagaatcctgtgtgactctggggagaagcccagtgctcttggccctcatccaccctcactaggaaagctgcttaaaactaggacagaagaaacaaccactggcttaggatcagtcctcagacctgccttggcactaccccttttattccaaattttgcagtggcacctccaacttcttggtcacgttttgtaccttgtctgtttcctcatataacttcattccaaattccaacccatgctctgacatttcctctccattcttgctagacaggaatttctagatattggatattggcccctgcccataccctgactctgtatattcttttgtcctgctgaccagtttgagcttctgaataacaaaaactccccaaccactttaaagtcctctactttagcttgatgggtccctctcctgtattttctgaccttgactctgctctctgtacaaatagtaattacactcacccccaagcagagaatctgtgtcaaaatccatcaggatatctaagcacatcattatatctgtcaacttccccagactcctgatctcaatcccttattttcaacaacctggcaccgacagagtataatttcttttgtatcatgatgcagtttgatgtgcttttcgaaaggttatggtggtgattttaaagagatctgttttgttagaggaaggaaggaaaatagtgctgtttgcttccatgcagttcctcagagcctatgccagggtgatttcagctcatgagagaatctaaagtctaaagagatgtgtggagattagaaacattggtgtaaaaaatcagattacggagacgtaatatccagggtgtcagaggaggcagggagcttcaatcatgtttgaaactataggtcccacccaacaggatgagaaaatacaggagaagccagaaaaggtacctgcttgtgggtaaaatcaattaaatggaatcaatggtatggtagccatcatttctttcttttcaaattgtggtaaaaacacataatgtaaaatttaccattttaaccattttttagagtatagttcagtaatgttaagtatattcatgttgtcatgtagtggacttgcagaactttttcaccttgcaaatctgaaactgtacccattaaaccacttctcatttcctcctttcccccagcccctggcagccatctttctactttccgtctctatgcatttgactattctaggaacatcatgtaagcggaattatacagtatttgttcctttttggactggcttatttcacgtagcataatgtcctcaagtatcacctattagctgtcattgcttgaacacggttttctgccaagcacatgatctcgttttattcccaccacaactctcaataacaactgtgtaccttttttccctttcacagattaggaataaaaggctctccaagactaggctcagaagcagaagcagttggagagttgcttgcagaaggattattgtcatactgggaagtgctctcaggatttacacctctaagaaactgaaaggggcatgactgcgcagaggaaaagctggttcaccatgcagttgcaattatggctgcagcaggagcatgcagggaagctctggagtaggtttggcctttcagagttgtccccagtaaatcaaatgggtgaagactttaacccatttatgctggaggttgcaaaaatgttttgtgaaaagtcagaccttggcgatgaccttgagcagtaggatataaaaaactcccacaagcttagcgtcccaataatggaacactaggcataaatgagttaatccctgcatcagccagtcattggccctaggtctctccctgagggaggggatgtagctgtgtgaggcagttccctgagggcacattccaatgaaggccccagctgtgagccagcagccaataaggcagcaggtggcccatgcatgcaaaggccctaaagaggaggtccagggtggagcgccacggtgtctactacagatgctgaaagagtaaatacattttatttatttatttatttattttattatactttaagttttagggtacatgtgcacaatgtgcaggttagttacatgtgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgcggtgtttggtcttttgtccatgtgacagtttactgagaatgatgatttccaatttcatccatgtccctacaaaggacatgaactcatcattttttatggctgcatagtattccatggtgcgtatgtgccacattttcttaatccagcctatcattgttggacatttgggttggttccaagtctttgctgttgtgaatagtgccacaataaacgtacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtacatttgtttgagttcattgtagattctggatattagccctttgtcagatgagcaggttgcgaaattttttctcccattttgtaggttgcctgttcactctgatggtagtttcttttgctgtgcagaagctctttagtttaattagatcccatttgtcaattttggcttttgttgccattgcttttggtgttgtagacatgaagtccttgcccatgcctatgtcctgaatggtaatgcctaggttttcttctagagtttttgtggttttaggtctaacatttaagtctttaatccatcttgaattaattttcgtataaggtgtaaggaagggatccagtttcagctttctccatacggctagccagttttcccagcaccatttattaaatagggaatcctttccccattgcttgtttttctcaggtttgtcaaagatcagatggttgtagatatgcggcattatttctgagggctctgttctgttccattgatctatgtctctgttttggtaccagtaccatgctgttttggttactgtagccttgtagtatagtttgaagtcaggtagcgtgatgcctccagctttgttcttttggcttaggattgacttggcgatgcgggctcttttttggttccatatgaactttaaagtagttttttccaattctgtgaagaaaggcattggtagcttgatggggatggcattgaatctataaatttccttgggcagtatggccattttcacgatattgattcttcctacccatgagcatggaatgttcttccatttctttgtatcctcttttatttccttgagcagtggtttgtagttctccttgaagaggtccttcacatcccttgtaagttggattcctaggtattttattctctttgaagcaattgtgaatgggagttcactcatgatttggctctctgtctgttattggtgtataagaatgcttgtgatttttgcacattgcttttgtatcctgagactttgctgaagttgcttatcagcttaaggagatttggggttgagacgatggggttttctagatatacaatcatgtcatctgcaaacagggacaatttgacttcctcttttcctaattgaataccctttatttccttctcctgcctgattgccctggccagaacttccaacactatgttgaataggagtggtaagagagggcatccctgtcttgtgccagttttcagagggaatgcttccagtttttgcccattcagtatgatattggctgtgggtttgtcatagatagctcttattattttgagatatgtcccatcaatacctaatttattgagagtttttagcatgaagggttgttgaattttgtcaaaggccttttgtaaatacattttttaaggtcacacaaatgacatatgggacagaacagtgtttaacttcaaaactcatgttctttctgctatactgggccttctctccgaaagaggcctaatttgcacactacagtcaagcttagaatctattcatagttaaaatgtggagtcaaagcccaggaactatgtccttcaattcatctttcattacttacctattccttatcattcccgctgacaccaaccattttttctgacccttgtcatgaggagtgaagttgtatcattgcagcagctttctacttgtactctatgcctaaaatctctccttcctccatctggtcagccaattgctgtcaagttaatcttgcaagaacactacttttgccagtttaatttcgcaaaactcctgctgtgtgccaggagtgtcccagacatcaggtagtctaagataagcgatagtctctgcccctaagccgtttgcaacctttggagagacaacgtcattatcaccaccagcacccccattaagctcagagctaatatatgccagatgagactctgccagtcactgtgctaaggacttgacatacgttatctcccttaattctaacaactactttctgaggtacctctgatgagtagtatcatttttagatacaaaagcagaaacttagcgagttaagtgctttgcccagtggctctcagttgagaaacgaggtagtcacaccaggcagtccaacttcagtacctgagttcttaatcatcatgtttacaactttggctcaacattgtcaccaagatcgggttcaaatacatccattatcaatattctttctgtctccttgtatgtccaaacaaacaaaacaaatgcttccctcctgatgaggaaagtctccaaatcttgatacctgctgtgtctggacagtttttcctgctatttgctgagtgctggaaggattccctcaatccagatgtgattgcagatccagctcaagctcagcgtcctccagggaacctttgaactaaccacccagaaacgagcctttcaccggacactactcattttcacatatctagatcttatttccccatctgaactgtaagtgtcttaagagctgattttgttgttttttaataaaaaataattcttagttttttttcttattaccaaaaaattattcgccattgaagccttctgaatttttaataagaaaactattggtatattgcttcaaaaagaaatctaagcttctagattcttgaaaagggatagtgacagaaccttagaattaatattcaatataactaatctgatgaaaattcagtcattgatacattactgagaactactagatctcagcatttttaattgtagattcacatggagttgtaagaaattatacacggactccacatacctttttaccgagtttcctctaatggtacacctgcaaaactctagttcaatgtcacaaccaggattttgacgtcaatattgtcagtatacagaacattttcatcactacaaagatccctcctattggccttttatagccacacccacttccctgccccccctacctcctacttccagcaactactagtctgttttccatttctttaattttgttatttcaataatgttatatgaatggaaccatacagtatgtaatattttgggatggacttgactcactcaacataattccctagagatttctctttttatatgcagcaagacttgtttcctttttatcgtgagttgtatgctatggtttggatataccctagtttatttaatcactcaccccttgaagacatctgagttatctgtagttttggactattgtgaataaagctaccaacattaatgtacaggtttttgtgtgaacataagtttttatttctctgagataaatgctgaagagtgcaattgttaggtcatatggtagttgaatgtttagttttaaaactgccaaacttttccgaagcgtctgtactattttatattccaccagcaatgtatgagtgatccagtttctctgcatcttcaccaacatttggtgttgtcattattttttatttttagccattctgatatgtgtgtaggaatatctcattgtgcttttaatttacgtttccctcgtggcaaatgctgttgaacaacttttcctgtacttgtttgccatatgtatatcctcctcattgaaatgtctgttcatgtcttttgtctattttctaattcaaaagtttttttatagttcggttttgagagttctttctgtatcagatactagtcctttcttgtgtatagggttttcaaatgttttctctctcatcttttcatcttcttaacaggggatgaaaaagaattttaattttggcgaggttgaatttatcgctttttccttttatggatcatgcttttgtgttgagtctaagaatactttgcctagccctggatcccaaagattttctcctgttcttttttttttttttttttgagacggagcctcgctctgtcgcccagcttggagtgcagtggcccgatcttggctcactgcaagttccgcctcccgggttcacgccattctcctgcctcagcctcccgagtagctgggactacaggcctccaccaccacacccagctaattttttgtatttttagtagagacggggtttcaccattttggctctcctgttttatatgtcttatagttttacattttatgtttaagtctgtgatccatttgatttttatataaagtatgaggtttaagttgaggtttattttttgcatatggatgttcaattgctctagcataattatttgaaatggctggcttgattattgaagtaaggtcagacttatttctctcctgggcttcagacccagccaccttctatgtttcttgtccaccacaacctgaatgtcccacagacacctcagacttaacatgtccccaacagctcattattatcctccttttgtcccaatccaccctcaacatttttccctccctaattgtgctgttcttatgaacgctacgcttcacccaattgcccaagtcaaaaattagggtattatttctgaatctacttttatctttaaatctaacatgatgcattgccaaattctgtcagctctatccccaagccatctcttaattcattcccttatttacacctcccttgactccaatatcttttgactcaaatgctacatagcctctaatttatctccctgatattgttcttgcttccgaatcccttttccacaatgcgcctatagtaatcctcctaaaatgcagatctgattaggtgactctccttattttaaagtctttcttattgttttctcctgccctaaggcagaagttccaacaaatcttgttatcagattctggattaaatcccagcctcagcagtgggacctaagatagtgcctgaatttccatgaacatttattgatgacaaacagggtcttaaataatgagtgatgtagactttccactgtcaacatcacagattctggtttttaatggtattcacatttgccttctccaagagtccaggtttaatgatggtgagacctatcctaagacctggctttgtagtgaggggttacctcatcacagaatcaagaagggacctcgggccgggcatggtggctcatgcctgtaataccagtactttgggaggttgaggtgggcagatcacctgaggtcaggagttccagaccagcctggccaacatggtgaaaccctgtctctactaaaaatacaaaaattagctgggcttggtggcacacacctgtaatcccagctacttgggaggctgagacaggagaatctcttgaacccgggaggcagaggctgcactgagccgagattgcaccactgcactccagcctgggcgacagagcaagactctgtctcaaaaaaaaaagggcggggggacctgggtgcaagtaattctaagaagcaggaataagagaacaagaagaatgaagcgacaaagaaagatgagcaattctctggaactgttgagaagtgtacagaagaaaacaaatctggatataggtagctacagcctgaaatatggaaagccagagcatgtgtatacctgctcctgctcccactggttgagaattgattcctttttcatctgatatgggcaagcattggatctgagtgggacacatcctctccagtgcacccctgccttttccgctgctctgaacttcacacaacgtcggaaagattcaaaacaatgtagaaaatctaagtataaatacaaaaaggaaacaagaagtttttctatcaaagctgtgaactatatgatatgagtaagctcaataaacactgtgcagaagttaggaggggaaaaagagaattgctgccaaagcactaacccctgtggctggctatgcttgcccacccaggaagctcccatgtcatgggggtcaggggaacctagaacagaaagctgaaaggctcagggatcccttttgagaagggatgctggctatacagcacgagttagaacttgcacagaaccgtccactactgctgacactggaatcacaggtgggctgacaagatgtgatgcaagcaccagacatatttgctacaaacctcaaagtggagcagagcagcggcagtgtcagtcttcttggtgtcaatagaatacctgtttatttgttgaattctccctatatgaataataataatacaagaattcaaagcaggataggctttgtgtcattggaggagtatggagaaccatcagtgcagtaagtgtcgtgggaggtttctagacagtttttaaaagtcgatattgagtcaaccatcaaatgtgaacaattctgatatgccagagcatttgtattcttaactcatggggttattacaaagatcaaatgaaataatcattataaagcactttgtgcagtgcctggcacaaagcacgcactcaatacatgttaatgtttatacaattattattattgattgtcagaattatcagccccacatcagcaaagaatagtaggtggtctgtcagcaggaacatggaaacattctcattacatagaagtcagtgttgcagggacagtcattaaaacaggatctaattttagtcttctgagggaaaatgctaggttctccggaaatgttgaatccttcctcgagcatgtagtttaatttttcaaaattatattgcatatcctgtaaaatgaaaatgaaattgtactgctgttcattaaaggcccccaaaaatcttaggcactatacaatataaatgaaaaaaaaggcgttatttttccatagggcataattagaaataaagaagcaaggtcactcacaaatttccgagctataaaggaggaaaggaacaagattttcccccggttattttatagctgccaggttgaactcatacttatccaatgagccccagaatggaataccgttctacaccaactgtactgatgatagtgattcagggagtaaatgataagattccatccttctaaagtgcttttgggattggattctagtaagtttcattttgctattggccaatcacaaaagagactacaatagagaaaagtgaagacatcatgctgaagacagactgctgcatagaaaaggaagagggaccccctaatttagagatatggatggagaaaaaaaggcacttatgctgtagcataagggaaacattaaataaagctataatagaggagaaaatgtctttgaatagaagaaaaaaatcagacagacagaaatagactaaaatgctaaaaaaaaagatacaaaaggacattgaaggggacatacagtgattattacacaaattaaatgcacacagttaaaagggaggtgaaaagcttctaaaaagaatgagtgtgtagtgaacttaattttatcatctttactaagacaaagttaaagtccctaaaatattttaagacacttaaaaaaaaaagtcttaaaattttgagagcctttcagctctgtcaactctagactttccctcctacttaagttttttttcttttttttcttttatcttttttatttatttatttatttttttatgttttttttttttttttttttttttttgagagagagagagagtggatcagccttaataagagaatggtcttctgccaggtggtattctcctaatccctttccagtgagatccacaagggttcaaaaccactttctggggtcttagaggcaccacttatctctcttcctctgctcatatctttctgctccagtgcccgcatagtttgtgttatcagtggtgcgtagcctgagacatccacgacctatgccagctctcgaagtaatgtgattggcatccaaagaaacacaagaagcccatgatttcgtccctttgcaatttaaaatcatatttaaaatgccttttggtcatacaaatttgaaaatgatcttgtaaatcacttccgggaatctatggtcaaaactcagcttagagttctctacttcttaacagagtgcctgccagtaactagtgactgtcaatgagtttgaaaacataaattgatgtgcaaatgctagataatagcaacatcctgtgcaactgggcagcatttctgttgtttggcttttttattttcgtggactctcccaatctgagagaaaatagatttgagttcctttttaatcggtttagacccagacaaggatttaattggtttagaccccattcacctacgtgtgtcactctgtctccaacataacagaggagatgaccaagacaacatgctctccagccaggaggtggggaatactttggtgtcatagcagacaattattgatggaaaactcatgttagaaaatgtaaggtaccttcttctagacggagtaaaaggggcagctgcccagactttcattttaaatagggagcccataatacaaatcttttaatacaattttaaaaagaagagacatagggggtatctcttaggacctgtcaacaaccaaccctctatcaaatggccaaatcacaggtggtctgcagcttagccaaaatgtccaagtacctttttgtaacacagaatctcctttgaagatccagctttcattaatgatccccagcagctctggtcaatgtgtcttttcacaaatgaagctttttaaaagctttcagtggacaaatgtggctttgagttttcaactaaatctttctgtttaaaaggagtgctgaaatgggcatactttataatcttaaatgctgcacacaaaatactgaaatattattgaccctgagaggttggttcaaatcaaatagcatactcacgtaaacgttctcttttcctaatattagcaacagggaatgtgaaatagagaggggcgggatatgctggataggggtgcaccaaaattttcaaaaagcctcgaaactagtgtatattgataaccttgtggcatctaatatctagtattctttttttttttttttttttttgagatggggtctcgctctgtcgcccaggctggagtgcagtggtgtgatctcggctcactgcaacctccacctcccgggttcaagtgattctcctgcctcagcctcctgagtagctgggattacaggcgcccgccaccacgcctggctaattttttgtatttttagtacagacggggtttcaccgttagccaggatggcctcgatctcctaatctcgtgatctgcccgcctcggcctcccaaagtgctgggattacatgcgtgagccaccgcacccagcctagtattctatgtctattatttcttcataatgagactgggggaaatctttggagaattaatgcagcagttggtaaaatcattctataataatgggtaccattctgctctgtcccacatttttatgaagtctctttaaatttaaaaaggcaatgtgctttgtggttcttgagcaacttaaatacgttgctctgaatagttattgtgatgaggtaatttgtaacaacttttaggatcaatgctaattttcttaaatgtttctgtagtttcccctttattataaagtatattaggctggactcttggctgtaagtgacagaaaactcaactcagattagttaagaaacaaaagggtgttggtgacagtggtggctttcagactattgctgcaggcccacctgccatcctcttaacaccctcaacataccctgcagaaaagagagagctactctgacccgagagcttaaagactggtcaagtatgggcttgactctttatggcccaaattgggtcacatgcccacctaggctaggggaatggaatcgtggaattgattgattgattattgttgcaggttgagtcctccaagaagcagatgccagggcagatttattgcagaataacacctgtgaagaaataggggtggaagcagaattgaacaagggaagccatcagatcacaatgcagatcttctagactctgtgtcagcacaacaaggaatgccagagcaaagactgccaattagaggaatactgaattgggcagatctgacaatagtctgtatataactcgggactgttaacttctccttcctcaaccagttatagacatagaataggactctcttatctcaaacatcaatatctgtgtatatgaagtagagggtgaaagtttactgtacactagtggttctcaaccaagagcaagtctgtcccccaggggacatggcaatttctggagacattttcagttgtcccaactggtgaggaggtgctactggcatctagtgggtagaagttgtggatgctgctaggcattctctataattcgtgggatagatagcacaacaaaaaattgcccaggccaaaatgtcaataatgctgaagttgagaaaccttgctctataaagatacatgtcttggccgggcacggtggctcacgcctgtaatcccagtactttgggaggccgaggtgggcggatcacgagatcaggagatcaagaccatcctgggcaacatggtgaaactcatctctactaaaaatacaaaaattagccaggcgtggtggtgcatgcctgtagtcccagctactggggaggccgaggcaggagaatcgcttgaacccgggaagcggaagttgcagtgagccgagatggcgccactgcactccagcctggtgacagagcaagactctgtctccaaaaaaaaaaaaaaaaaaaaaaaaaagatacatgtcttatgtgtactgaaagaggccacggaaaccttttgttgatacattcttgatagtttttgttcttatatgtagttatgaatacttgagattccatccaatttatttaacttttgaccagaaagggtagattgaattggtgaaacatctatatcctgaatatttaaaagattctgttttttaaaacaaatattaacttgaattaacgtaaatattcttagtagttaaagtccttaaagaccttagtttggtgaacagataagaatcatctgtgttcagcatatgcattgccttatgaagatggtaagtcaaaagtatgagtttatttctgatatttaaatatccctgaggtatagatttgtttactctggaagtttactctgttgtttgtttgtttgtttttgtttttgttttttgagacggtgtctcactctgtcacccaggctggagtgcagtggcacgatctcggctcactgcaagctccgcctccggggttcacgccattctcctgcctcaacctcccgagcagctgggactacaggtgcccgccaccatgcccggctaatttaatttttttgtgtttttactagagacggggtttcaccgtgttagccaggatggtctcgatctcctgacctcgtgatccaccagcctcggcctcccgaagtgctgggattacaggcctgagccaccgcacccggccttactctgttgttttatttcttcattatatattacaaagttgaatgttagggccaggttagatcggaaaacaagttaagtattccttatccaaaatgcttgggaccagaagtgttttggattttttatttttgtggattttggaatatttgcatattcctcatgagatatcttgggatgggacccaagcctaaacatgaaattcatttatatttcgtatataccttatacacataccctgaaggaaattttatacaatattttaaatacttttgtgcgtgaaacacaaaagttttgactgtgacctgtcacatgaggtcaggtgtgaaattttccacttgtgacgtcatgtcagtactcaaaaagtttcaaaatttggagcatttccgattactttggaaaagtctagaaaaagtttgatatcagtgcactgaaatcattttcaagtaggaacaatagcgatactagccctttactcatgcaaaattcacagtttttatctaaacaacacaaaatcattcaatgcttttatatttaatcatctatattcacctaaccataaaaaatcaatttcaatacagtaaggaaaagacaagaaaacgaatcattctaatcactgtattttgaaagttctttgcaaacaaccgtgaaatggttaaaagataggaggatggagaccagcctggccaacagggtgaaaccccatctcttctaaaaaatacaaaaattagccgggtgggttggcgcatgcctgtaatcccgggtactcgggaggctgaggcaggagaattgcttgaacctgggaggcaggggttgcaatgagctgagatcatgccactgcactccagactgggcaacagagcaggacgtctcaaaaaaaaaaaaaaaaaaaagatggtaagagaatgatgacttgttgcttactaaaataaaggaaagattgacactataagtgatactgtttgaaatctcaggaatctctgaatcattaagattatatcacaaatggcatgcaaaatacctgttcaaaaaatactcctcatggacatgagatgctaagctgctgatactgagtctgacctaggacaatgatgttctgtgtcacctcttttctgatgcctcccagattgctcctggcctcactgctgtctcacttccaaaaatacatattgcccttattggtcataacacagagactatcagttcaaaagtctctaattcgtctcagctgcagtcatctcccagcaagacacaaggttcttgagaaaagaaatttttcatgtcccatctttgccatccaccacacgatgaacatacagtacagtgtacatagcagcccttgaaaatgctggtggaatcattgattcttgaacccaactgtcatactttccagatttaagtcctggtaaatgattaaaatcgtatgggttaccctcaacaaaccagctcaagtatttactataaaaaagggaagctagatatggaacttcccctaaagatgggtctgtcaaactcaccccattgtattctgctctgacaccatgttttttgtttgtgttatttttttttaagagacagggtctcactatgttgcccaggctggtcttgaactcctgggttcaagtgatcctcccacttcagcctcccaggtcactgtgagagattacaggcttgcaccaccatgcccagccccaccttttaatacaaataagtaacagttaccatttactcagtgctcaccttataacagatgctgttaaacgctttacacgccttagctcatttttagttaaatacattgtttttgccccagctatggtagggatcttgctaacaatgagaatgaatgataagaggggctttaaggagaattcactgccacacctttcataattttcccatcattcctccagtctttgttcaaccgtccatgatttactgatttgctattacatcaaactatgctgcaacaaaccagtggttccttctgatttttatccatctcctcctcacctagggtgagagtctgaggcttccttgagtctactttctgatattgttacatttaacacagaacatctcttgttttcgtttctggcagcttatcctctcttcgctttctccatgctttcattcatcctaaaacaccattctgacaatgatatttaggttggtacataagtaattgtggttttaccattaccttcaatggcaaaaactgcgatcacatttgcaccaacgtaatatttttcttacttaaaaaattaatgtagagtatggaaatacttgccatcagggaatggggaagaaaatggctagagagacatggtgaaagagagacttgatttttaaataactttttttgtttttcttgaattttattatcatgtgaatgcatttgaaagaaatacaattttaaaataattattaaaaaaatatttgaatgccttcccatgaacaactaaatgaagtctctattcttaaacctgacagtcaagtacagctctggtttgactccaagctacatttctagccttgtattattcaactctttttctgtttatccttcatatccgggcctttactagtgccaaaaaaaaaaaaattgctcattctactcttgtcacccagagtgtttcttctgtttttgcccatcaaaagcttacccaattgtgaaggcccagtttcaaagcaacctccttcattaatttcatccagatactctgtaacccccatagctgtttaggcttgttctagcaatttgcagttatcagaaaaatgagtacataccgagtgccagaaagtggtctctccaactgtgcacattacaacatctcattctctgtgcctccatttcctcatctgtaaaatggtcactatggtgtactttcctcatagtgatgttcattctttcaagtagttagttaggtacctactatgagacaggcactgacctgggtcctgggggtacagtaatgaataaaatagattgagtcctgccctcatcaaatttaccttctgataagaaagacataaatgaaatgtacctataatgctcttgaaatagcacttgggatatagtaaatgctctataaatgtttgctattattactgtcattgttggtagtgttgttatgtggtatttctattaacacataaagaaactaaggttcacaggctgttagataagatgctggttaaatagctagtaagggactccaactcaggtcttcctgagtcataaaattcgtggcatttccactacactgatggatgtataccaggctgtacatcagaactatctgtggagacttaaagaaagtaaagattctcaagcctcagcctcaaattaactaaatcagaaattatttagacgagctaagaatctgtatttttttgaaaagttctcaaatagttgtgatacactgtcaaattggggaatgactgcactacattaaaatctttcccataatactttattatgcttatttgtaaatatcaaatctacaaattcactaaagaccatccccttgttttcttatttatttttattttttctgcttcctctcctagcaaagtgccttataaacactcaataagtatttgagtaattaatggcttaattatttaaagttgcacttaaaatgcaaatactcacagctgtggtactggaagcctgttatgaacaatcatttatcttcctagggttatttactaatcagctaaggacaagcagttgggaaagaaaggctgactatttgggaacagaactgagaaggccctcaaaccaaatgttagccacgttattgaacagcctagggccccgccttaactttacctacacttcgttgacaatttcaggtaaaatgcagaaaatatacgctaacaatcaggagattcctccctcacaccattgtagtttcatttcttttaagccgacacatgtctctcttatggaaaatatgggaacaacctgttttaaagaaagaaaaagaatcctttattcttgtcacaccacaaacatggagttcactgctatacgttaagattataaagcaaaatcccaaaaacgcagtgactgattattcacagtagacatatgaagtcaggaagcttattttttctctctttgctaaggcacaaagcctggggctatatgcatttttattacactgtactgtgttgatttcacttgaggattaaaaagagagttgaggcacagtgcacgtatcttgatggattttaggatttcttgctttcgtgaaagaaagaagcttataaagtacctcagattatcgcccagggaagtgtacctacttccatgatgacctagaaattcaatcttttgtttctcctataaaagatcacattgtactttggatgttttccctgtagttttctgcactatgtaaagccacatttggaaaaacaaaatagttttagtttagagttgaagtgaaaatatctgaaatagttcaggaaagtcttatgagcatttggggagcttacaaacagccttgggggtggggtgagggggaatgagggaagagggaggcagggggagagaagaggagggctaggtcagaagtgtgcaaagaagacagagggagagagaccgtagagactgtgagtccatggcagagttttaattctggttctcacacatctacacagagaaacaatggaagcacattgctccatcccctgtcctttactaagaagcgtgaagtaaataacttgtggcttatgatatgcgaagaagagagaagacagaatgttgtaggatttggaagtacagtagatgagatcttccggtttattgatttgtaaagaacggcttgatactggtttgtcagttctgcatcagtgagagaaaagaaaggcgcttttcagtcacttgccagaggaggagagccgggaagtggaaacagggtcttctggcggacaagcttccttgagtggtggtcaaattgactgtgaagggagtcaaggtcaggaagctttggaaatgctgcaaggatggtacgggatttaaggagggttgatttcctcggttaagggttgttgcagacttcagcaaattcccccttccagcctttattaaagaagtgtttagtagaacaaactgaaaatctacaagtatattgttacccaaaatataaaagcttctgccactgagatgaaaatgtttgatttccagtgctttatctttttgcatttatctacctgtttcagtcattcgttaatatgaatttcctaatatatgccgtcttttttttttttttcggacaataccagttctatggtatctcactgatgattatttcaaattgccacttttgttccttggaaatactcctgtgttcaaataccaggaggcataattatgtaattaccatgtgaacattatgctacttatgggccaaaatgcccctagaaaggaatgctccaatggcctcagaaaatttctgtgagaacgatatcttccaaatgtggtataaataaagctcaagaataaatagctaaggctggaatgtaaatgatttaatgtaatgatgttgtaaggtgagagccacttgactttagttcctgttgcaaatcatgagatacattaggaaaacttttaaaagggaacctattttttaagataaaatctgtatcaagttacatcaccttccaggcaaagtaattcaactttcctcttttctctctgagaccaaaaaaaaaaaaaaaaaaaaaggcagaagaaatgcttcctatgatctcttctcttcctgtcacaattttcataagtctgtagatgtaattaaaactaaagattttgacaaatgaaacaggataggaggttgattgctgcttttctaaattaaaatgaatgatacccttaaggtacttgggtctatgaagtcaatttaatgttgatataacctgactccattatcacagaatgaggcagttgcataagcaagaaaaccaataaacaaacatccaaagtgcattttagaaatcggtgaggtgaaagattaaaggcttaacaacggacaaagagcttgctgttttgttctctcttgccttccagtttgatggcagagttcatcagaattagaggaagaatgttcttggagaagcgttgggctggcactaggctaggagtcctattcatatcctgcctcgcttgtcttgcaagcatgcacagccccttcatttgaggcactgtttgcctcagcagagtctgtgtactcttctggtaggttgtatagaacataataaagggggagggctggaggagaaaggacagaaaaaggagggaataaaaaaaggagtcagattaagaaagaagtcagcacagaaatataaaatggaaggaaaaaaagctgtgatgcaggaaccttaaaaggtagattaaggatggtctcagatggcacggcattagtatcaatgccataagtcacacaaaatctattaagaattatgctcctactcagagtgagtgccatgttagcactagttgtttcccgtgatctatcctgaagtcaaacgcaagaaacactgtttaactcctaagtgccctaatgtcaggaaaacacagaaataaactcaaaggaaagacaattcagttaatctttgcattcaacaagcccaggttgttttgccgcagagctatacctatcacaaaacttcattccagaagatggccggtagaggtggctcatgcctgtaatcccagcactctgggaggcccaggagagtttgaaatcaagaccagaacttatctcagacttttttttttattattattttttcagttacaactcaaaagaatcagaattagaataataatggattttaactgaaagggattaccattagttaaaaggattttaactgaaactgtaatcagtctcaggagcgtttcccggataatgtttgggcacgtatttatgagtgttacttgtgaggatttgggagtaagaatgaacgaggaagttcctcccccaacacagacacatgcacacagaaactgtacaaactgaaaaacttcaggacaaaaactcgtgaatagactggagagtcatttgtgtgcatatgtgtggtttatttactagcatcacagcacaagagtttctgtcttttgcttttgtttttgttttaataggctcatttgtgtaagtgtcatgtctgtttcttgcattcccatggatatttatctagggtctagacaaactgagaaccagaaaatcaaaacatacgttcctagttacatattttctctagactggagtaaacatgatttatgtatgtagtaatcagtaagatgtagcttggacactaggaagaaaccacattgcctagcagtgtatttccacatggggaggtaatgcctgtctctcctaaacttctagtgaagataaaactcaaagtagagtaattaacagaaaggtcaaaagacaaagtggaagcccttgagaatctaaaacaaagttaaagaaccaacatttacatttagataaatttatttgaaataatttctaagagccatgatgttgttatcggtcctttttctttctttcttttattcttttggcttatttaaaagcaatgttgaagaaaaaatgaaataaagcttatctttcacaatacacagaggaatggactgagctttgggaaacagtcacagcttggaattaagagtgtgtgtcatatcgtaatttagttggatgatttggtgctcattcattatacccagaattacgctttcaagtctaccgtattcatacttatctcagtgcctgacaaataagaggaactcaaaaagcctttcattcattcatccattcagtatttcttgatcatcttctatgtactaggcattgtgataaattcttaacaagacagataagatctctgtctttgtggacaataaacttacattctagtcaatatcttttgaatgaatgtagtgatatttcttactgaagctaagaaaggaaggtctctgcaaacagtatactgtctacagaactcatctgaaatgagaagaccaaggagaataatatatagccctcataactctcaaatcttaaatatgattatttaaaaactagagtaaaacaaatgtggaggagatttggacttcagggttgttttataaattgccgttttacatttttaaatctagtattataggcaaaattgaatctaaatggttttcttcttttcttttttttactttcatcatcaaaaatggaagaaaggaagaaaaggaggaaggaagaaaagaaggaaaggaagaagggagggagggaagtttttcaaaagcttgtgtcagggatcttgaaaaagaaatgattcattcaaaatatagttgttaatagtaaagatccgtgaataaacagtacattaattcattcaactaatattaatttagcacctattatatgccaggtactgtgctactcactgaggatttagcagggaaagatgtgtccctgtcctcatggaacatataaaaaaggacctttttttcctgagatgcttttactgaagaattgctgcaacctagattatgagttctcatggaccagatggcagttttctgcccatctgggatagttctgaagaatagaccctcgtgtatcaatcaaggtttcttccagttctaagctttcgtgatctatgatctaatagttgaaacaggatgtatgcttccaaaaagatgttatatttgtattacttttataaaaggaaacagagacatgccctattaattcagaagagattgggttcctcctggctgtttaaatcattctatttaaactcctttatctcttctttcttggctcaccttccaaagctcactcttaccccttttagtctcacttccctttcctttctttaattgctgagacaaattgttcatctctaactggctatacatgacatctccagttaaatgtttcactgttaggacaaattcattatgttccaaatgaattcatacatacatatgctatttcttccttttctgattttcatattgccaccagcaatatcttcattctcccagtcttccttactcgaaatccaagagtttatttgcttcttcagatattaatctccaacaccaaattggatagttcttcctcctttcaaaataccttctcatatgtaccttcttttacattgaatacaatacagccttaattctaatgcatatcaacccaagtctagtaagttacaacagcctctttctgatctcagtctcaggtgccctttcgaatctgttttacactatactgatcttcccaaaccctaactttcctctaaaatagtgagtcatgtcacagaaattttcagtggttctctttgcctgcagggtaaatcttgagcctcagagtctgggacgccttgctttgcatcatcggctttcaacatgactaactaattgtatctcactgtcgtcctcaacaccactgttctgcagccccaagcctttcttcagcttgtcactacttcttacctccaaacctttacacttgcagagatcagggactatagcatttgttttttgcctatctctttcaatattaacaaatacttataaaatgaataaaccaccaaggaaagaactgattgtgccagaacataagacacaggtatatcatttctggcttttgcttcctgttttgtatataccacggtatattgatttaacatacagccagttagaaagatctaatgcatggaggctctcgtttaatagattatcaaatttcatttccttgcataattgctcaaagaataaagtgctttgttcctaagtcccaagctaaagctttcgaggactttggttgctttcaagtttttctcattcataaatttgtttctttatttagccagttgtgcattcaatccacacaaaacctttctccagtgataatttgtggaaagaaatattttatgcttaattcttctcgctgtcataccttctcttaagtttgagttatgaagatggaaattcactttgatctcattttaaaatcttgacaatattgaatgtacactggaaactaccactggagcgctccttgtataagaaggcaaaattcttcagagattgggagtctagaatgaactttgatgctgcatcggctcagtccctatgaaactaacattcttactagagaaagtggcctatggcacagtcataatcctttaccatctacatcttccccttgggatttctttctcagtatgtgaaaagatttctgatcagtgtccactcccatatggcatcttcatcttctcctctctacccccaaacactcacatttatctctagattgatttattcatgaaatgacccattctaaatttagaaataatgacatatgcccaacatttatttgcacgcgttttcccacaacctttctctataatcttatggtatcacattcttcaagaccaggaattgaccttgcattgggccataaaatacgttgaacaactgcagtttcatcgatatgcacactagaattggtctgcattcaataaactgattaaagaaattaaaaagccaattacttattaaatatttataaaatactttttttcaactttaatcttcaggatagcagttaagagcaagacccagactgaatgagtttgaatcctagctctgccaatttactaactactgaagcttaggcaagttttttttttttaacctctcatgcctcagtttttatgtcaatgaagtgggggggaataatattaactcctattgcagagttactgtgaagatgaaataacataattcatattgtcatgccacatattgcttaataaacattagccatttttgtattgtatgtggtgccctgcacattatagtctattgctctccttttttgctttttttttttttttttttgagatggagtcttgttctgttacctaggctggagtgtagtgacacgatctcggcgcactgcaacctccacctctcagattcaagtgattctcctgtctcagcttcccgagtagctgggattacagatgcccaccaccacaccaagctaatttttgtatttttagtagagactgcgtttcatcatgttggccagaccggtctcgaactcctgacctcaagtgatccgcctgcctcggcctcccaaagtgctgggattacaggtgtgagtcaccatgcctggcctattcctctccttttattaaccataatagtagcaagaacagtagctggtaacatttattgagcaattaccacgtgacagaaactaggctaaatgctttacattgtatcatcttatttaattcccacaaaaccctataagttatattattttccacattttactgataaggaaagttaagaataatttacccagggacattgattagtcaaggttctccagagaaatagaagcaacaatatacatatgtatgtatgtatgtatatgtgtgtgtgtgtgtgtgtgtatatatgtatgtctatgtgtgtgtgaatatataaaattaagtattatctcatgcagttggagactaagaagtcccatgacctgctatctgcaagctagagagccaggaaaattggtagtgtgatttcagtcccagtctgaaggcctgagaaccaggggagttgatgatgtaaatcccagtgcaagtgcaggagaagactgacatcccagctcaagcaggcctgcagggaaaaaaggaacatgcctttttgttctgtttaggacctcaactgacaggatgatgcccgcccacattggggagggcaatctactgaatccactgaaccaaatgctaatcttgtctgcaaaacaccctcacagacacacccagaaatagtggtttacctgggcaccccatagtccagtcaacttgacacatagaattaaccattacagacctgcagtcagtgcactcagtgtcagtaggcatacttgtttgttccgcatcgcttctcttctcttctctctctctctctctctctctctctcacacacacacacacacacacacacacacacacacacacacgtaccacatttactcatttactcatccatttgtttggtcaactagtcattaaacaaatatttgctaccatttactatgtgcctcctgcagaaagggttggagacattcgaagagaaaggtaaacaaaaaatggtccctgctatcaagaagtttccaatctattgcaagacacactcatgtccatataactaaaatgaattatatgatagaagtgcttcaggtataaaccatatactgttagaatgctgaggaagccattaattctaacctgggagatgaggaagtaaacatataaacactaacagcattgatctgggagagaagtggggtaagagcattgccgagagaaggagcagcatgaagaagccacgcacaagagttatattggatggaatagtgcaggacaggcaggtagttttggtgggcttagcaggtagagtttgggagtgcagggtcataaggttgggaaggtaggtttgatatgtccctcatgcttttgtgtatataaaataaagtaaatcctgcattgtaggggaaccccacttggttatccacgtatttgggccaagcaaaaatgggcaagtctagggagagagtgaaaaaatgagattgttctggatatacactaggcacttaattgatattggaaggccagagttggtttgagaccaggctacctgagccacttttctgatgagattaacatcgatttttacctctcgggaattctgcacaccacgggaactaccccctgagttctgattgctctgtgcaagctctgatcaacccctagtttagcatggactgttcacaactaaatcaaaatccagagttagagagctaggatgcctggagccaccacttatattggattggcaaaatgccaaataagtaagtatagcatgtcacccgtaaaattattcctttcttccccaccaagaatagaactcactaagttgacagcacactgtgtcaatatattatagaaaaacctaataggaagaaaagaatggcagttttcactgcatgccccctaaaggtatatttcttaataatttccaagtccactgaaaactgaattccgaaaattagttttatcttactacccaccctattttatcccaaatttaagccttgcctgtacttctttgatacttaatatttttttctttgaggtggagtttcactctgtcacccaggctggagtacagtggcgtgatctctgctcactgcagcctccctcctgcctcagcctccctaggagctgggactacaggcatgcgccaccacacctgactaatttttgtatttctagtagagacgggttttcaccatgttggccaggctggcctcgaacttatgacctcaagtgatccagccaacttggcctcccaaagtgctgggattacaggcatgagtcactgtgcccagcccataattaaatattaatcaaccactggttaattaataattatcaataattaaatatcactcaatgatttattatctattaatcaatattgcttctttaaaaatttgtcaaaaacaatagcctaagacttaaagacaagacatgtcatttctgagattctgtagtcacctataccaaatgtcaccctccctaatgtttttgtgaaagtaaagatttgtatttttttatggtactaattgaagcagtagttcatttgtggctgccaatgagttgactgtaaaaaaaaaccaaaatctcattttaacattgtcgagagaggaaatcctttgtgtttggccttggattgataaaaacgagtctggaatactatatacggtaagtgaatattaaaactagagttatgaaatgttgctttagtgttctcagtcttggagactcaaagtatcttatcagaaaggatacattgttttaattgttcctcattatatagaatgagagaacatcatttctctccttttcctcccaggtggccgtcgaggaccgagtcaggcagctgcatgaagcccacagggactttggtccagcatctcagcactttctttccagtaagtcattttcagcttttatcacttaactttattgcatcttgattaataagaataacagttgaaaaaacaaaagaattaagagttgaattatagtaatcttttatcagatgcagtagaagcataaatcatcctgaaatataacttggttgataagttgagaaggttaggaagaggaaggccaattggatcattttgtccagtcttcagctaatgcataattgtttcctgcactatattctcaaatgttaaccatattaatatttttgagtctttttgaaaaatgtggaacactttgctcaggagccatgctagtattctctgtatcattattccaatgttagtatatgggctgctgaagcaaaaacatacttttgagtttttaatttctgcctatcagttcagttcataaagctaataattatgatatcatgtaattataatatgatcatccaatatatgttactgtgactctataattctttaaataattcattaaatgatccctgccttatgaaatgagtgacaattctcaaaagaaggcatacaaatggccaacaggtatatgaaaaaatgctcaacatcactaatcaccagggaaatgcaaatcaagaccacatgatatatcgtcttaccccaattagaatggctattattcaaaagacaaaaaataacagattctggtgagaatgtgaagaaagggaactcttttacagtgttgatgaaaatgtaacagtaaattagtaacagtatgaagattctcaacaaactgtaaatagaactaccttaccatctggcaatcccactactggttatccatcccaaagctaagaaatcagtatatcaaaagggtacctgcacttgcatgcttatcacagcactgtttaaaacagcaaagatgtgaaatcaacctaagtgtatatcaacagatgaatggataaagaatatgtggtatctgtacacaatgaaacactgcaagaatgaaaccatgtcattcacagcaacatggatggaactggaggtcattatgttaagtgaaataaccctggcacagaaagacaaaaatcgcatgttcttactcttgtgggagctaaaaaaattgataataaacatagaatagaatgatagatactagtggctgggaaaggtgtgtgggtagagggggagataaagagagggtggttaatgggtacaaacatccagttagatagaaggactacgttatatcatttgacagcagaatagagtgactgtagttaacaacgatgtgttgtatatttcaaagtaccaagaagaaagggcttgaattgttcccaatacatagacaaatgacaaatactcaaagtaatggatgcctcaaataccctgacttgatcattatgcattctatgccagtaaaatatcacattacctcataaatatgtaaaatattatatatcaataataaataaatactatgcctccaagttgaaacctcagcctatgggcatttcctttccctaactgtttgcatccttcttttttttttttttttttttttttttttttttttttgagagggagcctcattctgtcacccaggctgtgagtgcagtggcgtgatcttggctcactgcaacctccgcctcccgggttcaaactattctcctgcctcagcctcccgagtagctgggactacaggtgtacaccaccaggcccagataatttttgtatttttttagtagagacgaggcttcaccacattggtcaggctggtctcgagctcctgacctcaagtgatccactcgccttggcctcccaaagtgctaggattacattcgtgagccttgtattctccttttgttcttgacctctagccattctttttatttactggttttgctattttattaattatgtttttataattaatactaagagaaataaccttggttaactgaaagtttaagtattagaaaatcctatttatacaatattgcatattaaattggcaagcacctgttttcctctgattaatgttaatttataccactttttatttgattataaaagtatatgtgttgagttttttggtatttaaaaagccatactttaccacatggagttaacatctgttagcattctgatgtatttccttgtggtcatatatgagtatatatgagggtttatccatcattttaacgcaattactttgtgcctagaaatgttacagattttaactagtttaatccttatagcaatcccttcaatcccttaaggtaggtaccattattatacccatttcaatgatgaagaaactgaggcacacattcatacagctagtagatgagggagccaggattgaaactcaagaagttggctccagagtctgtgtttttaagcatcgcactgtaattttacttaatttatatattttatagagaggaagtaattctgtatgatctccattcttctgccatattctttcattgccattttctgatcatttcctttcttttccattctccacgggttaataaaaagatccacgctcacaaatactttaaagtatttgagtagatgttgtcatgtgtgtctccagttggctgttgtctttttgaacaaaatttcctggaaggtgttggtcctgtgtttttgtcatacatcgataatagattaagaagaagtatcttattttctggactggctctaactttattatccgcatgtggtctagttatttggacacagtttcacaatgctttggagttgccaagaaaaagggataagttaaagcagtttatctaaatgagtgggatcgtggcttttaggaacggctctagaaaaatgataaaggctacagatttcgtcttctgcatctttccaaatctctggtctacttaacttgccttggtgacagccattctattcgatttaattgagattaaatgtgataacatactcctaagcgactcataaaccataaataaaaaatagtactattatgaatattaattactcctcagacaccaggtatattcattcatattttcttctccctgactccccctctgaattcccatgtcttacccattaaaacctattttcagaaaatgatatactcatttaacccaagtgataggtaaagtttaatgtgtacttctcctgggttatttgcattttattagtgtgaaaatccataagcctgaggtggtagaacatcggccataagctctgagctgtgaggaaggaactttgaggggccaaggggagcattctcacacctttcaaaccatatcacatcagtgcccacttccagaaaggtcaggcctgttagacacaggtattcataaagagactgatctacctgcctgaatggagccagccccggaagtcatcagtctcttggatgcccatgtggaatatcaatatacgcttaaaagctttgcttgcaggtataaagaaaataccaacttggtttaagggatatttaagaaataggacggtgagactaaggatggattgtttctttacattgtactttttaaaattacaaaggtactctatacacatcaagaaaaatttggaaagcccacagtacaaacaagaaaagaaaaagtatccataatcctatgactcagagataatcactatcagaaatttggtttatatactttctgtatttctcttgtggttgcgtgtgtgtgtgtgtgtgtgtatcaaggttctatcttttatttttttatttttttgttttttgagacagagtgcaatctcagctcactgcaacctcccccgtcctgggttctagcgattctcatgactcagcctcccgagtagctgggattacaggaatacgccaccacgcttggctaattttttgtatttttagtagagacggggtttcactatgttggccaggctggtctcgaacttgtggcctcaagtaatccacccactgaggcctcccaaagtgttgagattacaggcatgagccaccacgcccggcctctctcttttcttttaaaccatgcgcagataaaaacatgctacagttttatgagctgcttttttcccttaaaactatctttccaatattttcgtgtgtttaaatattcttcttcagagtaatttttctaatgactggctaatactctcttctgtggctgtaccaaatttaccaacacaattctaaattgctcaatataaagattatttcacaatctttattatatcgagcattatggctaatatcctttttatacctttacaaatatctcagattctttctacaggataaatgcctaaaggtggaattgccatgttaaagaatgtttacattcgtaagccttttcaagtgtattgccaaacttacctctagaaaattgcaccagaaattgggtgtgccatccaaaccgtatttgagctaggcatggtgtggctcatgcctataatcccaattctttgggaaactgaggcaggaggatcacttgagcccaagaggtcaaggctgcagtgatccataatccacccccccccgcactccaatctgtgtgacagagcaagaccctgaccctaaatttaaaaaaaaaaaaaaaatcaccatatttgaagcaggacatctctgaagtcacgtatttgctactataaaagcagcttccccccaccaatgaataaaaatatgttttaaatattcctctaaggtcatattaaatgaatttgaattgatacttttttttagacaggcctgagttgatacatgtttagtaatgtgctttcaggttactataaataataatagggtggctcctaaagcttagaaattacaaagaaaagaaaaataaggaggaactactaattgcacccgccagcataaacatgcttactgtctctgtttatcttattctctctctctctctgtctcgcacgtgtgtgcactctctctctctctctcacacacacacacacacacacacacacacacacacactcccctttggaaattatttggaaattacattaccagctgtctgttgtttatcagaagacagaggcagccttttactaaaaaaaagaattcactgtttcttcctggtggcccaatctctacatgttaaagaaattttttcttttatcttagatctaagagaaaatgagaagagaaaagcgttgtgaaatatgacccttctccgctgatagacactaacttgtccttacttctagttttaatacactgctactcctaattgacttctacaacttaaaccaagaaaaaggagaaattctaatagtgtgacttcaaatatgtatataatttacaataaaattatcatttaaattatttaaattatatactaatttatagttatatatgtataattggtaggtatattgtcagtctcttcatatgtctgtgattaagaaagtactaaagtattcattggttggcatagtagtctgaaaattgtccttttcttttgaagagtttaaagatttgttgggcgtggtggctcacacctgtaatcccatcactttgggaggctgaggtgggcagatcacttgaggtcaggagttcaagaccagcctggccaacctggtgaaacccccatctgtactaaaaatacaaaaattagctgggcgtggtggcactcgcctgtaatcccagctgcttaggaggctgaggcaggagaatggcttgaaccctggaggtggaggttgcagtgagctgagatcatgccactgcagtccagcctgggtgatagagagagactctgtctcaaaaaaagaatttaaagatttttcctgaccattatttcaattctctggtcttctgttctaaattctacttttctcaccaagaaagatcactatatatttgggtaaagggagaaatcattctataacagtaaaaagaatccatggttttcttaatattttacaagttccagaggtcccttaaaagaatattttccaagccaggttctttaaaacattaatgttatattaggttttgataactgtcccttgaaaaaaatagtactgattaataagattggaaaaacactaggtttcaaagataagcaagtttatttcttgttagaattcttggaatttttattatacactgagactctaagaggataaggagtctatagttctccagttttaggtgactgtggaagcctttttcaggcacaccagttaatttcacactaaactttatgccatggatcacagtgaatctttgccttaatgtggtatttgccagatgctttaatgacaaaaaatttctgctaaaggttgtagaaacgtgatccaattaaaaagaaaatgagtatttatgaggcaaaagggtcaagtccctctctttactgaagttcccagccccactcccacccaggagccctcttgtgctgtggagtttcctaactggagataagcttagaaagtatctataccagtagtttccaaactctgaggtgtggctcattagcaaatcctaaaatcagtttaatgacttacaaccaacaatttttgactggtatggaatggaatggaatggaacagattagaaaatatcagagtgcattacctaagcaaggttaagtgttgttttggcggtggttaatttgttagatgtgtgtgtacatgcgtgtgtgtgtgtgtgtgtgtgtgtgcgcgcgcgcacgcacgcgcgcacgccagatcacagtgtaaaacgtttttcttctgtgggttgcagtcgaaatagtttgagaaacattgaatcattcgagccctttccttattttacagataatgaaataggtgcagaacgatcaaatgacataaccaaggtcacaaagatagttataatactgggactggaacccagtttctggacatccaagccacacatcacactgccttacccgttaagaagaaatgcccaggccaataactgtctagtctatctgctattgccaacgattattctctcgtatattcctcttcgtttggccatcctaagttgatttacataacctaaatttttctctcaacacctctgggctaaaaactgccttatcaaaatggtatcgatagcggttaagagtaaaagctgtaaaatgaaactgactgggttcaaatattgactcagacactttatgcttttttctttctctttattcttcatctttaaaatagggataatagtaacatatttggtcaattgtaagacacacttttccacccacgtttcaacagttctgaaatcagaatgcaccatacgaccaatgggatattgaattcggtgaaatatggctgtattatttcatagggttacagtgaagatcaaacagttaatatttgtaaaacccttagagtagtgcctggaacatagtaagtgctattcaagtgtttgctattagctttagcattagtatcattattactatcagcttgatagtataacttaatgcatgcctgttagagtcaaactagtcatgaaagtttcattcattctcttgcatttaatggtcagtataagtagttcctctcctttctgaagatgatttccaaggatctaatctgaaagtccagtgttttgcacattagaacggctcaatagttgtttgtataactaacgagtgataaataatcaaaaagatagaccttaatctctaaaacgtcaggatagtattagtcttgttgacagttatattctacagtacctaatgtggtatgtggtacttagtagatgttcagtaaatatttacagaatgaattatgtcttatacccaaaagaagaagaggtaaattcactcttgacattgataatacacagaggcatgagatttagcatagtggctatcacatagtagacactcaataaataatgtgaccttttctgttgcttctcagcaaagactaatagcattcataactttatatggtcgtttttatcaaagtcgactgtaccatgtaatacattaagggaaaaggctgacttcaaaattacagcatgatcacaactatattacaaaataaaataaaaataacagaaatgtacacataaaggaaaaatggaaaataaaaagataccaaaagacaaacagttattgcatcatttctttctttttacttttacaaattttctggtaatagcatgtactacctttgtaatggaaaaaaaacaataaaggtaacattttatactccagcttttaaccagtgacctcttgcagtggcaatgggactctgaaagacaaatttcctttttactatttattctgaatttaaaagctgtttcattgagtgaccttctcagattatgagacactgtaaaaagaaataactgatccattatttcttgcaggctttacaatcttaactgccttaatcatatccctggttaagtctttttctctcttgtcaaagtgactcaagcttttacagtttctccttgatacatagggcctagcagtttgtttctatcttgagagttgccaagctttcatcctggacattccccactacacatacacacttaattttaaaaaataggggaaacctttaagcacatctaataattgctgacatttcacttaacagtgctccaacctatgctaccagtgtcctcaggggacagacaatttgaaatatgagtggggcaataatttaaagcttcagattggcttaaataagccatcatgaggccgggtgcggtggctcacgccagtaatcccagcactttgggaggccgaggcgggcagatcacctgaggtcaggagttcaagaccagcctgaccaacatggagaaaccctgtctctactaaaaatacaaaattagctgggcgtggtggcatgcatctgtaatcccagctactcgagaggctgaggcaggagaatcacttgaacccaggaggcagaggttgcagtgagccgagattgtgccattgcactccagcctgggcaacaagagtgaaactgcatctcaaaaaaataaaaacatcaaaataagccatcatgataaaagtcagaaagaattttgcaggtccaatgtgagatgatttgcaggctaaaattctctttcaagtaaaatctcagggtgaaatgatttgagccagtttcttcagcagtcacatgttgtcccaagtgttaggaatttgggacaaatgccatgtgacctaccagtgatgctgataatgcccctataaattcaaagacagcctttccaatgcccataaaaagcagctacagcagtaataattatattctcttcttaaaatgtgttgtcatggcccttttctcctttagctcaaatgtatactccccaataagctctcagatttatttgctttacagtatcattagcaaccagattttgcatcgttggccctatatatcccatcaatttgaacacatgaggaaacagaacgtttttgtttctgctatgggaatttctgtgctggggctggcttacaatggctcaagagagccaattgtaaaatatacaggaattgtgagctagttattaagcctacctttggtagcttgaaatcaggcatagtgggaagatttactccatggaaattggcaaatactacaaattggggcactttgttttttttttttttttttgtgcatagatggtttcccagaaatgactaatttatctatgttatttggatcactcaagtccctgtaggcaaagaatcttcataaacttagcaggaaggatgctcaggatccaaatatttatgtgcgttgcagagtgaccactcatcctggtttgtctgggactttcccggatttagcactggaattcccattttccaggaaatctctgtagtcccaggcaaaccaagatagttgctcaccctagccttaggtaaaatccctagaagtagagccctatttagatagatggggcttcttgtagaagtaatttgttcaggtgaaagggagtgagggaagcaggataaagtaagaaggatgctggtcaaggagttaagtgggaaggaagagactcacttcagcttgatcccacagggagctctggagaacaaattgtccctactttgagataaggggcctgggctttttgtttgtttgttttgagatggagtcttgttctgtcacccaaactggagtgcaatggcgtgatcttggctcactgcaacctccgcctcccaggttcaagctattctcctgcctcagcctcccgagtagctgggactaccgcgcctggatttttttttttttttttttttttgtatttttactagagacggggtttcactaggttggccaggctggtctcgaactcctgatctcctgatccgcctgcctcggtctccaaaagtgctgggattacaggcgtgagccaccgcgcccagccagggctgggcttttattttcccgtgtgaattagtcattggctgtggatttctggggagtaggagatagcaaagcagttcccatttggccaagggaggatttctggtgaaaggaccaatgaggccttagcaaccaacactcacaacaactgcggctgggtgaaccagctcagtaaaagggatctgagtggaacaacaatagtattaacctctcctagactttatgaagctgctatcataccccatgcataatctggctttagagctgaatgggcgcatttagctggatcactaaccaccactccttcgtcacgtacttacatggaaattagcccggtggcatggaagagatgagacaaatgtctgtttctttcttatttcatcttcctcattgtgacagattcttctgggcctcatgaggagctagggcaaagagaccagcaccagagttctgaatcagttttataacatgggcactattttggtggaatgctggctctgaagggtgtatttttacactacccagaaaatgaaggcatttgtgaatttggcctggggtagcattttgtcatctgtccaaaatacaaagctttgcacaacagaaatagtgggatcacatccctgtgggcaagaatcattactttcgtttttccatttggatgttttccattttcagaacacaaccagtttgggattacaaagtactttctggtgagaactttgaagtgaggacaaaaggcattttgttctttagtagacttacataaactgttcctggtttaaaaaccattctagatttttaaatagactttcagatatctgcagtaaaaatcatcttgatttcaggcgactgcaggtactgctctgttatgtgctatgtctccttaaggctgtaagggacagggataggcttaggtgataaggaacattttcaggatacagagaggcatgaagaataacatgggccgggcgcggtggctcacacctataatcccagcactttgggaggctgaggcgggcggatcacgaggtcaggagttggagaccaacctggccaacatggtgaaaccctgtctctactaaagacacaaaaaattagccaggcatggtggcgcacacctgtaatcccagctactcaggaggctgaggcaggagaatcgcttgaacccaggagatggaggttgcagtgagccaagatcacaccattgcacaccagcctaggcaacagggcgagactccatctcaaaaaaaaaaaaaaagaaagaaagaaaagaataacatggaacaacagacaccacgaaacatgtttgcttctttctgtatatgcatttgctgccatagacttcagactattacagtatcatatcttctctcttctctccacctaacaccttctacttatagtttctactttcttatgacttccattttcttcctttgttatccgactttttaaacttccccacccatctgtcatctctgtttatctctgtgtattacattcaagctctccaagaaaaagcatctgattggattagttatttattatccatctaagggtaatgccatctcacaggccacaggccagactgtaaactaggctttcttgacctgggcactattggcatttggggccagataattagtggaatgctggctctgaaaagtgtatttttacactactcagaaaataaaggcatttgtgagtttggcctggggtagcattttgtcatctgtcctagaatacaaagctttgcgcagcagaaatggtgggatcacacctctgtgggcaaaaattattgggggctgtcctgtgcattatctctggcctctactcactacatgccagtagcactcccctcccttagctgtgacaaccaaaaatgtctccagacattgtctgatgtcccctgttgggtgaaattgcccctagttgagaatcactcctttataccaatgcctgcacaatttgtggtaatgaaagtcatgtggaacactaaatacagtgacctatgcctgaggaattatttgaagttgcttttctgcatccttagggaccctttagtctctcgatgaaagggagtgtcctcagcagacaatcttcaggaattgcatcagctgcctcacccaagatcataccccttacaggggcagctcttcctgatcagtgtaggggaataatgacctggccattttggcccaactcaggagaacattaacattctagctcaagagctcccatggggttgaatgagactgtcactgggtctgcattcaccttgacttctccctatttctattcctgtttctttcacttcccttccacagttgtctatcctgctctctaatcattgccttagagttggcttcctggaggaagccaatctgtgagggggcaatgaaattgacaggcatttagaagcatctaagaaaaaggtattataataggcccattacagtcactgggtaatttgatttactcttgctttcataatgaggttgattattttgttcaggataagtagtgattattattatttaaggtgtccaacctcatgatctccattaataggtaaggactttggggacagcataaaattacatgaatctcttaccttaaaccttaagctcagcagcatacatgcccatgacaggcaagagttagaacgtaagaggtcagtaannnnnnnnnnnnnnnnnnnntcagtaacatagatcttgaaaggaaatatgttggagtgtgagcactttaagggcatagagcctgcattacttttttattaaaaataattttgcatctaacacaacatcttgcatattagatgcaggatatgccttgattgaatgaataactgggcacttaaaagattgttcccagtctaataaaatgaaagaacttagcctagtgcttagtctaatgtccagaaagagttaatgaacttcactttatcttcagtcagttaagaattgattcactttgttactcaacaaatgtctgttgaatgaccaatgtaaatcaaactctgatctaggaactggggaaacggcagtaaataaaacaaagtttatttattgtggagcttacattttaacaagagaagatggacaatcaggtcatgataagtttgatttaaaaacaaagaataaagcaggctaaaggggctagaggatgggagaaggggacccttttagtggagtggtcaggaatggtgacatttcagtagagatgtgaggaagtacaccagtcagatattgggggacaaagtgttccaggtggaggaaacagtaaaagtaaaggatccaagatggagcatgcttagagggtttgagaaatattaatagcaaggaagccagtatgactgaagccaaggaagaaagatggtgaatgataggaggtcagtgagtgaccaagggccagacgaggaagggtcttatcaactatggttggctatcgttaaaagcctttggcatatatgctttgtgagaagggaagtcatagaattctgagctaagaagtgacatggtgcctgtagcattgttacttactgtgcctgtagtattcattcattcattcctatatttattaacaaaaacgagtcacctgaaatatgaagataaaaagagaattattgccttgggacatttaaataccaatcacaaaagacagacctataaaaaatgacctcctacagtggtagtaaatagtgggtgcaatgggagtagaatggaagggaggaatccattccacagtgagagaaaggagatgttctatctagttgagtattaacgcatattgtccctgaggctacatgcaaatccaaagtagagggtattccttttgataggaacttagcaaagaatgtttataattgcttggtccctgatctcacctagcaagagtcacaagatgcattcagtgatgaaaaatcagtttctcccttctacttagccattctgataagatgaatatctcgggccgggcgcggtggctcacgcctgtgatcccagcactttgggaggccaaggtgggtggatcacctgaggtcaggagttcaagaccagcctgaccaacatggtgaaaccccgtctctactgaaaaatacaaaagttagctgggcatggtgacaggcacctgtaatcccagctacttgggaggctgaggcaggagaattgcttgaacccaggaggcggaggttgcagtgagccgagatcgcgccattgcgctccagcctgggtgacggagcaagactctgtatccaaaaaaaaaaaaaaagatgaatatctccctttccagtttcgtgtgtagtctccttacagcccttctgttcagaaaagggatttcttacgtatgtataatgaatataaatataggttttagagagcactaatgttttaatgagatagaaataggcagacgagagagaataattgaaggattagtcaacatgagggcaatttgatagggaaagaaaaagtctgagcaggaaatgtctgtggaaaaaaaaattcgaagaggaatggaatgaaatgagctcatttatggtgtgagttagggacagaagggatttattctcaggaggtgaaaagtgaaggagttcatgttatagaattcgacctagaccagctatcaagggaaagaaagtaattcaaaagacttggtccaggagatctggagcagatacatctattagaggaagattcagttttgaactgcatcttcagttattcctggaacccaacacaaaagctcatgacaaccttgttatcttcaggcaaaaaaaaaaaaaaaaaaaaaaaaaggcgggggcagcaaggcttatgtcttaaacaagacagcacataacttcaggtcagagaattccattaacatgaatcacccacaccaatttaaataggaaaaaaaatagtaagcttggttatgtaaaaatttagtttaaaaatcagaaccaacaattgaaattaaacaagaatgttttatttatttctaaaaatatttagctatttattttgaattctgaagcaatactaatatagtatataatgataaaacacagttgattttcatagtaaacatcagcatcagaatgccaagaggaagatttgtctccgttcatgttttattactctgagaaccgcgtaacattttttaaagagtcagaaaatggctagaaaaagaggaagaaagattatttccttaactagttccctggtcccatgctttggtggttaacagtcagtttaactctagaaccatggaaagtctctgtcactttcctggttaccctgggattcctcacattggcagtaagttcgtgaatgagataaatatcctgataactagctacattaatgatgaaaataattataaacgtaggagttggaatttttaaaaagtatcgagcgctctgtgctcttaacacagaggaagcattttgcatagattaacccgtttaatcctcacaccaacctttaaaataaggactgttattgtctccatttcacagaagagaaaactgagactagaacaatttactaacatattcaagttcatacttgtaactattatggattatcagccttagaaaaggggttccagacaccagtgaatagcaacccacacgtgctcaactgcacagaccaaagaggatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcgatctcttgacctcgtgatctgctcaccttggcctcccaaagtgctgggattacaggggtgagccaccgcgcccggccgaggtggaccctcttaatccccttaagttttaagtgcactacacagtattgttaactataggcactatgttgtacagcagatctctagaacttactcatcttgcataagtgaaactttatactcattgaataacaatttctcgtttcccctgccctgtcttctggcaaccacttttctatttactgcttctatgaggttgactatttcagacacttcataaaagtggagtcatacagcatttatccttctatgactggcttatttcactgagcatgtctgcaaggcccatccacattgtcaccaatggtaggaaccttcttttttttaatgctgaatggtattccattgtatgaaaatgtggtgtatacatgcagttctctttgtacgatcttccttccttaaagagtccagccattctcatagcatctgctatgattctagtacttatggtcttgtcctttcacttgcatttcagtgaaaagaaccaaacttatgctgatgcaaatacctgtacacaaatgttgataccagctttattcatgattgccaaatgctaatcagtctatgggcctctgattttcactgcataaaatatagactaatctgtttatcattcatgctgatgaatggtggataaatggtctagctaagaatgaaagatctgttgtatagatgtcattggtctaggaagacagagatgtagaaagaagtaccataagcccaggcagttagatactattcaaaggcatttctctctgccatactttatactacatgtggcacattaacagtagttaggagtggattcaaggctgcagataaatgctgcccaggtgagagagaaagaattggttccacaattaaccatcattcagacaacacatcatagctatgtgattacaaacattatttgtgtggtgattaacattttacaaagcaatttcatattgatttcctcattttatcctgacaacattttggtgagggagatatcattattcccattggaatataaggaaaataaggcttaggcaggaaaaagactagcttaagatcatgaagtgataggggagtcaggactcaaatccagttcttctgaatctgtactctggacattttctgctatatccagctccctctcaagatgctggattgggctttgaaatagaaagccaacatcctgagtgcctttctaaactctgagttttacagtctatcaggggaagaggagagtgtgagaggaatgttcccaaataatctactgtatcaagcagtatatctaacttgctttgagaattatgccaactaaatactattgacctgcagaaaattgatttttctctttacacttatatcaataaagagaggcttctgctgccataagtgtaatttatgtaaaatgtttttaaaacattcatagcctttaatcaagtaaatatacttctaggaattttgctttaaaaaattaactaaaatatgtgcaaagatttatctacaaagatgttcactgtggccttacttagaacagtgaaaaactggagacaacttatatgttcccaaagagggaatttattcaataaatcatggtacatccataagtgggaattttttagcaatgaaaaatctgttgtaaccctacaagcccactcttaagcattcatcttagagaaatgaaaacttatgcttatgcaaacacctgtacacaaatgttgataccagctttattcatgattgccaaatgctaaaagcaacctaatgtctttgaacaggtgaatggataactaagctgtagtacacccatataatggcatactacttagcaatgaaaagaaacaaatcgttgatacagcaatatggattatgcattatgctgagtgaaataaaccagtatcaaaaggttacatactgtatttatatgacattctggaaaagacaaaacaagtctagtagatcctccctaatgccttttgttcaaccccagaggtgagttttctattttacctccagtgattgctgtatcggttatttatctaaactgtccccacttttttgacccacctatgttatcaaactccaaatccaccaagtatgagaaaagtagagagatgaatgaaggtatttgtgttggaattccagaaagtgctcttttggcatgtcttaaaataacattagcattctttttaattttctggttaggcccctatgttgattaaaatatgacttaacaccagggtgcatcacttggaacattctgttcatcatgcatttaaaaacggctgaaataacaacttcccctaaataatgtggcctgtgcttgtgattttcaaaactaccttgggcacaatattgaatcctgtcacctcaaggaaggaaaagcatttgaagatagaattgctaccctttcttgctcttaataacatactgtgtctgtaacacaaaaggaaattcagaggttggttttgcaataaataaatgcatgtgtagtttgctatctaaattcagtggacaataccccatgatgctggtgccgtatgataatggttgatttgtacattcaagaatctgaatcacaaagctgccctggaattacacgtagtggttataagcacatctgtataagaaaataccaaaggacaacccggtgtcatatagaaactatttgccgataaatttgcttttgatgggctactaaaaatggacacatcaggcataaaagatgtgtgtgtctattacgtaggctagctttatgaagaatgacaagcttccactggtacactgagataagaaacagctgttgttggcatcagtactgctacaagaaatgaaaaaattctgtggcacacttgtgagcactgccacatatttgatcaacttttgaatagatggaagaccagaatcatctggcagccccaaatgaaattgtcgacaacccttaagaatctcttgagaaggagcactgaacccaattccgtagaactatcatccaattgtgtgttatttctaaagcaagtagttccagtgtgtgtgtatgtgattatgatggggcagggaaggaatgaggggaggctgttgttattttcctttttttttttttttttattgtgtcaaggacatttttgagcataaaattgtaaggtttcaaacaatgactgcaaagcagttgcttaggtgaatttataaactgtgaatcaaaggggaaaaacatctttcagaaaaaaaatacactgaatctcaccattggacctatttgatggctacacataagacaaaaagcttttttaaggaaaataaatgaacacttaagaactgcaattacaaaagcttgaaatttcatattgatctagaatttataatatttttaaaattctttaaaaatattttcagctatttagttcaagcatattctgataacttctctgacatttaattgaaaattttccccttttaatgtaaacataaaaagtcaactctagataccctacgtaggtcttcccattagctcagccaggcaacgccaattttcctctgtctctcgctgcttagaggttgtttctttcaggccgaaagcccctaagccaggccaggcagccagcagccctctccagcacacttctttctgagagacgcctaagaatagtgtaggaaatccaaagtgattcttctgctatcagaggatggtctagcatcctccaaattagaaagaatttctggaccactagaatgataaaaaaaaaaaaaaactagaaaggtataataagagaaattgtgaggcctcagcccatagatacctttaaggaaagaatagccattcttttctcagtttaggtattcacaggcttggcattcacagccagtgagggctggaccaagagctctctggagttctcttcttccttttatgatgctggtattttaagaagaaggtacactgagcagccaggagctataatttctggctctccaccatgtttcctgctatagagggctagctttttaatatttccataacaacagactctgaccagataggtcaggaagtctagcccatggtttgtttgtttgtttgtttgtttttcagttggagttttgctcttgtcgcccaggctggagtgcagtggtgcgatttcagctcactgcatcctttgcctcctgggttcaagtgattttcctgcctcagtctcccgagtagctgggattacaggcacctgccaccatgcccggcttttttttttttttttttttttggtatttttagtagagatagcgtttcctcatgttggccaggctggtcttgaactcctgaactcagatgatctgcctgcctcagcctcccaaagtgttgggattacaggcgtgagccaccacgcctggccttagcccatgtttttaaatcagatcttatttactctgtgaacttatttggacaggagagctgcatcctacagaagaaaaaaggacaagagaagagttgggaagagaatgagaaaggcaaagatggaaagggaagcagggaaggcaggaggaagggaaaagaaaggaatagagaaagaaggacagaaagaaatggaaagtcagagactacttcaaaacagcagctaaatgtcttttttctctgtattaaaaatttccgtctgccaaaatgaaaaagcataattaccggccaaatacaaatccatttcctatatcgtttaaatgacatatctccaaggtacaaaacagcatgtctggttaaaggttgggtgatttgatccctctattactctatataaaacaaagaagctggagtttcattacgcttaaattgtctggcagtgggtgaagttaacttttattagaagctgttctttcatattatacagtgtagtcgaggatatattagctttgacgttttcttacatctcaatacactgcggagtgaatttactgtgagactaatttaaaagggagtttttcataggaggaaataatggtcagcatcagctgtgcttcaaattattagcagaatgaaaattcaggggaaaaagtatagacacataaagttgctagatattaataagaatgcgtcttttatttctgtttctgataatattctgtgtttcttaaagctccagtgtcttaaaactatattcaggaggaagattatattgttgaggaaatgttatagtgcctcctcaacaagattattttgtcttaaagaaagaaaaaaaaccatcagatcaaacagtatataaaatatatttgtagaggttcagctttagggaagaaatcctacaacttaagcctgaaaaaaaaaaaaacaatgcaaagatcattcatttgaccaatacacagtgaagtcataataaaacaaattcctagtatgtgaaatgaaatttcacgtataggattcatcactcataacaaaagtcttattacgctctgatatcagtagacattccctcacttttggtcaccttttctaataagatcacactggtcagctgacattttgaggcaccaaattaagcatctatttggtaagtgaatttggattctctttaaaccaataaagataaaaacacaccatatcagagtgataagcatattactttagcttcaataacttagaatgtaaatatatcacagagggatatttcagctactgaaataataaaatccagtcagtcaaatagtaaaaaatattgagaaccagcaacaggaagtattataaaaaaaagcactcaagggagacacatacaagaaaccccgtcagtctactcattcagtttcttatctgttctataggtttagcagtggaaatgtttgtgggttttttttttcttcgcatttatctttgtgcctgaatgagttcagtttcgcttagattaggacagaaatttcagaacagcaggttaatccatcctgtcttcatgggcagctgagcaaacagaccaatatcagtgtaaaattgtaattctggagattaatgttgtctttcctgtttgcgatgaatttgacctccttgcctttctttttttcctcccttcttttcagcgtctgtccagggtccctgggagagagccatctcgccaaacaaagtgccctactatatcaagtaagttggaagtatcacatttttaaaagagcatttattgtgactaacctgtatattcacaagtgagtttatttttaaaatgcgacattagcctggcctacaatacctgtgtcttttttttcctgaggaagcttggataaaaaacttattctaaaattaccattgtaaatttgctgatgcaatggggaacgacttttaagaaaagtttatttaatgcaggatatatggtgtgttttgtgacagagggggcggatttttcacaatagaaccaaaagctccagataattttattgatagtgggagtcaatctttgcgagaacaatttcttttatttaggggttttctcacatttcttcttccgtcaaagatagaagatttccgcagttatatgtacacaactgttttgggtgaatgaatactacatgtttccaaaaggcagaaagcagcagtcctcgactcgtagggcttagttgttcattcttgatacataacactcagtatttgtcacctaacaacagaaagatactgttttctggaaacatttgtgccagtcaaaagaatacgagtgcttggaagcaccttctgtagtattttgcatgaaatataaatgacaatacattgggtcaacgtggaagagagaggagagaggatattgagtgattacgataccttcacagtctctcatccattgtgcactagagtctaacttaaatttaactttgaattggaaacctcaacaacaattacaatttactgggttcataaaatagtcctcgataccaaccgaagtctttgaacttgcttctgccatgagtctgactaaaaatattagatgttttcccatttttttccgcctgccatcttttatcgaatctgtttttattctttcactgtccatcaattcttcttaattcggttctaaagcaataacagcagtcctagatcttcattactacagtcctcaagaaatttgattttatgcctctattttgttaactcagaaaaatgggagtgaaggtagtcttttgactctttcaggagaaatacatactttaggaaacggtttaccatttgtcttattacatttttccagatgaggtatctcttaacttgaaaattcttttttagtatgtttgattctgctttttagttttcatattttatgaatttaattttattattgttatatttaattcattagtcactcaaaactgtacattttaaatacctatttaaatcacatgctttattaaataatatattgctgtagacatgcactgtatattaccttacatccactgtatattttatggaacaattttcttcaaactctagacagtgatttcctacatcagtgtctttgtcctcacaaatttttatttccgactaagatgtttgagacctgctacttcttcaaccaattcataaagctctcacttttatccaattcctttatgagctgaaataaagactctttttctcctttcatagatgaggttttaggatcactggagaattcaagacacctttaagctattattctccaaatgactacttgtttggggctcactagaggtctcacatggattgctagggtctccccggtcccattgtcctttccctatatattcatcttctccctgatgttacttctactacaagagatcccagtacattgctgtgagggaatggaaatgaactccgtccaaaaaataataaagagacaaattccagaaaagctgtaattcccttctgtgtattagtctcttgctgtttctcagtggaattagagagcagctacatatcctatttgtccaatgctccttcatgtacctaaagaccatggtgatggtattgataagggcacagatctatgaataagaaaacttcaattttagtcctccagtctagtcttagaggctctgtcattaggcgactgtatggctttaggcaagtcacttaacctataaaaatcttggtttctttccttttttttttttttttttttttttttgagatggagtttcactctgttgcccaggctggagtgcagtggcccgatctcggctcactgcaacccctgcctcccgggttcaagcaattctttcgtcttagctcccgagtagctgagactacaggcacctgccaccatgcttggctaatttttgtatttttagtagagacgaggtttcaccatattggtcaggctcgtctcgaactcctgacctcaggtgatccacccgcctcggcctcccaaagtgctgggattacaggcttgagccaccatgcccagccaaaccttggtttctaatttataaaataaagagttggactagatgatatctaaaatcctttttagctctaagacgtaatgagcatgactcattcagttgtcctgtccaaacttaaaaaccgaagatctcagcttttgttcgataatatctttatttttaaaattcattattttaatgaacataatgtaaattcttactttaaaaaacaggaattttatttttccactgtttaattagctttagatatgccctatcaacccactccaatttcaccacacacctctttaaagagctcaaatcttggtatataatttaggattattatgcttcctggctcatgataagagagagagaacaataggcaggaaaatttgccaaaaggtgagtatggagaccttaaaagcctctgaaataatcagttccttgaaatgaggaaattacgtaatttctcaaaaatatctctgaaaccttatggagagcaattctctctacaattataatctctttgaaattagggatggtataatttctcaaatatgagtgtaaaatgttaaactgtaatatagggaaaacatacatgtttataaaatgaacattgtcagtaagcagatgattaatggcacttgtgtcttattagccattactattatctaaaatgttctatggaaaccaaattaatttgatgtacaaggttcggtggactttatgcacagcttaatgccgttcataatctgagatgccgtcttggtctaaaaagaacaaaaatacgtttacagtgacagtgcttcaaccagtcctcatttttcctcttttttatcttgtttgtcttgacttccagtcaagagtttttaccacagatgcccagctgcaaaaccaggtgtcttctctggctatgtttttaatgctttgtaactttttcttttcaatgctgggataaagggatcgcccacataacaagaggtttctataccagtggcacagttcctgttggttgttgaattgtgcactcattcttgagattttaagtcattaacatcttttgctctagtttgcaaatcaggcagtgtttatgcctgcatcctgacatcagcttttcatatgaggctaagaaccttgattttgatacttcaaactacgtgtttgtctagtttatttgtccacagcatacatcattgttacagttttcatattccctctcccttggggctcccttattcctgccagcatctctttcaggttatttgattacagctttcattgccactgaaaaaataatcaccaacaatgttcaacctgttacaactgccttttctactctctgccattttgtagttttttggcctactgtcaaactcatgaaaatttcaatataatagcctttaaccagctgctgcattctgttaggatttctttcacctttttatgttgcatgctcccatatgggtaaaccaaacagagccaagagctgggactctcttgctttcttaatgagttagaaaattgttcttctgtattctggactgtcaaaagaatttaggaatcccaaacatgcatgcaggatgttccagtatagatgtcataataaaagcataagaaatatcacactgggtcagaccaacagggcaactagcccggaactctgtcccagatgaagataccaatggttgttttgtcaggtaacctagtacattttaccttaaaaattcggatacatcatgaccacttcttaataatgcattggaaatcaactggcagtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagaatgacatgatatcataggtcatttccagtactaacattttctgattttgtgaatgttgacttcgaaatagaaattgtttgtgatcattttccagagaagtgaaaatgaatcttcatattgcccttgaggattcttattgcaccatcaatcttatcgggatagaaaggacaaataatattaaatgtttcacttaactatttagcactattgatgataagaagtggatgcaacagagaatcagctgtctaatttgatctgtcagtctttgaggatgctggtgaatgattcggggtaattaaatttttgaaatcactgccaaaagcctgatgctctgacttttcaaaaggctttagtacacaaagataacccagaggtcaatcttctctgctgtgttttctcctctgccatttgatggtttcaaaggtcacgttacctgagtctcagtaagctctggaaccacaatgaaggaatagttggtaatacattattgatgatataatcatgaaaacaattcaggttaagatattaactgaaagagagtgaaaggggtgccatagtgttgtgcagagtactgagtctggttttggttttatagatcttgttgggagatgtagatgttgatatcatctgtgtctcataggttcatgaaaaaaaccctcacatccttttttgtagtttcataagctgatttgtatcaccttgactgaaataacagactccaggaggatagctgttgttatctctttttctagcatagtgcctcacagataacaggtacttggtaaatattggaatgaattcatgaacatatgtcagtaattctatgtgcttttcagtttgctgactcatttcaccttcaaaacaatcttgtagtatttgtgtgtcaatttagatttaccactcaaatccatctctcatgccctctagacatgaactttagtgttaggaagcatgccgagtgtttgatagagtttctcatagctcctacagtttggtgcttaagggacagtccttggcatggatgtatgaatggtacataccaaaacatgagttctagattccgttctatcttaatctaacaatatgataaggagtataacttagctcaacctcaatgagaaggttgaactagataatgcctgggaccactctcagctctagctttgtttcagtagaactagagtctgtttttcctaaatatcattcatgaggcttcttctggttttctagtggtcaatagagctttaaattgatcaactactgtttttcactgagcattgtggacaggacctactttttgggccagggatatagtagccactgagtcttaacagaaatgtcatcaatgatacatttttattttacagaaaaatgttgtaacattctatatggcatatgtcatgtggaaaggtggcaacatatatacatacacctatacatgtggcagctaaaatttaatgtgtgtatggggaaaataatcctgtattataatacacatggtatagcattccctgcctcattcgtggcacttttggaaatgtgagaatgagcatagaacatattcaagttggtttatccaaaagaagaggagtaaattatttcagctatttccccattttctttttctaactttcttaaacatgcactttcttacataatcacgtgttagaaaaaaaccagtagtcacatcaaataaatctgcatttgaaacaactgtatcatatcccaactctgttcgtttgagccatttgcttaacgtgacacccattctactttatgacacataaggaatattgcttaagaaatgttaattggctttccttttctcctctgaaactggattgaagtcttattgacctctattagatactgagtgttcaggtttttaggaaaacactcatagagatatagccccagtgtgagctgcatttttagaatattttctagaacccaaatatgtccctaatcaaagttagtttattttcattcttagcgttcccacgtaatttggggtatgtgtgaattcccaaacattcctgggcctctcctaggcttctctaattgcttcttattctgttcccctgggaagcagcatcctgttcccttcacaaaggtcagcagcaacagcccaggcaatgttttaaaataacttaataaccctgaactgcctctctcttctttgggataatttccttagagcattagtcctttgaacactgacctggttgcagaaaatgcccctttctcagtgggaaaactccaaatcccattcagtcttcccctccttccttccaggggatagggtgggggagtagggggtagggagagggtattaaatacttcaggaaaaatgttaacacggtaaaacacactctctctctctctctctctctctctctctctttctctctctctctctctctctctgtgtatgtattcttttttaaagaaatagactgtgagtgcattgtataaatcagtgctgtcacgttgcaaattttttaaaccgttgtacaagatagaaaaacagtatctctggatattgactctggaaagcttctaagagcaggtcctagatgagacttagctcactgtcggcattcggcaaatgatcacgttttctgtgataccattaactcctggggggatgaaactgaaaagcctcgctgctcttcctgaaactctcaactgcttttttctgtttttctttctcagcttatccacatccatcttggtccccaaagccattgcatgtcagatggtcagtgcaatgtgtaatttttaacttgcttctttgttgctttagaaggaatcgttttgttgttttctttccttttggtcactatttcttgttcatgagttttctgtaaacagtgtgtctcatagataagtccatgtaatctgctagacaggaagaaaagcaaagtttaatgtgtgcctactatgtgctaaatgacaaagtgtttcatctgtatcttcccatttaatccttgtaacactccacttattatccaataaagaaaaaaacggctatcagtcgggcgtggtggctcatgcctgtaatcccagcactttggcaggccaaggtgggtggatcacttgagctcagcagttcaagaccagcctgggcaacatggcgaaaccccatctctaccaaagatacaaaacagtagctgaatgtagtggcatgcacctgtggtcccagctactcaggaggctggggcaggggaatcccttgaaccagggaggcggaggttgcagtgagccgagatcacaccactgcactccagcctgggtgacagagtgagaccccatctcaaaataaataaataaataaaagttaaaaaaaaaaaaaaggaagaaacagctgagattcaaaaaagttggaggcttatccaagtcattctaataaaggggaggggggagaattgatacttaaaatcatcatgataagaaggatagacattagagattcagaagggcagaatgctgggtgaggggtggataatgagacattacttaatgggtacaaggtgcactactttggtgatggatacactaaaagcccaggttcaccactatgcaatacatccctgtaacaaaactgcacttgtacctcagaaatttatacgaataaaaataaataaatcaaataaaataatcatcatcatctcagctattgcttctagctgtttcaactttctaatgtttttgattgaaaactggccatttgtataaccaaatgtggccaatccaccactgtgaggctgccatcttgggcatcaccaaaactactctagtagtccttccctgcactgttaggtggattttccttggcgtatcttcgcaatcaagttgcagagacctaagttactctttgctgctttgggcaataaaggggaacaaaaaacaaaatgaaacaaaaacttggccagccctgatgtaagcactcttctacctccctgcaggctgagaaaacaaagtatttcttttttttttttttaatttttaaaatgtttgattctggtctaaatcaattaaaatgagatctccccccttcttttttctttttttcttctaaaaaaaaaaaacacaccaaaaaaccgagatacatgtgcagaacgtgcaggtttgttacataggtatatgtatgccatggtggtctgctgcacctaatgacccatcgtctaagttccctcccttcaacccccaaaccccaacaggccctggtgtgcattgtttccctctctgtgtccatgtgttcttaatgttcaactctcacttgtgagtgagaacatgcagcgtttggttttctgttcctgtgttagtttgctgaggatgatggcttccagtttcatgtccctgcaaaggacgtgatctcattcctttttatggctgcgtagtattccatggtttatatgtaccacattttctttatccagtctatcattgatgggcatttgggttggttccatgtctttgctattgtaaatagtgctgcaataaacatacatatgcatgtgtctttatagtagaatgatttatattcctttgggtgtatacccagtaatgggatggctgggccaaatggtatttctggttctagatccttgaggaattgccatactgttttccacaatggttgaactaatttacattcccatcaacagttcaaaagcgttcccatttctccacagcctagccagcatctgttgtttcctgactttttaataatcaccattctgactggtgtgagatggtatctcattgtggttttcatttgcatttctctgatgatcagtgatgttgagctttttttcatatgtttgttggccatgtaaatgtcttcttttgagaagtgtctgttcatatcctttgcccactttttgatagggttgtttgtctttttcttgtgaatatgtttaagttccttgtaaattctggatattagacctttgtcagatgggtagattgaaaaaatgttttcccattctgtaggttgcctattcactttgatgatagtttcttttgctgtgcagaagctctttagtttaattagattccatttctcaattttgtcttttgttgcagttgcttttggcgtttttgtcatgaagtactttgcccatgcctatgtcttaaatggtattgcctaggtttnnnnnnnnnnnnnnnnnnnnttacatttaagtctttaatccatcttgagttaatttttgtgtaagctgtaagggaggggtccagtttctgttttctgcatatggctagagagttttcccagcaccgtttactgaataggagatcctttccccattgcttgtttttgtcaggtttatcaaagatcagatgtttgtagatgtgtggtattatttctgaggtctttcatggataggaagaatcaatatcgtgaaaatggttatactgcccaaagtaatttatagattcaatgctattcccatcaaactaccatgaccttcttcacagaattaaaaaaaaaactgttttaaatttcatgtggaatcaaagaagaccccgtatagccaagacaattctaagcaaaaagaacaaagctagaggcatcacaccacctgaattcaaactatactacaaggctacagtaaccaaaacagcatggtactggtaccaaaacagacatatagaccaatggagcagaaaagcaaaggatttctaagtcatattccaccacctccatcagggcttccctaagatagagagtatggccaagaccatacttaataaatgtcatggaatgtgtttctcttcataccctcaattgtaagtctttctgaaaggtagcgcgtggtcaatttagatggacaagaagtgctctgcaggagcctttgcaacatttgtgcatgtccttgattttgacaccaccccccgccccccattccagaacagatcgtctcatccttcccttaagccagaggcctatggttctagctttactaggcaaatatatatggtctgtggctataagtcacaatttctcccaagccttgagctgggggaatactgagtctgcccatgtattacatgcagaacatttcatcttattgcagaatgatactttattcttattgcagaatgatattcattattgcagagtgatattctttagtctttattttttatcattataactacatggtgcaaaagaagtatttctcatactttttctcataatgactcaaaattacaaaagcaatctgggcaattaatatgtttttgaagataaataatggcttatgttttctgaagattaagaaaaatctctgtctgaatatagctgggcacagtgtctcaagcgtgtaatcccagcactttggggggtcaaagcagaaggaacacttaagcccaggagttcgaagccagcctgagcaacaaaatgatacctggtctctacaaaaaaaaaaaaaaaaaaatccttggcatggtggcatgtgcttgtggtcccaggcacacaggatgctgaggcaggaggattgcttgagcccagggggccgaaagttgaggctatagtgaaccgtgtttgtgccactgcactccagcttgggcaacacagcaagactctgtctctaggaataaaaaaaaaagaagaaagaaaagaaaaatctctatccgaaaaatgtaggcaccctgtgttaatatgtaaatacaagtgctttatcaaataaaggctagattaattgttttttctcgctcttacttatatcaatactacaagaacttttctgccaaaaaaaaaaatcaaataatagaaaagaatgaatcctagatagagcaggaggggctgagcaggcacagcaaaagttcaaggtggaaatatctttatgcatccaattaaaagtaatttgtgtacattttactcatatatctatatgtacacatacatacatacacagacacacacacatatatatatatatatatggagagagagagagagagagagagaggacaacgaagaggaaactaaagagaataaagggtattaacagcaggtctgtgacttattccctggggggatgtgaagggaataaatgaccttaatagaccacttcataaacatgttaatgacctcccagaccttcttgtttatcttgttaatagtggttaactagaggaaagatacctgcaaatccctatctataaaatgattttagtagggtatacctggcctggctagatagcttattgtaaataaacctggaatgtttggatttatgagtcgtggctggctggagaatagggcatagctacatgaacgtttttctatttttgtaattgacagattataaaatggaaaacttttgagactgaaatgatttcctttcaatgtttctgtgtaaatttttaaaaacgtatctgttaatatgaaaccaaagcacatcataatgggaaataacatggatgttttggaaacgcatgtgtgattatttcaggttccccagggaaataatgttctatctgtgcccagcacttccctataattctttcagtcattaataaagattggtactagataagaatctgagatttgtgtgagtctgatgtgagatccaaatgttatacttacacaatttgtgtttattttagtttaaaaattatctttgccatgagcaagaggggaaaaaaaggaggatgagcgggcctacatatttttccttaacatcttgtcccaagttttaggaaatcacaagtctaagaaaaggccagggtcaggactaggaagtgatataacagttatacatgtctacctttaaaattatataagtaataattaatttttaaccttattttaagcagatcctagaaatagcaagagcctctataacgtcccagctaagaccccaagttttctttcttgtttaactcttgaaatattttgttaattttcagatcccttgtctcctcagttcagctgtaaactctctgacaacgcttgtgccttatgcatctttgcatcatccctagcatgtattatatatctcacatgtaaaaataataataaatacttgatcatttgttttgattttgatgattaagcactggaagctgagctatgatcccaataggtatgcttatttaaagaaaaatagatggcagtccaggcgtggtggctcacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaccaagtgaagttcctggagattttaggtttttacaggtctttttctcatgcatttgaaagtaactagattgcaagacataaatgctgctctgggagaatgcattggtgaacccgtgagttagggtgaggaaatatgaagatccagagtgaacagggagaccagatagtagtgtggaagcactgcgtagataagaccagataaagtagcagtggaatcacaagaggtggttgaatcaggaatatggttagaacaatcacaggtcttgctgatgcattgaggtcaggaggacagaaagaggcaatccaggttctcctcggtttcagcaggaacaggtacttaaagaggaacaaatttggtagggaaaatcaagttttagtgttccattgcagtacatggtaaccatggctaataataatgtctcatatatttcaaaattgctaaaagaatagatttttaatgttctcaccgcaaaaaataaatgatatgttggtgaggtaatggatatgttaattagcttgatcaactctttctacaatatataccaagatcaaaacatcacatcgtatcccataaatatacaaactattatttgtcaattacaaataaatgaaataaataattttttaaagagatgtcttaaagggtggcttgaagagcttctgtgctccaataatacctgcccattagccatactttgcttccagcaacaacaggaaaacatttaatctaaacaaaaaaaaattgcttgtcaactagatagctactcttccgtgtagaaaccctagagctgcctgggtttagacatgtttaagtttgaggtacttattgggtatctagctgtgcagttcaaaatttggatctgaagctaggggaagacgtcaggacaagagctttaacttttgtaatcatcaatatatacatccttcttagagtcatggggtgggatgccatcatattgggatgagggaggaaaccctgggacttcacaatatcgagctagtttctgttttgcaaaaggcaaatgtattaatgaattcattacattaattaagcaaactatatttattgggggctattgtaccagctattgtaaattttatattttatattatatatatatatatataaaatgctcacaaaataaaggaactaagtcataaatatgcatatgatttacataaaggagctaaaataaggatctctgtttctgtttcaattctttattaaagatctatctaagactataaagacatatataacaaggtacaggaggtaaagagtatattcttaggcatctaaaaatttttcctatgcttttgaaatctgtgtgatttactttcttgaattggcctgtaatataggagtacaatatcattgcagagattaattagtgtgtttgtgaactgttctcaaatgctaaaatgaaagcataaaactataaaatggcatcattattccttaaagaagcatagtttccaagggtgtctctgatcattgtcacagcataaatgaccaatttcacccataattagccaagttagtaagaagttattttttactgggtatattttgtttaacctcagttatatttgtaaaagtagaaactgctacttgttactgctttcagaatttctcacaaatgctaaaatgctttttaattctaatgcacttaaatggtttgattctccttacctaagaaaaacatttatctaaagatatactcttgactgattcattcattgattcatttgtcaatagatgtttatttatcagaatatgtgcaccagatacattgctagatgtaaagggtacatttggtgagcaacatgcatgatacctccaaagtatagccagggaatagataatggaaatgacactaagaatgaatacatattaacacaaaaagagagagagagtcatgtgtcaaggcaatttagcaggagggaacttgtcaatacaagggattaaaaggacagcatgactagggctggaggaggtgaggagaaaactcaaaaagtcctctggctgatgcaaatgaattggatgaggagcctatgaatacaaacgtttgaaggttactgatgaaagccaggtgagagaagatgggatttggaccaagatgatgatagtttggatatggtgagaaaggcatagatttgagagatttttaggaggtaaaaatccttaagatttgaggatagatatcataggaggaagggcgcaaagagaaagcaaaacatgtcaaggaatcacacctagatttctgggcaatgcacagttggtaattctttacagtgagttagggaactctaaagaaagatcagatttagggtggcaatttgattgtaaatgtttggatttcaaatgattggtgacatccaaaaagcactgtaaatagacagatagtgtgcacctaaagaaagaaggaggcgcatctgggttggagtcactaatttacatattacttgtatatagctagtaactgaaaccatgagtgtgaatgagattctgatgctaaattctggaaggtcactttttaaagtgttttgctttttgaagtacaggtgcaatactaaaaataaaaaagactaatttttaaaaattaaattaaaatgaaaagcctggaaagataaacaccaaagttatgatactagttgtagtatgggagagggggcatcagagaggatcggaatttcatcttgaatggtgtattttatttcaaaagaagctttgagcaaagataaaatgttaattctgagcattagaaggaacacatttgtttttttgtactgtggatctttttgtatttcctagaactcttaatctaaaacaaatattgcaaaatatatcactgtaaacaactggttggtcactagctttttaaatactttgtagcaacttggttgcttgtcagaggtcttctttgagtgaagtctttaatttatagttctttatacttgatcagcataattgcaccaaactgttacttaatctgaaaaatagctgtttcctagagccctacttaatactgaaaacctactgtgtttgtattgcaattgcatttttttttttacttttccccctgcttttcagtttgtataatttctgttaccctatattcaagttcactggttctttccttgtctttgttgaatctacagatgagcccatctaaggtatttttcttttctgttactgcttttaatttctagcatttccatttgattcacttatagtttccagctctatactgaaatatactgaaatatagagctggaaactataagagtgaatcaaatctaatcttgcatattgtcttctaatcttacatattttctatctaatcttgcatattgtctttcttttccctcaagagtctttaaaatattaattatggttattttaaatttcctgtctgatagttccaacaactgttacatatctaagtctggttctgattcttgctttgtctccttagactgtgatttttcttgcttaggcatgctttgtatctcaggggtaaaagtcaggcatcttagatagcgtaatagatactgaggtaaataaacctttgacatggtaatttatcttaatctgactgggaattgggctgtgtttgatgttggtagttgctttggttgtcattgttgagttttgttgctgctgtggccaccagagacttcaaattcctctggtaactttgtttcctcattggaagcttgttagtgtagtggttgagtgtcgggcagaggcattctctaatgtttgaattaatacacagttggcctgggtcttggggatgtggtctttacaattatttctttcccttcctccagaggtagagtaacttcaacctcccattcccttcctggagctgcagtggatatccaccagtgttctcagtctatggccccaaggccctttctcctgcataaggctgaaaaacaacaacaacaacaaacaaacaaaaaaaaacaaacaaaaaaagaacaaaacaaaaccacacatagatgagatctggtgttcccttcccctaaaatgcagtggtatttcctcagtgcctgatatggtttggttctgtgtctccacccaaatgtcatgtcaaattgtaatccccacatgttggaggaggggcctgatgggaggtgaatgaatcatgggggcagatttctccgttgctgtacttgtgatagtgagtgagttctcaagagatctagttatttgagagtatgtaggactttccccttcactgtgtctatcctgctgctgtgtgaagatgtgcttgcttcccctttgccttctgccatgattttaagcttcctgagggctccccagccatgcctcctatacagcctgcagaactgtgagtcaattaaacctctttgctttataaactacccagtcacgggtagttctttatagcaatgtgatgtcttttcctctgaagagaagggtataagcagattcatggtgactagctactgtgacccttccccaatcagcaacacagagggtgttggggaggctttctccagattcttcgcatcctccttgtgaaggcaaggtacagttcctgaaggaagaagcttgcaaaaggttgggactccacctatggcagtagcccccaggatcttcacactctcaggctagctcccacatgtcccccaacaatttaatctccctactagtttatatggcatctgctccagggatccaaatgctcaggcactgcttctggctaaaggccaatctctctccagatttcaggttgttctataatgtcatttctctgatggactgatgaaaagtcattaatttatctgtccagcagttttcttgctacaagtatgggagcaacctctttgcagctctccatctccatctccaagttgaaactggaagtctgagcaatacattttagaaattaatatttgtaagttttccgtgtcataacaaaaataataaatgttcactgtggaaaacatagaaaaagattaaaaatatttaagtgcccatcaccacctagacaactgcaatgaacatgttggtaatgtcttcttccagttttttaaaatctgctgataaaatacaaaagatattgtttatataactttgtatcctaccttttcttgagcaatgcaagtttaaacctaaatacgaagatactctaacttcctactttacatttttgacggcagatgtcagctgtcttcccaagtgcagtacccttggcttaatatcaggtagacaaataaggccaccacaaattcacctttcacctcaataacacaggtaatttgatagttctacagaccctataatattacttgactgaagacccagaatacaagtctttcaaggattactctagaaactatataaagtattggtatcatctcccttcatcatatcttgccaaatccaacaggtttggaacttctgtaggaagatttttgtaacatgaaaaatgcgtgttgcaccttccatatccagcaaatacaccatcggttttttgttggctgcaccaatgacataaaatgatttcactgaatagggggtgacccagaatggaaatgtagagcatcgaaaataaaatcaaccgacgcagtctttgcagcaaaccatgtggaaacaaatttaaatatggaacatactctttccaactcatcttcagatgttgctttaaaatttgtgcaggtgaaaaaaaaatctttattttaaggtaactcaatcttttaccattggagagaatagaattatttttgtttcctcttgtatattcccagttgtttaaatgttctctggttcccttgtgtggacacataaatccaaatatatctaatatcaaggtatttaccatatgcagcactttttccctcagatagttattttttgaaatattcaaatagcttacctgtatcatcccccccatcctttttttttttttttttttttttttaagacggagtcttcctctgtcaccaggctggagtgcagtggtgcgatctcggctcactgcaacctccacctcccaggttcaagcgattctcctgcctcagcctcccaagtagctgggactacagttgcatgccaccatacccagctaatttttgtatttttagtagagacagggtttcaccaatttggccaggatggtcttgatctcttgacctcatgatccacccacctcagcgtcccaaagtgctgggattacaggcgtgagccatcacacccagcctaccctattttctaaacgaacaattagttgacttttcttcagttcttactcagaaatatctgaccctaggttccaacttttgttttgctctttgcagttagtttttatgtgtactgttagggagatgtgctttttttttaccttcaaatttaaaagagagagttttcaattccttttaagtcaaaatacaactgttctactctaaagctttctttaaaaaaagaaaagtaccaaatcctcatccgtagtaattaattttgacagtgtaggctcagtagtgattcacaaacctgtattttgtgcatcagcattccttattattctaattaaagtggaacattgtgccctcgctaatcattaatgggttttcattttgtaaatgacatttgcagaagttaaaacagcgagttcatgtgaagtccacaggcaacggtgttgaaattagcatcaccatagcaacagtcttccatcattagcattcagggcaacaggaggtgttttgttgtgttttgtttcccaaaaaaagaaaaagaaaaaaacttcaaaggtaaagcctacagaaactctctcagaagatatttatgttccttgtgtgtatgtgtactgtactagacctctaagtctacatagaattttttttaaaaattgcaatgtggatcatctcctttccagatttgtgttttgcctagtatactagctaaatttcatgatctttctccagctgtacacgtctgacctgctgagcagcatttactcattgccaacctgctgctcaccaatagggtttcctacgtggatgaagagagtctgtattcatgaaaatatttggttcaatctaaaagtattatgtgtattcatgagtttttaatttaattcatggaaaatagatttatgctgttagatcctctggtgaactcatttagtcatgttgtagatataggtcaatgattattctcattcatgtttagacggaattaaagaggagtcaaatagagaacaatattatcttaactgagtctctggcagtggtattaccactattactctgtatgtgtgtgtgtgtatgtgtgtgtgtgtgtgtgtgtatgtgtgtgtgtgtgtgtgtttgaattctaatattctgggaaactttaaaagtggcatatctagcacttatgtttttctcagtactaaaatgcataaaagagcaccatattgacctaccagctgcttctaaatcacaccagtagtaggtaattatgaaattcaaatgaagtttaattttcatttattatacaaaaatgtcatagctcaaacccagaagtgttacccccaagcttggatatagacaggtatgtgtgtacattttacttttcaagatgaatcatagcagtcttctccattacatgtaaggactagaagttgtacattccactcaggtacctaaaggcaagcctgtgctagcccacactaacaaagcaaaatgaagcaaaggatctatctggctttcaatcagggatgcatctatgctaccatcagctctgtcacataataaatgagtctatagataacttgaactactcagccaatgggctgtaacccagtgattctgtggtattgaaaggcagcaacccccagaagccacatgtctcagtgtgcactccaggactgtaggcccatagaacttgtatgtatgcacacatgcatatgcattccccacttttctaatggcgatccaatctaggcctaatccacagctagtccagaaaagaacttttttaggttttctgtctgccatcactttgttgagaggcagtacaagccaagcaggtgtctgtatttataatatgcacaatgttaggataactcaaactcataagggaaagattaatggctgactactatgaaaaccgcttctagccttgtgataccagcacctactatcttcctttttctcttatatgatgaaaagatttcaatgttggcttttcattctgatagaatgtgcaagccaaaatctaaataaagtccagtggcaatgatccccttaaacattatatctttcttctcgatatgctgatgttttcccttataaaaatctatataagtttcaagatttatatgacagacaaaccacacaaacaggaggtccctcacattcactactagtcacttgctctatcactctgggaatagcggtcttcagattgcatctctactctacctcttgctcttttcaacccctctcctcttttttagaccatacagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccactcatctgcctttaggtagggttttaaaagatgcctagaaaatagttctgtgctagaaatcagagactcttgacctactgtaaagggagcagtaagcacgtttcctcaggagaatctttctacatactgcagattcccataaaaatctttgtgacaaaattgcctttactgaaaccatcatccattggattaaaaaatagcttaccattagctttttgaaaatagaaaacgttgagccttttcaatgatactttcaatagtttttcacaactatgagtcctcaagctatcagtcttatttttagataccatacttataagatagttatagaatttatagagtatggtttaaaagactattcaattatagagcaatcattcagtttattcccatggcagaagtaaatggaaaccactccagatcaacaagaatctactctcttctgattcagaaaagagatttcctatcttttcatgaataatccatgttcaatgtttaacacctcaggaagattttcttaatagcttcttctggtcataaatccttggtctgtcatcagggacatattgaagagttagttaccaaagttcttaatgtctcccattgtaaaaaaaaaaaaaaaaaaaagtcactttttggattgtttctttcatagagtccatgcttctgtacgcttaatactttagcttttgacttcaagctttaggtaatgcaaatgaagctattacatcaccaaagttaaatttttcttgtaagtatattctcaacattcacaattgagagctgcctcttctttggctggtataaggttttaatttattgtagcactttcaccctagaatggcaaaaaatgttgaaatcaattccatatatcaccaatacaaagtactaagtcaaggccgggtgtggtggctacgcctgtaatgcaagcactttgggaggccaaggcgggcagatcacttgatgtcaggagttcgagaccagcctgaccaacatggtgaaaccccatctctactaaaaatacaaacattagccaggcgttcatagcgagcgcttgtaatcccagctacttgggaggctgaggcaggagaatcgcttggacttgggaggtggaggttgcagtgagccaagatcatgccattgcactctagcctgggtgacagagcgagtctcaacaaacaaacaaacaaaaatattgaattgtacaccttaaatgggcgaatcgtatggtatgtatactaaatgtcaataaagctgttatatgaaaaaaaaatgctaacacacacattctgaaagtatattaaaagcaaacctacggccgggcgcggtggctcacacctgtaatcccagcactttgtgaggccgaggtgggcggatcacaaggtcgggagatcgagatcatcctggctaacacggtgaaacccagtctctactaaaaatacaaaaaattagccaggtgtggtggtggacgcctgtagtcccagatactcgggaggctgaggcaggagaatggcgtgaacccggggctggagcttgcagtgagccgagatcgcgctactgcactacagcctgggcaacagagtgagactccatctcaaaagaaaaaataaaaataaaaaagcaaacctacaatgtctcttacaaacacaggcaactattcaattccgagtttacactactgaaacacacatgaatatgacactaagagaatcacgtggatctgcactcttcaatcaacactacgtctctgagcacaagaattttacatctgatttccatttggggaaatagattcagaatgccataaaccagatacttcttgccttcctttagtggtcatttctgccattatcatttaagggaatggatctccttctcccaaaactgttaccctaagattacaagcttgtcctttaacttatctctgaaagcacacctctataacgggtcatcagtattcagtcagctaattagactgcagaagtacgtttactcaaatgtgaggagataaaattgtgaaatgtaagaggaagaaagaatgtcaaagataatccaacccaaactcttcatcttacagataggaaaatggaagtccaaaaggggaaagtaattttagtaacatggctaaactggtctagaaaaccagatcttctgatacctgatcccatggtctttctaatgccatggatgttcgggtagaggatatattcaggtagataacttatagatagccccatgtgtttgtatagcactttatcgaacactttcacctctattatcacacttgattcttacaatatcccatggaatgtttgagtatcatatatgattattcttattcccacagacttggaaactgaggctttgagatgtctggatctatcttagatcatttgctatggactagaatctgggactaagttgcttttgtctaagctgtgtgtttgttctgttgtgccgtattgttaattcatttctgttggtaaacaacacaaaggaaaaacttctataattatgtttctttttcatcctcaggtcatctatcctactttttatctaagctttggaaaatattatgtgctttccttttttttgtattttctttttgtagagatggcagcagggggtagtctcaccatgttgcccaggctgacctcgaactccttggctcaagcgatcctcctgccttggcatcccaaagtgctgggattacaggcgtgagccaccacacctggcctattatgtcctttctttagcttgctcgtttaaccatttgtttggcagggggagtcagaactgtgttttacttagtcgattaactgataggacaatttaatatctaccctgcactggcagtaacccccatagccccgctctgtgtctcattctgtgccctgaacaaccttgtcttaaaaacattttaaaagcagcaagtatggggagatttcttatctccatataatacagaagcaagtgtagagtatggctacggaaaacaaccagcaggtgaggctgtgacataacaattttaacccaagcctcactgctacattgaggtatccttgttcaataaatagatcagaaaatatggtgtagtttttccctaacgctgtctaaacagcaacaacaaaaaatcattacccatagtatttcagtaatgtgttgtattgaatgcattgttttcgagggcgttttcaaaaaataagttgattgaatctcttttttttgcttgaagaatgacccacattcagaaagtatacagatgaaacatgttcagctcaatgcaattatcacaaaatgaatacacctatgttcgccatctaggacagtaaataaaacattatcagtagccctaaaccagattacacacacacacacacacacacacacacacacacacacacactaaaccagactacacacacacacacacacacacacacacaccgggttgggggagtggtgagagagagagagagaaagcgaatattatgttaacagttggggagtctaagtgaatggtttatgggtgttcttttaacatttcaattggtttaaaattttcaaaatgaaaagcttgaggagaaacatagaatataaccactacctcagaaatcaccaccctacctcacccacattccctctcccaatcactattcctccctcatcttaaaggtaactgctactctgccttataacactatggttgagttttgcctgtttatttgaactctataaaaatggaattgtacagtatataaccttttgtatctaggactcaacattgtgtttatgagattaactcatgttgttgcatgaatctgtcatacattttcattgcaatttgatatcccatttaaaatgtatactataatttatccattctattgttggggaacattttggttctttccagtttgaagacattatgaataaggcctcctatgaacattctttaatgcgttttttggcacacacgtgtgtacaactgtgtttggtatatactttgcagtaaaattgcctatgttgagggtaggcatatgctgagctttagtagatactcctggttttccaaagtggttgtaccagtttacaccatcattagcagtatatgaaagttctagtagctccacatctcaacaatacttgatacttgttagtctttaaaattttcgccattgcagtgagtgtgtgagtagaatctcattgttattttaatttgcaattgtctgattacttatgaggttgaatatttttacgtgtatttattgaccattttggatatcctgttgtgtgaagtatctattcagtctcttgcctattttttttattgattcatccttctttttcttattgatctgtaggagttttttttacatattctagtttgtagccctttgtaaattgtatgtgttgcaaatatcttctcccattttatagctttccttttaattaaattgtttttttgattgatagttcttaactttaatatagtccaatatgtaaatttttccttagggttaattcttttgtgtcctctttaagaaatctttcctaatacaagataatgaatgtatcctcttttattatcttctagaaacttactattttttaacttttccatttagatatatagtacacctggaattgaccttttgtgtaatatgtgagatagagattgagttttatttttcataatatggatatctagttggcccagtacttgatgctaaacattcatttagaattcatttgatagtatttcctttagagttattgcatctgtgtttattagttatattggtctgccattcttgtcaaggtttggtatgtggattattgctggtttcataaaggcaagtagggaagcattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatgactgtctcacccctaaggcaatttctgtattggatgagaggatataattcattaacctttaggtcacttgtgaatctaatgttttgatattttcggaattaatcagaagggaactgacagcatgacctgaatctgtcctatatttatgtaaacatcctgtgtgatgcacctcattctttgtgcagttgtatgcatttttgaatgttaaatttgattttagggcaaacgcttttttaaaaaaattttaaaataaactttattaaataaaaatttacacacagtaaactgcctccatttaaagtggttcagcgatttttggcagatgtgtacttgtgaaaccaccactgcactccaatgacagaacgttcttactcccccaaaagcctccttgtgcccctttgcaggtcatttttcctttcacccctgattctaggcaaccactgatcgtctttcggggggctgtgtattactttgcattttcaagaattttctataaatagaatcatacagtatttttgtatgtatctggtctcttatattcagcataatgattttgtgtccagcttgaggatattatgaataagactgctaaaaattgtatacttgtttttctaaataccccttataaaatcttacttttgagaagcatattactaaaataacttcccaggttatatgtgtatttgttctttctgttcatttcagcattatcttattaacaagcaactggaggacatgcaccaaggataaattgactaggtgctaactgaatttgtgagaaaggcctagtttctaacgttctttcttgggagcagatgtgtaacagctacttttgctgtataacagaccaaccccaaaacttactggcttaacactgaggtcagcaaacattttctgtaaaggacaacatagtaaacactataggctttgtggagcactttgcatctttgttgcacattctttttctttttacaactctaaaaatgtagtcatacttagctgagaggctgtacagaagcaggccatagaccaaatttgaacaatagttcataaactctataacacaatggccagccatttacttagctcactatttgatgggtggattgggccatttatgtggtgtgaccagttgtactactgtttgccaggcatgcttatgcatctgtagtcagctggcagctggataagctatcgtgacctgactcatatgtctgatggttgacaggctgtcatctaggaacagatgcaactaggtttgtgtgtatctcatcatccaacatgctagttcaggctagttcacatggaaacttctcaggtttctgcttgtgtcatgtttggtagtgtccattagccgaagcaagtcatgtcatagggccatcccagatgtaaggagtggggaaagactccacctgttggtgggaagagatacaaaggcacactgcaagagctggacaccaaggagagggctagaacttttggccatgttgcaagatatcacaaaatattcaagaaaagttacaggaaggttcctctgtggactaaattctcttctgaatttagatgtaggtaaaatggagtgtgctgttaaaattcatgctttgtgagtaatcattgctaggctaaactgtttgtggcttcacagccaatggtagacatacagcatccataatctagtgcttttaaaaatataagaaatactgattacaaacatagttaaccacttattagtactgggaatttaatgaaagctgctgtgattaaatactgaaaaaagaaagattgtgggtttccttctggtaactttcaaagctggtcactcttttgaaaggaattttattcttaaagctgttatttttactcataatatgcttaatacccccatggctgcagactgtctaaaatgttcctacaattatatgagaatacttttaaaaatcatgataattatcagtcttcatggacacttattcagattaatttccccaagcacttaataggatgaatttataagcattaaatagaatggggaccatccagccctaaaatgtgaccattctgtcaggcacacacttgccaatttgttggcgtggacctgagcacactagcaaggactttgaattaggtctcactgcaagatggaagcagaagggcatttctcagtttatgttttgaagtgttttgttcagacaggcaacgtgcagttgtgtatagtagtgtgagctacctgttactccccttaacaatacttttagcagcaatgtttttcctcctgcaatgtgacaatatcaccatgccatttggaagaaaacaaaaaggctgagtgattcctggtatactcccaaacagccacccaaacgaacagctggcagagaagacaccccctaaaacttggagcagattctcagcccctgcagcatctcatgtggttagaacttcagacttgatgaacgcctccccaacttgctccccctcctgaatcttttaatcctcctccagtctcttgtaatgttccagcccttaccagggaataagactgcaaactgtcttccgtcaacttctttccaaatcctagtctagagaaattataatgatgcatgattgtccagtgggcatgtatagtttgtccatttctttatgtagtaaagcctgtagctttcatcttttttgccaatccactataaaaattaattttatatgtcatcctggtacacacacacacgcacacacgcatctatatctgtaaatctttttctgtctattcatgcttgtatgattgaaagaaaagtttcacaaaacattacttacccataccaaatagtacactttcatattttctttttttttttttaatttcaacttctattttagatacaggaggtacatgtacaggtttgttacatgggaacattgcatgatgctaaggtgtggggctcatgacctgttacccagattgtgagcatagtacccaataggtagttttataacccattttccccactccaacctctacactgtcatattttctattcttttctgtttcattaagaacaatactggtaatgatccactatatagatttcatgacgtactaagggttcatgacctgcagtttgaaaaacactgtagttagttttatctccacctcaggccaggtcatcagaaagctgcattcttagaccactttgccttggcccccataagattgcctcaactcaggtgtacctcggcatcatgttcctggcttatgtcgaggggcactgaaaactgctgaagggatttttctgaaagtcgacaccatgcagtgtctcccaccttagatcccatgcagatctgtttattcaatctaagtcattccagacttggattttcctttgtttcacttacactctttcctccttatcaataatccaaataataaaatcgatcatatttccttttatattttttcttttgctttgacatctacaaaggccacaaccaaattatacccaccttttaaaacacttttttactgaaatatattaggcatgtagaaaataagggagatgctggttaaaggatatgaaacttcggttaggaggaataagttcaagagctctattgtacaccatggtgactataggtaatgaaaatctagtatagtcttgaaaattgctaagagagtagatttaagtattatcaccataagaaatgataagtatatgaggtaatgcatatgttacttagcttggtttagccattccacagtgtatacatatttcaaaacatgttatacatgataaagatatacaatttttatttgtcaattaaaaaaaaagaaaaaatggcttaaacttatacagttcagtgaattttcacaatctgaacacactcatttaaccagcatccaaataaagaaacagaacattaccaacctttagaaggccctttgtgtgcccttctgatagttacctgtcctccaagggtaaccacaatcttgattttgaacaccattaaatattctggcctgttcttgtcctttatataaatgaaattgcacagcatgtactcttttgtgtctgacttctttaaacctggattcatccatgctgttgtatgaagtggtggattgttcattctaattgctatgtaatatcccattgtgtcaatatcctgcagtatattatatactctactgtggatgggcatttggtagaaaaaaatgatgttataaacattctaagacatgccatttgatgaatatatgtatgcattcctttgaggactatatcaaggggtagaatttctgggttatagggtctgtgtgtgttcagcttctgtacattcttccaaacagttttccaatgtggttgtaccagtttgcactcctactaacagagcatgagagttgtagttgctccacatcctttctaaccctgtgttgtttgtcttgctcattctggtgggtatgcatagcaaaattttcataaccacatcatgcactgtgatcttcaaagctgtgttctggctgggcatggtggctcacacctgtaatccctacactttgggaggccaaggtgggctgatcactagaggtcaggagttcgacaccagcccggccaacatggtgaaaccccgtctctaccaaaaatacaaaaaaattagccgggcgtggtggcaggcacctgtaatcccagctacttgggaggctgaggcacgagaattgcttgaagctgggaggcagagtttgcagtgagccgagatcgtgccactgctctccgacctgggtgacagagtgagactccgtctcaaaacaaaaaacaaaaaacaaatctgtgttctaaattttcctcgcttcttaaagttttatgctatttatatttccttagtgctgggttttattaatttttaagagttatacattgttataagttgccctaaagcctttacagaacaatgcacagtataaatatgtacatagtatatacacaaatatgaatccatgaatgcacagctaatagggccattatcaaaaatcctacacttttccttttcctctagccctcacattcaattggctcaaaagtagcattgattttattctataacctgtcatgaattcagcctctccacaaattcccagtgctcctttcttagttcagactttcatccactcttaactgggctgttgtcatcatctacttggcatacatttccattctgatccctaccctcttttccacccttgtttcttcccacctcaaatttaattctattttaaaaagaaagatattcaaaagtacaggtggtgccaattttttcttctctatccatcatatgcaaagaggcttccaattctttgtcgacctgtttctaagggatgagagtaggtcaagctgtgaggacttcaattcccacgtgaaggtcttgttcatattaactcaataatgtgctttgatgtcctaatggggaaagtagtattttctgccagttagccttcccaagatatcaaatccaatattggccaaatacatttttgaattcctaaaaagcctaaactgatgtcgtaacacagctgtatattaacataaaaactctgtaccttagtaaattattaatatgagcgattagctcacagagtcaatgtaagaaacttgtttcaactcttcatattctagcaaaaagaacacacacacacacacacacacacacacacacacacacaaaacctgatttaagaactaactaggtgattaaagcctacttagtttttaattgaagtgcatattctctaatcccaagaggccaaactaatcacctttccctttttgctgctttttttctctctatttctgtaattattataatctgtctgatactgtgtttagctatatatgggtctatcttctctcattagatcataagctccttaaggaaaaggccatatttccttgggatcccacttaaaaaaaaactggattacaatgttgaaatttttatatatttccatgtcattctccaaacactccccagtttttaccaaccataaagaaaaaatgagaagagtttaaatgataagcaaatacatatgtaagtgttccataaatacactatgtttgaagttatttaaagaacttaatataggataatatttaatagagaaacttagtctagatagagcacataaaaaacattcttggaaatttgtggataaataaaagttccttgcatctgtattttcctttcatcttgaaaacatgccttgacaaaagtaagccagagctggagtacaagattcagacattggtagatcattaattggttaaactggattttatcttatttccccttttatggatccctgtctttgtgtggaattcctgccacatgctggctgttcaaggcttgccaccaggagactttctccatcaagctaggggatatttctccctcactgtcccccaccaaatcaatattcacttgctctctgactactccaggtttctgctgtctgagaatatgaacatggatataccttttaacatgcgtgaatactattcatattttaatctcggccccactgaatgatagcaaacgctgtgaattttatgcctatctcaggctacagctagtgccttatcttgcacacacacaaaaaaaatcttacttttcctacttgcttccttcttaagtgtaaaaagcaaaaagaggaaaggtgccttttgtaaactgctaaagagcagtttacagaagagcagtttactaaactcagacctctcattttccctcacacgacaatctaaaacagaatgttaaagtgaatttatttggttctgtatacctaactattcctgaacatactgagttctcttttaagaaatcatacctgcctgacaggctgctttgcatgaacacagcattccccagccttcaaattgctgtcagagccgttgtgtcattttgacccacaatatggcagtattatccacattctatagatgagttaacaaaagcttccaagtggttaagtgacttgcctgtaaagggttaagtgacccacctctaaggggtagaattggtctggacactctgcccctctatcttcatgcctttgctataatacacagctacgcttgctgaagattaaggaagctgcttttgataaagcgtgattcttgtagatattcatctcaggaaaaaaaaaaagaaaaacgctggtgtcttcatctgtagcatttgattattacattttccttatctgtttcaacttaggatgacttccttgttcgcttaattgactggtaattcctttgtttacttttttccaaatctcaagaagcaagtctagagtattaacaatggttacattagcatttaaaatttttttttgaaatttgagtatttcagaaaggggtaatttaggcaggcatgtatgtagaactttgcattttaattaaaaagactcaaaatgaaatgaacctctgacagtaacagatgactacttctaaaagctgcattactacttgatatatgctcagtattttcttgtgggtaagtcctacgacttgtttcaagaaaagtgacaggactaaaacaattaaaaaagacaaagctgctgttttttaatcatatgttcataaataaaactaggttgtgaattgtttccagagaagcaattgacaaagtatgagtaaatcactctaagaactaaagctgcgttgattttttttaatgttcaaccaaacatctatccttgtccaatgatgaattttctttgacaaataaatatttacaaagtatgaaatatagactctgtgcctttcctaaggccaaagcatactgtttaaactaaaatttaattttttttctcacctcaaatacaccaaaataagaacataactaaaaattaattctctcttgtagtagactgtccattaatcttttgttagataatattagcattgtgagtgtcaggtagaaagaaaaactgtaatttctagattgatcagaaaatgtgagtatttatggatttgaagaaaacaataaagtctgataaaatagaattttctgtaacctcccttatggagtcaagaaggaggaatctttcaacatcctcccattttgcagtgaaaagtcttcatgcagtaaatagtttgcttgggtagatcaaagggttaatttacttctgatttgagaagagacgcagacttccctgatttttttacaaaaatgtgttgtgtgggaggaaggtagaggcctcagaatgaattcactaattggggttttcacctgctgtgagtctaatcgaatacaaagccttatttgtagctgaagaggaagagagattatgcagagtgtaagaatttctgcccagttttgaaattccgcttatttggcacaatcggtggggaaaggcagacaaatagttacaagtttgagctgttaaggtagaccaggaatgctgtagtcagatatacttgaaccacattaaccagtgatccatttttagcaggaggtggtgtgggtcatatacatgggttatcgctatagctggcaggctaataggtactccaaattctttcccatgaagcaaccgtcggcctgtgaggttaatgaagtatggctttattttagtgaagatgctaaaattcacatctttttagatgttcggcttgatataggtggctctgtgaagctttgagaaatcttattaaaagaaaactgtgtgagagtgaagcagagctcgactttatctggaacctgtctggtgaaatctctggtttagatggcagctggctcacagagaactttcctgagtctggcttactctgcctccctaaagagacagggcctggaaaaataggcttttgtgtgggtgtgaagtgctctgtgtctgaacttagaggcctcttcatttgctggttaatgtgacctggctggatattcttacatccagaagatgttggtttcagattgatactagggggattgttatatatatttcaattagtatgctgtaatatttgccctaaccagcaatgattcaccatacgccaacccatttgttagatgtctgagtcactgttcatggttagtacttgtactatgcaaagaggaatatggaattcttatgtctttattgtatacccaaatgctgacattttactatagaatatgtattcgagttaattgaagtgatacctatactctaaatgaatttttataaagtgatgcaggttatactaaaacttagggcgcactatagatagagagaagctgaaccctaggagttggtgaagtctctcgggaccatccctccaggcaagtacccagttcaaaccattccttgtctttgtcctttcctatgccactctgcatttttacacagctagcatcaggccaacattgaaaccacatgcaacccagaaaggaaaaagatgtgtttgtggaaggtaggaacagcctagtttcagctgttggcccttcacagcctccactagatgggctcattcgaacccaagacccttccaacagtacactgcaaatccatagctccaattcagacatcttccctctgagctcaagactcagatgtccaactgtctcttggatacctgcacttttacatcaccacctccaattcattatgttcaagactggattcatcatctctttcctaaccctcttctgccccctcctcctgaaattcctagctcggagaatgctactcatccaatctttgttgtcactcaaggacaatggtccttaaccttcactgcatattagaatcacttggagagtcttagaaatcctaatgtccaagaccaattaaattagaatctcagggtggtgagacccaaacatctaaatttattaacaatccctgcagtgattccaaagggcggccaagcttgaggactattgctttacttcttccctctcttccattcatacatccagtcagtcaagactcctgtagttggaaccttattgtatcatttctccacctcctctgccactgctgtaattcagatcctcctcatactgcaatctccttgtacctgatgtctgaatttcagactcttgtcttctgatcaagcccccataccattgcctgagtgatttttctaaaagacaaaccggacagagccacactcatgctttaattctttcttccttaaaaagctccctcatacctttcaggatacaagtcaaactccagattgtcacactaagccctttccagtttgcccatttctctaacccttatcttgacattctctccaaaagatcaagcagaccgttgaagctcttgtaaagaacaagctggttgcatcctttttaccctcacatctgctgttgtcaccatcataattgttgatatgcctttaccctcaaaaggccagaagctctttgtgggcctacagaggaggcttctctgaatatttatccaatgactgagtctcatctgctttttagccccagagtggggggatctgactttctcctctatcagtagtccccactcagcatcaagtctattgccccagagggtggctttggctggatgggtctcagtttggtcagggtcctgggagaaacagatggtacattcaaacggaacacttgaagagagtataatgaaaaggctatttacaaggctctaggcaggctaggagaaaaaaaaaaaaacaaggaatggtaaacttttgcccaaagggataaagggaggaatggtttgcgtaactggtggaatgctattgctgtaggaaaggactggccaacaagacttgtggctgcaggtcaaggaactcagcagctgccaggccagagatcagtaggagggaacctgaagaataaatacccaaacatcaccttcctcctgtcctttcctctccttctgtaggcctttcatcactgcctcccaattggctgaaagcaaaaggaagccaaacggcaggaaagcctgattgatgtccccacagaggtccaacctcctgggccacagagcagaatggagaaggacaaagaatagagatggatgggagaatggggaagcatcctgcacagtcccttaggtcagagatgcccttattctctaaagataccctcaaagtttaagtggttcaaagaccagagttttggctacgggaaaatgtactgggtcgccttctttgacctcatcccatttcatttcttctttatctctatttctagcaaatttactcttctctgctctgagccatcagtgagattgtctatgagtatactagaaaaaacacagacctttctcacaggaaaagaagccatgtctcttcatggcagcatagcagaatagctaagcgcatgagtcttcgagctggattccccaattccaatccttgcaccattctagacagtggtactgggaacaagtaggtcatggctgattctgaagtcaaaattttagctgaagtttgttctggtagcagagcttcaggctcttttcatgtccgtggttcatatcaaaacagtaataataataataataatataatcagaaggaggagaagaagaaacatctactataaacaaacaatatattatcatacatggcatcactacataatttacatatgacacgaaggtatatcaattatgttcttttccaaatgctttcctctaataagcaaaattcataatctgactgcaattgaacaacaaaacagtctctgtgatgcccgcgtcatttcttaatactttcagtatttaattataatatgacgtcaagatttgggaacaagtcttcaagtgcctataactccagtctaaaaaagaacttaaagatgtatttttgaggattgccatctgtcaatttttttaaaaagtctgaatagtgatttcttattccattcttttttcttgtcaacagattattcttagtagttttctaattggacactgagaaaagagacttaagcatttatagagaagcgtgtcagaactcctgaattttgagcaggtaatttaaaagtgtaaaacaaacaaacaaaaaacaggaaaggaagagagtgacaaatgtcttactatccaggtgttacaaatccttagtttatcgatttgtaatatttacaaatgtccatgctctgaggcttctgtcttttcgttgaaataaacataaacagtagttaagtgatttgccacactgacacagagattggtgtctctgatttactgcaaagggcactacttcctcattacaggacactaatccctcttccccaaggatcggagcagacctagaatatactattagaccaagggacaacttcagccaaagcaaatcttagtgtgcccccctcagaccgtaatagcagctgcctccacaactcactagcttaaaattgctaaagggcaacactaagtaatctcagtgtatgagccagaatgccagaagaagtgccatatttgcttaaaaatagcaataccgatcatacttacatgcacatatctttagtgataacatttacctttatatttggtttgttaaaggtaataaagaatcctggcattcccttttgcttttgtccagatactttatttttgcctcctttgccatgctatagcattagataaagcaaaacgggtgtgcttccacctaaaacattctagggggaaaaatgttgagcagaaaaggattatttcaaaagaagccggatatggtggcatgcacctgtcatcgcaggcacttggaggctgaagtgggaggattgcttgagcccaggagttgggagaccagcctgggcaacacagtgagacccccatcccttaagaaataaattttaaaaaggggaccacatttaaactgtagaccgaagtggaatgaatcaatcggaaaggagagtggaaagcaaatgtttgaaagaaaataaaaagaaaagcaagccaacaaaataaatggacaaagaagggcagtgaaaatatcactaacagtttatcgtaagatgctctttggatgctaatctaaggtgttatgtgaagtttgcagaaaattcttgtgctaatgaaggctttcttcttcttttgagtatttccaagcttgaaataattgtgtgtagttaacttctatcatcatactgcaaactctaaaattagaattatttgaactgttcaggccctgtaacttttccaataaaatattctattagaaacaagttccttctagatcttcctaaaagaatactaaaggaccaaaccgtgcaacagcactggtggtattgtcttaatttagagagtccataccagtgattctcaaacattagtatgctcagagtttctggttcaataggtctgggccgggcccagggaattttcatttctaagaagttcgcaggtgatactgataactgctgttcccagggtctacattttgagatccgctgttatgtcacaaatccaaatccaaagtctttttaacaatcccttttagcccaggatgagcctaacggcaatttcacgtccttatcgccggccactttaatcttcaactgaggaggaagggagagtgagaattatgtatataatttttttcttttattttttaaaaagaaaactccaagcccacactcttaattatctgggatgaggtcatttgcacctgggtcatttatttagacaacaagtagtcttgctagaggctttaaggaggtgttagcagagcggtgtgtggcttccaggttcctgggtctaccttaaatccccatcctctttctttctttctttctttctttctcttttctttttcctttccgttttgaaagccccaactgcccagtctctgggtgtccgggttcccaggtccctaggtgggggcggagcccgacacggccccgccccgtctgcccgcagcgccccctccccggcccgcccgcgccggctcctccgcagtgctttcagctgtgagcttgggcggcggcggcggcggcgctccactttcggggagcccggcggctctgggaagctcactcctccactcgtacccacactcgaccgcggagcccttgcagccatgagggaacagctcaaagggtaagtggatcgcggccccggccccgtctgatggccgcaatccgtgcacttgtggcgcgagcagggggcaagctgaggcggtcaaaacttggacaggcgcggcggctggacccggggcgccgggcggctgggcgtctaggaacctctcccgcgggttcccgcggcgcggctgcaggtgcgcccccggggtttctccccaggcgccgggctagtgggggaacctcttccctcggctttgggacgggctcggagagaaaaagctgatttctccccgtccccagaggggataacgcgttcctcacgcggggattggggccgggggagcttttcactcctttccaggctgccagtgtggacgtgagcaaggctggctgttcctaaatcgtcgctcttactcgtagaaggaaggggcgcacgcggcgctaccttccattgcactgcaagtgccaaaaggtcaactttctgcctgatttcttccgaggattccaactgacatttccctcgctgcattttctaccgtgctcattccatgccccaagacctgcagaaatcaggaaagaaagaacaaacaactaaagcccagaagtcaaagatttcagcggggggggatttttgtttgtttgggctttttttttttttttttttttttttttttttgcccttcgggattgggtgtggagtcatttctagggtgttctctcgcatttctccaggtgtctgtgctcatcttcaagcaaagtttgtcactcccaatcccagcacggcaataaaaagggcagaacactttgcttatattagtcaaatttgaagttaagtttgaagctttaaattgaaggggtttagttgctcgagggaggcataatattaattataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcttagaactgatttgcaattgaagtgaaactaagactgcaaaggtgaaatctaaatctgttttcatagttctttgcatttgcttagaaataaaaggtttgtgtgttgaaggtgagaaaggttagcttctggaattgtttgaggagttcatttatctatgttattcaagtcccccagaatcacagataactgggagaatagtacctatcaaggactagtatcttaactcacaaatgggcaatggaattgggggcttagaatttcctccttcttccagtaaaggagattttcagttttgccgaggactgatggattaaaaaaaaataatttctaaaacccttttcataattttaaccttcaaaataaattctttaaaaaggcaggaatgtatgtatgccaacagtcatgaaatttctttagaagatggggagctccatgaagccctcattcattctatgtgggattctcctgtaaattgtacacactgtttccctttccttttagaactgtgtttggtacaggtttatttcttgcctatgttcctctaatttgaagtccattccagatggtggcttttcaccgtggttccctgtctctgtctgatcaggcttatcagctcagctaaatgtttttctgcagacctatagaagatgctacggtccttacaaatatcctggagatgggacattgttgttacacagtgtgactagtaagggcctgtgtgagcccttgtacatgtgggcacacatgtgtgtgcttcctctcttcgctcttcctttctccctggtgcttatatcacatctggatgacctttggaaatagaggaggcctgaatgcagggtggtctcaatagaaggtaacctttccttgctctgcacttatatatggaattggtatacactcactttccgagctgagaaatgcctgagaacaagcaacactttttccacgaagctgcaagctgcagcctccttgtgctgtgcatgtaaagtaccagtcctgcctaccccttctccagatcataaaccggcttggtcatggggtgtcctaaaaccccttaaagcatagagaccatatctcctgctcttcttgctctttaagacttgaatgtcactctgttatattccctcaactgataagcccttgttatagtcctcaaatgtgagttgtctctatggaaaagtaaaactgaaataaacgtatttggaagacagtgaaaagcacttcacaagtgaacattttcttgcaaattgatttcagtagccctcactgttcaatcactgactagtaaatattacagggatggtctttgaagttgtacagtttggatgatttccatatgtctttatgaggtttatgattgtgttccatttcttaaaccaacttaaacggttgttttaacttattttttttaaacataggtgataacatgtagtgtgttggttttgctctctaggaagggtctttcttcgccttgattgacttaattacagttggatccacatctatattgtaatcaactaataacagatttgcttttaatagatgacaatttgaggggcacatgataccaaaagcgaccacatattgagcaccaaatggtgccggtcacttacctatttcaactaatcctttaaccctccaaggtaggcagggggcttgctttaaatttcacccgccaaagtagggcgcagagcctaaaattcaaaacatacgctaaggccattcgacattgttgcctctccagactcctctttctgtgtgaggcccctgtactttctggtcctctggaaatgccccagtttaagcgatttctcttttttccttccctccccttcccctcaaaagtttatgaataggctctgcatatgagtacccaaatatcattcagaactgcattttactgtatcaaagcctgtcatgcaatccctgaaaactggaaatatgacgctatggtgatttatgtagatgggccaaagtaaggaaaagtatatgtagttatttctccagggtttattcatgtaattgaatgaggaacaaaggtgttttgttctttttgtggcaggagctgatagccagcaaccacacttcaagaaatggaaggcagctgtgaatgcttcattcaggcccaagtaaatataggaagaggtgtagtggtgtatagcgtactgcgtttaaagaaaaaacactctgaaataatgggaagaaggaagttatgatatattagtcaggcagtagatataccttaagctgaaatgaaatacaggtatcatggatatgagatctgtatatgtagaggaaagagtaatggaaaaatgtcaggggcagtgaaagcaaatgagaagtgagatgatttatatttattgaactaatgtccggtatctctttgacagagttgaataataatcagttgtcggtgtcctttctgtagtgttccacattggatgggtgaagaagtcctgatagtcgattattgatcacataacaaggtcaatttatcataactgaagtgcgatcgatttgtgggtgcaaagaagaaacaaattctggaaccgaataatgtttatatttgcttttctctttggaaacaaagcagaaaggggcctttctgcttgtaagataaacatttcttcaatacactatggaagcgctttgaaataaagattccgaatggttcaaaagcaaaaatcatgttgttgttattgttgttttcttttttcctgttttcttgactactcattgtaaatgctaaagtctttctttatgttttgtgttttagccacgagactcaaacaacttgctgggaccatcccaaaatgacagagctctaccagtctttaggtaaggacatggccatgtttcctccaagttaaatgacaggtgacctttaggataaagtagtttgcagtgtgaaagttacttgctatataaatacatcactagattgtttcaagggtgaaagcagtggcaccttcctatccaaaattgacagtcagctttctttttatcagaggttccttaaaaacaagttttagaagttgattgattcctaaaaattcaatatacctgagagggcctataggtctttgtagttctctttggtgcctaaaatgatggaaaaacagttgcaatttatggctatttttttttttcttcccacgaagatagaaaactgtttcaggtgcttgttgatttcttccgtgtgaaaccaagacaacccttttgccaaaccacaaatgttgtgtaaaggaattttctgccgtctttccggtgctcacaattcctaaggcctggcgggtcattaatgtgaacatttaaatgatttctttagtatggcttgttttgtgtttatgtaagagcctgacagttctgttttctttcccctcataacttgaattattttgaatgggtacagagcatacaaataagggtttgaaaacaccagtctttttacactggacaaatgtccagatgtctggtttgtcgttttagatctacaaggaatattctgaaatgagttatcttaagttgcagcttgttttgggttttgttttgggacagggtcttgctctgtctcccaggctggagtgcagtggtgcggttatagcttattgcagcctcgaacccctgggctcatggcggttcttctgcctcagcctcctgagtagctgggacaacaggaatgcaccaccacacccagctcatttttaaaatttatttttatttatttttgtagagatgggtctcactatgttgcccaggctgtgtttttatgtatttttttaatataaaaacgtcatgtcttttctactttttcaagcctgcatttctgtgaatggacatattgatagaaaaacacataaggcgatctctttggatttaaggttatgtgatgaacactgtgggaatcagggtacttaaacataaattctgtgtaggtatacgtaagtggggtgtgtgtgtgtcagggggtacgtagctattactgcttttgtgtcatagattctcacaaaatgaattgcagctatagagacaccaaggactagagaagagatattagccaaaaaaggttttattaaannnnnnnnnnnnnnnnnnnngaaaaacaaagtcacttatactagccagagagatccaatacatttcgagtaatattatgtcatttcagtctggttataagtgtgtaaacgtttaaaattttaaataaaattgggatcagctaattttcaagtgctacatttccagcccctacagaatgtttttggcttataattgtggactgtttataccacaggtggaaaacgtgaatgcttatcttttggcaaatgagagaatgaaaaggcttcatctgaagtgggcagcagctgtcctgggcaagctggtctttctatcccagtactcccaggacccctgattgtacaagagaaaaactagaaatctgtccacaaagagctaatttaaattagtctgtgggcctcctgatcgtaacctgtggtttacacagatttagcccacttctaacatttcctactctaattacagtaatttctagttgtaatattttaattcactcttattttaaaatcattattattatagaattaatacctattcatatttttgaagtttaaaaatatagacaggctaacaataaagaagagacaaatcattcgtaaccccacttcttagagttagctggtgtttaataatctaggatcttcaaaaatgtctttctatacatatatttttatagaagttgaatcattctgtcttataacttgcttttttttttttccactggaaagtaatgtattaccatggccatatttccattttgttgtatagtattctctaccactttcaattactctgtaatgagaaattgcaaacatgtttgatgaaaagctaattatggactatcaatgaatacatgtttgctcctttaatacaaattaaatatacatttaatcattatatttctaaaattttctccatactttagatgtggtgataaactcaaaactgataatctctcatgacttgtgacattgggcttgtgacatcactcaattttgaattataacagaattttacagttgcaggggattttagaactcatttattgcaaactttctcttttatgaaatcaactttcaggtataatttttatataataaaaggaagtcatcgtaagtgtgtgatcaattccagccccctttgaaattctgtttcttgctagcccaataacaaaccacttgcaagtgaactaagtgttgaagtttgcttttcaccttcagagttaatatttccaatagttttgtaacaatcaaacattcgttgggcttttatccaagtggtgattcatcagataacatctcccatttattgcgggcctattgtatgttttccacatgggatgtgccagcaaccaaccctgcatggtggatggtatcaacatccacatttcacaggacagcgaagccaggctcagggaggaattgatcagggctacacagctatgtggggctacacctggatttgtcctcagttttctgttagtactttcactgttctcattgattttatttactaggtaaagtatatttatgttggttactacatacctgctacacgtatataggaattgatagttttacctatgaatagtaagttacttgagtggtatttctggaaatggtatggtgggtcctaaacaatgggcactcctttcactgttgcctggcacatatagaatgattgttatatggctacatccttttttgtttgtttgttttttgagacagattctcactctgtcacccaggctggaatgcagtggcacgatcttggctcacggcaacctccgcctccccaggatgaagtgattctcctgcttcagcctcccgagtagctgggattactaggcacccgccaccatacccagctaatttttgtatttttactagggacggggttttgccatgttggctaggctggtctcgaactcctgacctcaggtgatcctcccaccttggcctcccaaattgttaggattacaagcgtaagccacagcgcccagcctgcctacatccttgagatcccatataagattaactaccagcactgcctttccccctctccaaaattacagtgtttcagagtcgaaacataagcataaaatactgaaaagaaacttttcattgattttagtttttacttattagtttatatttttcttcttcaagaggtatccctttaggtccaaattgctctttgagctggatgaaatggtcggaagccttcaactacagtcagttggtgaaaggtatcttgaaagcagaaatggtgttgtggtctggcgtgtcaaatgtttaagaccacatctagccccctctcctaatcgaacctgaacctcatgtctctggtgaggtgctgaaaatatcaagatgttgctttttccctctgtacccccactccaggcatactctaccgtggaagctacagtggttcacagtatgcatggtaggttacacattcctagagacgcccacttctaaggagatttccattctctaatttgccaaagttcccaagcagcctgttcaacacatgtttatgttacctgccttgccctcaaaagcattcaggtgttcccctgcacccagggtttgaacacaataggattagaaggtgaaaacattttgttagaactgaaaaagtagcaagtatttactgatgaaaagctataatattgcttgagatattaccattggagctctctaatacattctgggtggttttctttttcattccttttccactgattttctacaatgaatttatattatttacagttagatgtttggtaaaaaagtttcttcgtcgatacccccattccatttcttacttagtgtctctatagctacaattcattaactaatgagaacttatgacagaaaagcagcagtagccacacacacacacacacacacacacacacacgccccacatatatgtagataatttatacttaaggaccctgattctcatggactttgtcaggtaactttaaactcaaagagatcatctcatgtatttttagtctgtatgtccagttgtgaaaaatgcagatgtagacattttagtggtagagaaaatagaacttttttgattaaaaaatagataaaaaacaatataagataattaattttagattatttccaacagatctaaaatggctttgcagaggaggtttccatcaagtgttagaaatattgtgtttccctcatttatcggctgtgtacctacacaaaaaattgagagaaaatattgccagagtcctacacaaacaaagcaagacatagtaaagaaataatttaaaggttcactatgatgactgaacagtcattaggaatttgagtccccagaaaattttttacatcacattaatggtttgacaaaagcattgtcttggattttcacagggaataaatcactaaaagcaactggaaatcagttttctttcagcatttgtctgtgactacccccaatagtcatagaatggtagtagagaatagtagtggagtaagtgggatataagagaccaagtgtctcatgtctattttttgtagaccttggtgctttatctttaaaatgtgaggatattggggctgggcacggtggctcacgcctgtaatcccagcactttgggaggtcgaggtgggcggatcacctgagtcaggagatcaagaccttcctggctaacatggtgaaaccccatctttactaaaaaaacaaaaaattagccaggtgtggtggcacatgcctgtaatcccagctactcaagaggccgaggctgaagaatcacttgaacccaggagtcggaggttgcaatgagctgagatcacgctgtagcactccctcctgggcaacaagagtgaaactccatctcaaaaaaaaaaaaaaaaaaaaaaagtaacgatattggacaagtgtctaagatttttgtttttcttttactttgggctgagggtggggcaggctgtttctaaacttgctgtgatcattatttttcaagaggtacctttcggctaactctgcagacaagtggatttctaaaaatgtaatcattcctatgttttaaaatgtacattctgagaaaacaaacaacaggagaagattatgccacccatccgtgtcttacaggctgagtgaggcaagctgttgtcaaatagagaggctcttgagatatttcccattagactcctctgggtcattcatttgttattgagagggtacattcttcgtcactccctagaagtaataatatgtttgattcatgaggtgagttttagatttctattagcatttttacaaatgtaatggaaagactgttccaataggttagcttggtgatttaaaactctgagctcttcaaggctccagaaagcatttacaacatcagtagatgttagatagtaatatgctctggaatttattttgaaatactaatataatattgatttacatgaagtgcaattatgtggttaaaagcctgtccttttctcacaatttatgtctaggtccctaagttcattactgaaattttaagaaaatattttttaaaaagctcaccctgcccccacacacataatatatgctgcttagagatacttttattggggtttttttttttttttttgacagcatcttgctctgtcacatagactggagtgcagtggcctgatcatggctcactgcagctttgaacacccaggctcaagtgaccctcccacctcagccttccaagtagctgggactatagccgtgtgccaccgtgtctggctaatctttttttaaattttttgtagagatggaggtcttaccatgttgcccagcctggtctcaaactcttgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaagtagttcatcaaaaaaactaaaaagctttcatgaggagttctgaggtgacatagataagataccagaaggccacccctgggttcaaaggaaactgatcttaaaggagaggaggtagcaattaaaacaaattatctgcagagaagtccaaacactaaggataagcttcccatgcatttgatgaaagtacttgcgacgtttacaggtgtttatgctcatgactctcaagactaaatacagacataccttggagattttgcaggttcagttccagaacacttcagtaaagcaaatatcacaataaagtaagtcacacaagtgttttggttttctagtacatataagttatgtttactctataatgtagtctagtaagtgtgcaacagcattatgtcttaaaaaacaatgtacataccttaatttaaaatactttattgttaaaaaagctaacgatcacctgagccttcagccagtaatgatccttttgctggtggagggtcttgcctcgatgttgatggctgcacagcatggtggttgctgaaggttggggtggctgtggcaatttcttaaaataagacaacaatgaagactgccactcagttgactcttccttttgtgaaagatttctctgtagaatgtgatactatctcatgaaaccacttactttgctcatccataagtagcaactccctatccattaaagtttgatcatgaaattgcagcaattcagccatatcttcacgccccacttgtgatttcaattttcttcctgtttccactacatctgcagttacatcctccactgaagtcttgaacccctgacagtcatccatgagggttggaatcaacgtcttccaaactcctggtaatgttgatattttgacgacctcctatcaatcacaaatgttcttaatggcatcaagaatcacttccagagattttttttttttttttttttgagacacagtcttgctatgttgtccaggctggagtgcagtggcgtgatctaggctcactgcaacctctgccttcctgggttcaagtgattcttctgcctcagcttcccgagtagctgggactacaggcgtgtgccactacgcccggctaatttttgtatttttagtagagacggggtttcaccattttggccaggctggtctcaaactcctgacctcatgatccacctgcctcggcctcccaaagtgctgggattacagccgtgagccaccacacctgacttccagagattttccatttactttgcccagatccatcagaggaatcactgtctatgtcaagctatagccttacaaaatatttctcaactaataagagttgaaagtcacaattttttcttaatccttgggctacagaatggatgttgtgtaagcgggcatgaaaacgtgaatctctttgtacatctccatccaagcttttgggtgacaaggtgcattgtcagtgagcagttatattttgaaaggaaacctattttgaacactaggtcttacagtgagcttgaaatattcagtaaaccatgccgtaaacagatacgctgtcatccaagctttgtttttccatttatacagcacaggcaaagtagatttcacataattccttttttttttttccttccaagacggagtcttgctctgtcacccaggctggagtgcagtggtacgatcttggctcactgcaacctccacctcccgggttcaagcaattctcctgcctcagcctcctgagtagctgggattacaggcgtctgccaccacacctggttaatttttgtatttttagtggagacggggtttcaccatgttggccaggctggtctccaactcctgacctcgtgatctgcccgcctcagcctcccaaagtgctgggattacaggcatgagccactgtgcccggcctgatttcacataattcttaagggccctgtgatttcagaatggtagatgagcattggcttcaacttagtcaccagctgcattaggccctactaagagatacagcctgtccattgaagctttgaaggcagtcattgatttctcctctagagctatgaaagtcctagatagtatcacctttaaatagaaggctgtttcatctatgttgaaaatctgttgttcgttgtagccaccttcatccatgaccttagcttcatctggaaaacttggctgcagcttctgcatcaatgcttgctgcttcatcttgcaccttaatgttatggatatggcttgtttccttaagcttcttgaagcaacctctactagcttccaacttttcttctgcagcttcctcatctcttttagccttcatagaattgaagggagttaaggttttgctctggattaggctttggcttaaagaaatgttgtggctagtttgatcttctattcagagcactcaaactttctccatatcaggaataaggctgttttactttcttatcatttgtgtgctcgcagggtagtacttttaatttccttcattaacttttcctttgcattcacaacttgactgtttggcatgagaggcctagctttcagtctgtctcatctttcaacatgctttcctcactaagctcaatcattaatagcttctgatgtaaagtgacagaggtatggctctttcttcccttgaacacttagaggccattgtagggttattaattaccctgattttaatattgttgtgtctcagaacaggaaggccagaggagagggaaagagatgggggaacagctggtcggtggagcagtcagaacacgtatgacgttgatcaattaagtttgccatcttatgtgggtgtggttagttgcaccccaaaacaatttcagtagtaacatcaacgattactgatcacgattcaccataatagatataaaaataatgacaaatttgaaatattgagggaattttcaaaacgagacacagacccaaagtgagcacatgctgnnnnnnnnnnnnnnnnnnnntgctgatggcctcgttcgttcattggtttcctgcttcagtaaacatttaagagcgtgccatgtattttcaaactttagggcaacaggctaaaaatatcaaggagaaaaacgtttactgagggtatagaagtttttatgatcttacttttattgaacattaaaacatggatgttcattctagaaattttagaaggtgaagtgcaaaaacaaaatgaaaatcacctcacatctcagtacccagaaatagccactatttacattttaaaagattgcttccggtcttctttcctatgcatttttatatagttgtttgagataatagaatgtttaaagtgttgtatcctactgtaatcataagtcttctcttattcttagttcctcagagatgttatttttcgctagttgcagtttattggggtaccacttttgtaaaaaaatatttcccaatttttgaaaattgtgacaaagaaaagtcaaattcgtgttgaatttatggaaggaaatctttaagaatctggaggcttattactaacaagcttctgagaagaaagccaagtaaagtgttataataccttctgtccaacaagctacttatgtataagtgatgttacagaataaagtcagtgtggtcaaaaacagacagtcagttatcagaaagttgataagtaacatttatcctatgaaaaatatagctatgaatttaaatcaatagttttctaccacaaatatcttaatggataaaatcttctttaccaaatatgtatgatgtcaaggtgacaaggcaagtatccttgtaaactttccgaattacaggaacaactttgcccttcttagcaagcaattttatacagaaactcaactttatgatgggtttctgtaagttttaatttttataataactgatatgtaaatatttagttacctttaacttatctctccaggtagaatggctagcagactgttttatcttctcaaaacatttgtgtgtacagttcccatgttcttttcaaggttcttgcttctaactgtcagttaaggcttttgtagcctcttacttcagttacattttctggccaagacgcaattaaagaatatagagctgataattatttccatagtcgtttccaatttttctactgttccacgtaagactttgaggaacacctttatgcataacacctttctacatttgattcatgtaagtggaatcactgagtcaaatggtgttaatgtttctaagcttcttggaatgcactgcctgaaactttctcaaaaggctgtagccatttacactcataatacttcaaagtgccaatctaaccatgtccttcccagcatggagtattatttttacttttgctattgtaacaaggaaaattaaaccatctcattgttaatatttgtgtattttttatttctagtgaccacaaatgttttcttttaaatatctgctgggtgtttttcttcttttttgagtaatgtgaaaacaaaacgaagttaaccaaacacaactcttccaaacttttctgatataatacacacttttttgtgtgttatgttgaggggctctagttggtaacagcctcctggttacataaatactgtacagtttaattttttttcagctaaataagccttatccctttatccatccttagtggatctattatctacccattaaattaaattttattctctataccaactcctgtttcttcacattttttaaatatatgcagagccctaaattacagtggctgtcctaataaaaggctattcagttattaacagaaaaggaagattgcttcctgcctcttgggtgaggaagactcatgtataccatagatatggtcagtttacatttacagttttctgtgaggcattgatttttttcccccataaatatggagtacttagaatgttcaaaacctttctctgggtaatagaatgcacaaaagtataaggcatgatccctgttcattgcccaagctggcgtgactctggtcatgcagcggacttcatgatgtgatagaattccttgcctatgagagtgaaggagatggtaccaggtctacttgtggccggtggtggaacacttacattattctaagtcctttctgtctgtagaacccaaatgacaaccatattattttatcttctcttattgctagtggtatcgtttattaatgccaacgtatacccattttgcttttcaaggttactttagatgtcttaggttggaatgactgaaggcttatacattcaaatttatatatgacacacacacacacacacacacacacacacacacatatcttattgttgcctgctatctttctacctgttgtataagaaatcctttgaaaaaagcctatgtcagcttcacaaaagatgttactgtgttttgggggaaataaaattgggaagtaataaaacagttaataaatgttacaagaccgtgtacaccaacttaaataagattaaggtcaaacgtatggtaccttatataggtaggaagagcagtattaattagaataattagggagagttgtttggagagtggaaaaaaacattgttctaggaagaaattttgtaatactcaggtaaagtaaaatgtagggccaagatattccagatagtgtagcagcataaacaaaggtatgaaagactggcttgtttgcgagtcagtgaagacattgttctctgagaatctactccagatttttttttttttttttttttttttttttgctttttgagacagggtctcactttgtcgcccaggctggggtgcagtggtgcgaacatggctcactggtgccacaacctcctgggctcaagtgattctcctgcctcagccccccaggcagctgggactacaggcacacaccgccatacctggctaatttttgtatttttggtagagacagggttttgccatgttatccaggctgttctcaactcttgagctcaagccatctgcccatctcggcttcctaaagtgctgggattacaagaatgagccaccgcgcctggccactccagatttttaaaagggaaatctgattcagtgcccctggggtgaactaagtgccttaaattatagagtgagaaatttacattgcatttgattggcaatgggaaaaacattgttaaatcttcagaaaagagaaataatgaagtccgtcttctgtgttttggaataggaatttggtgggtgagtttaaggacagttagagaggggagagattatttcgttttgttttgaggtaattgacatgatgagggtcttaggatagcaatgggggaaggaaaagggaacgtgactccagaggtttttcttaacaaggtagaattgccagaaggtaatcacagattggacaggttttaaagaaaaagggagttatatgtcttcaaaatttgaaggcgtggtgacacagagaatggtgataccattgaggaaaagaggaaattgcaaactgagcggagcaacagggaatagatatgaatttgattgaattacatacttatgggtttatttacaatttctcttcttagaaaaatttatttttggtggctcatataaatgtatgtgcttccataccataagcatatatttctcattaatcctttcaaaaaccctgtaaaagatatttgtatctccattgtgcagatgaggctcagagaaaataggtaattttctcacattgcaaagcagggatttacgtgtacttttaactcctaaaccagcgatttagcccctcagctatactttcttcctgagaggggacagtggcattttgaagaggaaatactctaaagccatttgaaaaggggaaccgaagaaagagtttggtccacagcatgataaaaatattacttgcacttttattatactttataacaagaagtacggggcagagaaaggttcctaacttttactgagcaagtatatatccaagatacatctcctctttggagcttttgagatacactatctctcttagttttgcaacagccctaggaataggtactattactgttccctttaaaaatgaacaaaaaaaaaatgaagcttaggaaagttaaggttactagaccaagcttattgggagaccatagtgatgaagaggaagggctttagggtcaaatggatttgaattttacttcttaggcctttggtttccttatttataaaatgggattgaaataatgatatcacagttgaaggtaattatatgagaatttatgttatttattgcaaacatagggtaagcacctaataaatgataacctgagaatttatgttatttattgcaaacatagggtaagcacctaataaatgataaccattattactattattttacagcaaagacataaatagagcccattaagttttcttctctacccagtagtttttccattgtacaatagtactctcctgaaggacagcgggtgaagctaagaatttggaagaaatcccagatagagaaatcttgaaaagaagatagatagatttaatactcaatcattaaaaaaagtgcacatgactttaagaaatcaaacattgtaagaggatagtattgaaaagtaagtctccaaccactcttggtatcaatcccctaattttacttcctagagacaattaacagtatagtttttatgtttgcttctgtaaatatttttgcatatacaaacatacacataaaaatatgcccatttttgcacattgagagtataataggcacaatgttctgttctttgatgctattaccttttacataattaacctggagttttttttttcctgtagcgcaatagactgacagatggtgaatgaaaacttgcactatggagagttatgtcagtgttttaataagacaggaacccagaaataaatgtacgaagtttaacatcagcatctcgtggcctttaagtcaaattggacaaccattcaaagcttcataaatgctaactgcttctcatgacttcagaagcaaacaaaaaaatcattattcaaatgggaaattaagctgatcatcagaagtacagagaggatgtcctttcttaaaggcggcacgtctaagggagtgtctgagacctggcttcttcattcaggatggaggctgctgctactctttaaaagaaatgttcacatccttacttcctgacttccttctataacacagtctgcttcacaacactatgactttatatgtcagagcgggttaggaggagctgaatcttaaaaatttaagaagatgccaaggtctagaaaccactcttaacaggggaaaattagaccctgcttgcttttgggaaaatttgttttccagtcagatgtttgtcaaggttaaagaaattcacgggccctctgttcgaattgggagcaattgggagcccttaagctgaatgagtagacttgaagtcccacttagaatgagcctttatatttttgttctgtggcttgctcagggaagggatacacacttggggagaaaaagacttggattctagttgatgtttttctcctagctgactagggaattcagaacaagttactaagagctttctagtccttagttctctcatttggaaaatgaaaattttaaattagagattctatttctaaggcaccatgtatttcattttcttaataaaaagtatatatattcccctaaagaatactcataagaaaaaggtagagttaaaatttcccaaattatttaattcctggttgcccagtaaccattaaatttctcagcagtcaggcaagaaccacattcccaccttgagacaagatttaggcctttccaaacttaccctcgggctctgttccaagtttatttgtaagtcagttgcatacaatttggaatgaaatgtgttataaatggtggttaggtccctaagtcacagaatcttagttaaccctcagagtgcctgatatactgcaccatgtaaatagaaagcagctgtatgtttctatgggagcaaaaaacttttgtaggaaaaatggtagaaactcgtactgcaggtgttgattattcagcaaacttctctagataaggaggactgggaacttcatcattattggtctagttacattcctggtcactccctcatcccattgactggtcagtttccctccctgtggtccttgtgcaagggtttctgcctcaccccataccctctgctccttgcccggtatcatggttcttctgagggtactactgcccattcacccttgtgctaattaggattacactgggtaaggaaagacatttgttctgtagcagagaagcggggaaggccatcagaggctttgagtgtcagaaagatttggtcttgaatgcaggctctgggatgcaaccgtagggaagttaccaaacatttgtgagcctcattttatctttaacaaagctgataatacagaactcagggccttgtaaggactcgatggtatcaggtacacacgacatttgcccttgagtgctcagcgaatgttagtattccttctgccatcggcctgtcacttccgtttttctctttggctctacagggaatacttgcatacaaaaagagctgaagtaagagtcacctacatcttaggaaaaaagggctgctttaggtttatcctcaagtagttttgtccaggattctgaggagaataaaagctgggtcagatccagtgtgttgaaaagaaagctgaggtgagaagtgagagaaacagagaggcagagaaagggggaatgagccctgtctgctatgaagtaggaggcaatccaaaagacaaggaatccgtggtcattgccactgagaggagaaagaaggcaaactcactcctgtgacttcagggccatccatgaggtgggcagaggaactcagagtctgcccgattcttggattgaatcttcaaattggtaaagctttatatcaagcaactcccaaatgcagcatagttttgaggtgataaagaagagtcttttcaaggctgggcacaatagttcacgcctgtaatctcagcactttgggaggccaaggcaggcagatcacttgaggtcgggagttcgagaccagcctggccagcatggtgaaacctcatctctactaaaaatatgaaaattagctgggcgtggtggtgggcacctgtaataccagctacttgggaggctgaggcacaagcatcacttgaacccaggaggcagaggttgcagtgagccgagatcatgccactgcattccagcctgggcgagagaatgagactccgtctaaaaaaaataaaaataaaataaaaagagtattttcccggagtaccggtaatattggttccagattcaaatgtattgtccagatacacagagggtaaacaggaacgcttcaggcatcctttattaaaagcacctcagtctatgtcagagggccaggcagtccattatctaatgaaaatctcctaccattgatttattttatcataactgcagctgctaagtaattttgtttaaggaatgatttacatattagtgtcttcagcaggatctcatcattagcatctagtctccagaaaagttaacacataacagtgaaaagaaaacattctctatcacatgcttctgcatgcatgggcaatttgagtcataccacctgttcccctcttctgttatgctagagtatacaaaaagcagagatacgcatagtttactatgatcctagatgcttaaatatcttgaattgtgttctatcttggactcattattcatgcataaagactcaacagattctcttcttgcacctctcaaacagcaacatcaacaaaacccaaacaatgtatctttcctaatgaggtgaaagcatgcataccagcctaagacagaaatgttgcaaaaatgttttttgcaagaaggtcagtttgcttttcccatggtaactaaggttaatttctactgtggttaattttggcatccattttattcatgatgattattagagggcatggatattgggggtgtgttgatgttgggcaccagagaaatggaaagaggcagatggaggatgcaaatcattttcactcagaacctaaaatgtttactgttagataaagggtagagaagaatcttaatttgactttcaaaacatatgattagttgaagttaccaaaactatttttttaaataacatttatcttaagagctataaataaagaggaaattttgcactagagatgaagttatgaacatttcattaactctaaagagttaatgaaaaactagttgattatatgtgttcatttataggttgacacgtgaatttccagagaagtaacttgtatgtttttaaattccaatccttatcttacatctgggcagaatcagacttgtgaacgtcccattccaaacaaatggctaaacactttgcagactttgtctagaagagtgccttacccatataagccctctgttataaaattgttttaaacgttaaattagctgtcaagctgttctgcatcagtggcaccacctggtagcaaggatggagatctctgccacccaagatctctttagtgctcacgtcatttctccaccgcaaggaggattgcgggggtggacgatgctccctatttagtcttctgcattttgttgcttacagttcaattaacatgtcagttagagatgacttttggttgcagttaataaaatatctgaccaattgtatcttaaacacagaggagttgatattttttgtagaacaagaagtctggaggcaggtagttgagagctatggaagagttccgtgatgtcatcagagacctgggccatggtttattctgctgtaccatttttaacgagtgactttggtcctgatggttccaagacgactgctgcttctcaggcaggaagaaagagaaaggacgttcagcctcagagtctctttgtctttccatttgggaagggaaatcctttcttgcagatatcttctcaagcattggccaaaactgtgtccacacagcttcccctggctggatcagggaattgagatcctccagcctttgtagcagagaaagaccaaggagaaagaatttgggaaggggtgttgagtgagccaacatacagttatctgccacaattaaatacagcggattcaccttgcaaataagcattctttttagaccatttattttctttctctctttgtcccaattcctttattccttaggaaagtcttgatatctttgtgaggtgtgtttcaaaaaagaagctccagctcaggttgtaaggagtaagcaaaaataataattccagtgattcagccatagaagtggaaaattatattatttgaagaaaaattagatgtaaaatcaatgtcatcgacagcttaaacctggtaaaagcaaggaagttcctttcagaatctaattttattccaaatacatttattgagcaccatcatttattgccctagatgccaaggataagtgaacacaacatgacctcttcagaagtctgcatttttctcatcttttttccctcaagtataagaatgaaaaataaagctatttctaattagttacatcagtcatttctatcagtattactatagattttatttttattgtatactggatatttaaactaaatttaagcctttgtgggcttagaaattactgtttcatgagtaacatggcttatgtaggaaatttccaatgccattaaccttaaaaatgttcattggaatactgcttatgtcatcttggaaactacctttgcggttgacatataaactgcacgatggtctattttcattatatgtttctgtatgtacataagcatcctcatgataaagattgtctacttgatcaaacttcagccagactcctgaaccttctcctaggcccacctgtgcacttctttgtaaaaatccagctgtagcgagaatcctgctaaatcagtttagcaagaaccaccttcctcttatgtatctgatcaggttcctcatcctccaccatcccccatgtgacgtctgatcaccctggcctgtgtcttcagcaaggttcctgttaagttttttttagctagaatcccccttacccccatgctttctcttagtagttttccatccaccaaaccccaccctgctccttggctatcaattcccacttgtccatgctgtattcagagttgagcccagttctatactgaggtctctttcccactattgcaatattcctgaataaaatctgtttttaccactttaccgtccatctctggtttttctttgacactcacataaccagagttttgtatgtgtgtgttgcttgacacatcacaaatacctgggatacgtgtactgattttttacagggtgaataatctttttgttttccccaatatcttagaaacctgaatctttaacccctgggcttagtacacagttaggcatataataggtgcttaagtaagcgtcaactgatgattttaaatgcagaagtaattgtcacttaatgaaatatagtcaggagactcatggattttggcctgtcttcctacctgttcttgtactgcaacagtaagtgtattaaggcaatatttttggcagcacaatcatttagtttgaatgcattagtaaaaggtggagtccaaagaattaatcgctggaaagttttgggaaaacccagtaacaactgtttccatagagtaatttgagtgacagccaggtaatagctacttattggagggactccacagtcagagccttgacagggacctgaaaaagagtgtaactgaagggtaaatgtaaaagcttttgggagaacaagggagtggtcaggctgaggcaaagatctgaaaagaaatgcctcctggggccaagctggtaatttgaatgactgaaggtgactgggtgggaactggggcaacctgaaaagcttctgttagggtaacagagcctccgttgcagctgactgttctatgagaatgtgagtctctattgtcaggtcttcaggttcttccagagaagcaagacaacgggaaatcaccagatttttaactaatggcgtatcattcaacaatttcaaaaaccattatgtgagcccaaactgaccaacgaatcaaacacacacacacacaaaaaaagagtctgcagactaaattcaaccagttggtgacctctggtctgtggttaccagagaagtaattgaaatggagttttgggagaaagatcatatgttgaaatcttgggagataagggcagagaaataagtaagccgagacggcggtaaggccaaggtagaaaaggtagcctttaggaaaattaagttaagactttttaaaacaggaaggggcaaaagatgaggttaaagcagatgaggaaatttactgttatttattttcatcattaaaatacgctttccacaaatttttcaactgtaagagagagtgataaattcaaaataggtaatgtcaaccatattatgaagagtatgtttttgcaatccaaaaaagctaaggcacaacattaaaaaaaaaatctgtgaatttggctttgcaaaggtataagaattaagtcacatctgatcatttttagagtcttaccttttataacaaagaggaaaatttaattaaactggctctgccctggcgaatctgggatgtgtgttcacttatgaagagagactgttaagattcgttaattaatgaggttgagaatagagttgaaggagattggggtaaatttataagtttgtgtcattctgagagttctgtaagtagctgagttacccatgttgtgactgagaaaaacaggagagagcagtgactgaaggttctgagccaaaggaagagaatagtattgtttattccagcagccagagtggcctgtgtgactgtaagtcgcctgtcaagagggagactgcaaggaaagtgcattgatttgatttggagtagttgtaactgcagcatgaagaatatgatatataaggatgataattgaggaacaatttaatggctgcataccttgctgaagttgaagttccttctggagatgaaggtggcaaaaaagaaagtgcttaggtagaagagctttttaaaatgagttaacagaaaacagcagactaaatatggaattgaggagtaggaaatgaaggaaatgaatttgaagatttactttctttcaggatgcagagctggtatgtaatccctctgtttccagtgccttctcccacttccaaatttcactgctcctcatgcgccctggtgtgtggtgcagcttcgagattgagcctccagccttctgtcaggatgaagcagcaggtggctgagatgctaggctccaagtgggggaggtgtttagggctctaaagactttcaaccagtccttgtattttcagccacatttcagtcttcagaggaacctggagcctttcatttctgagacttcttggctacataaactggcatgcgtcttgttagttcctcccactccctgccccaatctccttgtctccccaacatcattaattgagcttgggatttctctggtctcctaagttggttaccagcaggtcattttctaagccaccaaaatactggagctctgatctgttctcatctcctctcctgttttgttaattttcttttgggtaaatgccattttttattcctcttctatcaacctggtagagtttcagggataaagagagacaaatgagtctgctccatctgctgtgtttaactagaagtcccaacacccaaaatccttcacacgatgtgcagggctctgcagtgggcctccccctgcctacctgtcaggccttatctgtgcccactcttcctccttcctctctgagatttcagcaatattggccttctaaggattcttaaagccccaccttcttctctgcttcagagcttttttttttttttttttttaacatgtgctgacctattacgctgctgtgttcttacctggcacgctcccatcatccttcaagtctttgcttcaatgtcaccttctccaagaagcctctcggacctatgtttccctatgtatacagtctcatcacttcctgtgtgtttccttcaccattttaccacagtacatatgaatatttgtttgttagtttgtttgagacggagttttgctcttgttgcccaggctggagtgcaacggcacaatctcggctcactgcagcctccacctcccaggttcaagcgattctcctgcctcagcctcccaggtagtagctgggattacaggtgcctgccgccgcatccagctaattttttgtatttttagtagagacggggtttcgccatgttggcccaggtggtctcgaacttctgacctcaggtgatctgcctgccttggcctcccaaaggctgggattacaggcgcgagccaccgcacctggcctacatatgaatatttgattattatccatctccttcgctacactgcaaagtcaataaaggcagagatttattttggttaccagtgtattccatgtacttggcatggttcttggcttatagtacatgcacaataaatattgaaaggatagatgaaaggattatggatagatgaatgtcttttaagcagttataaaacagttctgcctaaagagtcttttttaatcagtagtattacttcaaatacatatttaaatacacatatgttataaatatataaaatatgtatttaaatatgtcatttgtactattttaaatgtatttaaaataatatatgttatatattaaaataatactaatgatttttaaaagatcaggcaacactgctttgtagctttttagaagacatttatccttatggatccataattattatggattgtatgttttatatataatgaaggttttgggagttagagccctgatccttccgctcttgaagcttgatttaaaggagcatggcacagtggtgcctatatgagtcagccctccattatctggggcagaattcaggccccagaaatggtacttaagatacacagttctcccccagaaaactttatatcggccatttgttacagaaactgctttctcaacaaaccttttaccagggcagctaacaatgagcaaaactaatttgaatttcaactctgccattattacagtgttgctaagaagtagtgagattctgctgaggaaggccaagcaagaggagggagccagaaatgccttaaacaatccacagccaggattttgtgctatcttttatttcacagttgaacttctcagtattttttggttcataacctttttctcttttcctcaattctgagtcttccacatttgtgccatactaggtactttattgcttctctcccttttttttttttcttgagatggagtctcattctgtcgcccaggctgaagtgcagtggtgcgatctcagctcactacaacctgcacctcctgggttcaagcaattatcctgcttcagcctcctgagtagctaggattacaggtgtgcacccaccatgcctggctaattgttgtgtgtttttagtagagacaggtttcaccgtgttagccagaatagtctcaatctcctgacctcgtgatccacctgcctcggcctcccaaagtgctgggattacaggcgtgagccaccacgcccaggctcatctctttttaagaatcgaaatcagacatcacatatgtgcatgagtagaagtgaatcaactcattgaaaaatgcttaatgcctaatattttctgtgtcagaatatattgtaaaagttaaaacagctaaatgaaacctgaagttaaagtaataccattgtaatatttgatactaacccagatttttaaaatgccttttaaaaaccacaaaagtttaaaaacagtaagattcatttatttattcaaatatttattaaaatccaactatatatgccaggcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtttactgagaaatgatgatttccaatttcatcccatgtccctacaaaggacatgaaactcatcccttttttatggctgcatagtattcccatggtgtatatgtgccacattttcttaatccagtctatcattgttggacatttgggttggttccaagtctttgctattgtgaataatgccacaatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgactttcttcacagaattggaaaaaactactttaaagttcatatggaaccaaaaaagagcccgcatcgccaagtcagtcctaagccaaaagaacaaagctggaggcattccctgctactttcttctggtatgcctgaatcactgtttgagaatggattggactttggtgcgtggaaaactggtagcagaaggcttattcactgcagtgggttgggggtaggctgaaaagatgtcagggaggattaactagaggcagaatgtgtcatagttagaagtatttagaagggaagaaagtttgaactctgatactgttccacactaatattcatgccctgaaagaatcagatcattcttgcctctcccacttggatctctagctactggaatttgccaattcttgatatgaacgctaagatttggatggagcttgtgacctcatttagaccatttgttctaaatgctgaatagaaccaggaaaataggaaaagagggtagaattggggtcataagagaggaatcgtcgttctttgaaagaagaaagatgataggaaactaggcacatgagttacgaggcagtggagaaggaggattagaaagggaaaaaaagaagagaaactttatgccaatatcttctacaagatgtttggctggcacaaaactaacactcaatacttttgcataagtaaaggaatgagagaaaatttgggattggatgcttatcccctggaaactgctacaggctggtgttaatgggaaagggatctgtatttgaccaaaagtgcatttccacgtctctacatttctttttataaagagtcaaagggactcaatgatgagtgtgtgtgtaagggaactccacactagcaagtacaggaaaaatttgatggtactggtgaaggatgttgcaccaatctggaggggaggacaggaattggtttctcatggattgatgccgcaagacaattcataccatgagttggctgagaccacttaaaaaagtaagcagtgatgactgggcaaaagagacaaaggaagaaccacatcttttaggggagagagagagaaggacaattaaagggactcaactagatcaagttctgctcactaaaggacagcgtccaggcaaatgttaattatcttcaagaagcaatctgtatatatagcatttcaagatactccgagatgcttttaatttattgaatactttttattggtatttatcataaacaagagactcacaaatatatcccagaggggaggttttggtgtagttgactatagtagttattaaataatctattaataaaagcccacaaaatggaagatagaaagatagaaaaacaaaagacaacacaggatggtgttggtatacagaatttatacttgaagtttaacaacacggaacaagaaactttattaaaatattcatttaaagaacttccatatgaatcaccagaggctcttagtaaaatattgattcggattcacagatctgggtggggcctgagattctacatttctcataagctccaagcagatactgatgctattcttcctcaaatcacactttgactaacaaggactcacacaggttctctgtaattggtgttggtagtcattcatggttagatgtagttgaggactgccctcttaactacctctcggctgccaggttataaagaaagcaagtctcagtacaagttctgtcacttaggagcatttattagccaatgggtacaaaacaatcttacagcctgtgccagagacacagtgaagtcacagttctgtcttttggggtgcttggtgtgagaggctcacagtctacacaggccacagtcctctattagagtggttctcaaagtgtggtccctggaccagcagcatcagcatcacctggaaacttgctagaaattcagattcccaggcccttcccatacctactgaattagaaaatctggaggtggggcctaggaaatctgcatctttaaactatccactccaggtgattctgatgtttgctcaagtctgaaaaccattgttctagcagcaggattccctcaaccatctaactgaattctggcaactaagaatccggtgaaccacagctggacattttggaattcagcctagggcaccatttctaaagatggagaacctactggattcttcttaaactcaatttaaaggcagggagtgtttctaaatgtttttcaacaatcttcatattttgcaaaccactaatatcactacacaggcccgtctaactattaattaggaaaattaatgaaacccctggtgtaataagagctaaatataactgaatcacttacagtggccgcctgtggcatgaggctttttgattaattgctagccaaccaccccttggagttcactcctgattaagacaactgaccacctctgcagtgtagcttaagctaacacacacatacatcacagtgtactgttcatgtgagggtttttaaagactcttaaaatttaccttatcagggcataatttaaacactataacatgtttccattttaagtgttcaggttagattttggcaaatgtatacactcgtgtaaccaccatgccaatcaagatataacatttcgatcacctagaaaacacccttgtgttcctttgaggtcagttacctactcccaccacaccccaggctaccatctggcatagtagctaagttttgcctgttctagaagttgatataagtgaaatcaaacagtatgtactgttttgtgcctggcttcttttacccagcttagtgtttttcagatcagttcacattgttgcattatcagtagttagttcctttttattgcactttgcacagtagtatcccactgaatgactttaccacaacttgtttatccattaccttactggttggtttccggtttttgactattatgaataaagctgctatggatattcatgtacacatctttttgtggacatacatttttttttattctgtgcaaatatccaggaaaagaatatttgagtcataatatacatgtgtgtttaatttcataagaaactgcctaactggtttcccaaagttgtcgtacattcccaacaagcagtgtctgagaattccagtcgctccatatcctcaccaacatttggtattccggtcttttaaacaaaattgtatgctgaatagtttaaattacagacattgtttctttcccctagttgaaattcaggcttttatgtttggtctctgcgatggccataaagctgaaaatgttgacccaagtgacttggatatggattgaattatttccctttcctaacacctcatcagaattggtttcgtaggtgtcatttgattatggcagtcatgtatgtcagtgtactttttctttctttcattcttttgtttattgattcagttggtcagtcggtccatgatctgtattaaaacagctttttcagagggcagttgcatattaagttgctaggaaaaatgacagaagtaggtgacagagttcttgtcttcaaggagctttttggagctgagttcctgaaataaatgtagcccagtatctatcaaggcttgtgcagacttgagtaagaacatcatctaaatatagcttcctgctatgtggcgtgagtcagggcttgatagcccggtgattcagaaaccactagtaacatatattgttgttaaccttgctgaacattagaatgattgtgccttagaatataggagccaaatgtttattttattcctaattatatttttagatgcatatcacacacatagacacatatgttggataaaaaatactcaaaatgttaacagtgcttatttaaaaggtttatataaactttttttgtagagatgggatctcactatgttgcccaagctggtcttaagctcctggcctcaagcagtcctcccaccttggcctctcaaagcgttgggattacaggcatgagccactgaatccagccagttgtgcctatttttgagtttatgggcttgtggatgatttatttgattatatatgtatatgttaaatgtctaagttacccaaagtgagcatgtataacttctacagtcagaaaaaatgttatattgccacttgattgtttaaggtcttatagctatttaaataatgtatttcttgttctctttaatcttgtgcagaaaagattcactacagtagatccagattactttctagaaaaaaataatgcctgtccatctctttcctcttgggaacaggactacatgaatgcccttcaggctataccactttagtcttcacagaacttagccttcctggttgtcaaagggcaaaaggaattattttttcttttccccacgttaacagaattttcacctccgaaagcttggcgtatacacactatatgttttctaggctatttttgtggtggttgtagttattggcaaatcactgggcgtcgggggtgggttgtctgttatttctgatggaataacaaatgctctttgttttccctcttttcagctgacctgaataatgtcagattctcagcttataggactgccatgaaactccgaagactgcagaaggccctttgctgtaagtattggccagtatttgaagatcttgatactatgtctttgcttagaataaaaagtaggttgggtacatttttacttagagaggggagaaacagctgtcacaattcctgttgcaatgtataattcattctttaatgtatccttggcctagagtttgcctagaatgttttgttttatttttagaatcattcctgtcaccattcctcagctactgatgttgaattaagatattgagaatttttattttccaactactggcattggcatcggcatccataattacctttgtgaaacttgcacaatccttgttctacctttgtttttttttctttttacaaaatgtacttagtattagaagactatgactatctgatctaaaccaaacttcatagacatgtgtggtttattagcttgaatgctaacgtgcagatgaatgaagtggtagaggaaaaatgacagaattgctttcctccttttttatcatacatctgtggaaaaatcctgaagtgttacacagctctatcatgtcatcaaatagtttatgtataactctactattgtctgagggtctgtgtgcattgatgatatgcccatgaaacaggcacagtttctttttctttttttctgtttttttttttttttttttttttttgagatggagtcttgctctgttgcccaggctggagtgcagtggagtggcgcaatatgggctcactgcaacctccacctcccaggttcaagtgattctcctgcgtcagcctcccaggtagctgggattacaggcatgccccaccatgcccggctaatttttgttttttgtttgtttgtttgtttgttttgttttttttgagacagagtctcgctctgtcaccctggctggagtgcagtggcgcgttctaggctcactgcagactccacctcccgggttcacgccattctcctggctcagcctccggagtagctgggactacaggcgcccaccaccacgcctggctaattttgtttttgtaattttagtagaggcggggtttcaccgtgttagccaggatggtctcgatctcctgacctcgtgatccgccctcctcggcctcccaaagtgctgggattacaggcatgagccaccacgcccggcctaatttttgtattttttaatagagacggggtttcaccatgttggtcaggctggtctcgaactcctgacctcaggtgattcacccgcctcagcctcccaaagtgctgggattacaggcgtgagccaatgcgcccggcccaacaggcacagtttctgctctgatggaacttacagtctaacaagggataaccaggcatgttcatgaaatttgtagacataagcaaatatatgtataatgtattaagaatgtctacagttggttaaaaaaataaagtgatcttgtctctatttccaagaccatttcaatgtcatatatttagttgtgcaacagtgggacaatggggtactatgtgaacagctaactgtgtggaatgagattcaaagaatgtttgtttgaagaggtgatgtctaagctaggtaactctagaagagtaagcagctctctctctaggaagagcgttctagtcagaaagaagagcatgtgctgaagggcccagagaaagcatgacacattcaggaactgaaaatatgtcagtatggctaaagcacagaattccaggggaaagatctattgtgaaataataggctggagagagaagcaggaagcagattgtgcaaggtttttaaaacccaagttaaggaatttagaggtcaggggatttggcctgggggtgacataatcagattgtcgcttagaaagatgattcttgctgtggaacagagtatggattggtgcgatgtgggagtgacaggagaaaaacctgttgcagtaatttaaaccagcaatgtggtggcttgaattagcagagtagtaagggagataagtggagagaatttagaaatatttaggaagtggatttgacaggcctcagtgattcatttgatgtggtgcagggatgtccaatcttttggcttctccgggccccagtggaagaagaattgtcttggaccccccataaaatacactaacgctaacggtagctgatgagctaaaaaaaaaaaaaaaaaaaaaaaatcgcaaaaaaaaaaaaaatgttttaggaaagtttacgaattcatttgggcctcattcaaagccatcctgggccacaggttggacaagcttgatgtggtgggtgaaagggagtcaaggaagacacttaggtgcttggcttggaatatcaggtgaatgtgggacttgtctggtaaggttagacacggagctgtggtgctcaggagaaatatacaaacaacgtttagggatcatgagcctgtaggtgctgcttgtaacgggggagaggattggatagctccaggaaagtgtagcgtgagaagggaagttatttaggacacaggataagcaacctacagaagggactgcaaaggaatggccaggaggaaagaaggaaaattccaagaggttatgatgccacatgctccatgggaagaaagaaagaacccgttaccagggtcagatgttgctgggatgtcagcataaagttgcggaaaatgcccattggacttagcaacaggaaggtccctagtaactttggtgagattttagaggcacagtggaagtggtgtggtgagttcaaaagtgaaccaaaagtggagaattagagaaggtatgaatgattcttggagaaatttacttatgaaggggagaagagtggggtggtagctagttggagggggctgaggagttaatggaaatgtatgtacagtcacgtgttgcttaacaatggggatatgttctaagtaaatgtgttgttaggcaactttgttgttatgtcaatataggagagtactacccaaacttagatggtatannnnnnnnnnnnnnnnnnnntacacacctaggctgtatgggatagcctattgctcctaggctatacacctgtacagcatgtgactgttctgaatactgtaggcagttggaacacaatagtaagtattgtgtatcgaaacgtatttaaacatagaaagatacagtaaaaatatataatagtgtaatctcatgggctcgctgtcatataggcagtccattgttgactgaaatgtcattatgtggcacaatatgtgtatataagtgtgtgtgtgtgtgtgtgtgtgtgtgtgtgtgtgtgtgtatacattgatccttgaacaacatgggtttgaactgcttgggtcaacttacgtggatttttttcaatcaaatgcaggccaaacatatagtattcgtgggaatgtatttatatgagtatgagaagacagggtgagattacaattattggcccaagaggagatgataaataatgggagttctcagagaatatgggcaggtaatccagagcccaagggagggaagagatacctctcttccactgtaatgggtggggtagagggaaggatctgggcaggtccaggtaactaagaaaccaggtagcagcaaggtgaaggatgtcttactataaaggcttccattttttgtatggagtggagagtccctgcaacgcagttaacagcaggagatgatgaagttgggcttatctttgtggagaataagagagagggcggagttgaaaaccagctgtgtgaacccagaggcggctgagtgtttcacggtagctccaatctgcaggggtgtggtatttccccaggcacacttagcacttgggagccagatgcttctgtcctggggtagggagggaacagctgggcaagagaagtgaggatttgggcaaaagattgattaaaatgatactgacaagtccctgttgggtaggagaagctgtgaacgcatatggaaactggtaattaggaggtagagggatgaaaatgctaactcttcagggaggtaggggaagaagtagtaaaggaactgaaggtcaagaagttgtggtcagagagaatcatagatgaacattattttgaaggtggaacagtttcaggtgattagatctaggatatagccatttgagtaggtggcagaggtagagtggatgtgaatttccatggaggtgaaatagcaagttaaggaactgagaggctagaatgatgcatgagtcccccatgccaatgttgaaatcatgcagaattggagcgagaactgggcaaaagagaaggaccgtgaaccctggctgccaggtcttcagaaataaaggggttcaaccagaggatctgcagaggctagcaataagatagtcaaggagtcacttggcatatggttcttacacagagatagagaagaaatgccttagaagtggaattatttggaaagagagactaggccttttcccttcatcttggtatccccaatgcttagtacaaaacctggcacacagcatggttcaatatgttttcatgagatgaatgcatgaatgaaagtaaaccaaggcttccatttccttatagcccgaagttatcatttttcagctatatagttgccaagtttaactggtgtttaaagggctttccaggtcgagggtttccttaggacctgttaatacgtcatagctgggaaaaagtagtttgggatgggatcgagtcagggggctgaatagagaaagttttcttgcctctttttcttcacctgcccctgcccctgcccctgccccatcccagagctactgctttcctttaataaaggagtaattaggcactggttatcatgaagtgctagagaatattcctgtgagatcctaaaagttcagaagctaaccatttgttccagtttatactatggaaaaaaaaaaaaaagaaacccagaaatagaccagatggaaaaaccttataatgactgttcctttctataatgtccattttcaccctggatttaggcattattcgattttcctgctcaaaaaaaattccattcacatatgtgttttattgtctgtcatttcaacttataatttccaataaacattgggaaaatgggggaatttcataatatacaaaattttgtccatttgaggtgataaccttgtaataaaggtaagctccgaatgtagaataatttctttaaattttcacttttaaatcaatttgaaattctctgcatttcctttctgagcatggcttttctaatatgtgaaaaagattcaagtatgccaaaattaaggtgtatgtatctaaattaagtattgaattctcattaatgctaggagggtgccatatatagtaaaactatagaatgaagagttcaccccatccttttattgaacatatgtgtggtcacattacttactttcaatatatgatttaagaattttctcctaattttatatttgcttagatttagcttccaggcttttgtcatttctaagcctgcaaagccatgataaagagctattgtctgcggtacaggcaaataaaacttgccctggctagctttccctaccaaaggccacttctaccaactctaactttaaggaaaattaatgatgttatctcagtgatttcctggtgccagtgaagagtttgaattacagatgccttggaaatatgcacttccacctctattaagcacttgatcttatttttttttcacttccctatcaatgtttccgtattgcagaaagccaaataacccaattgtatccactatagagaattcactatttaagtggagagcatcaccgttggcctataatgtccccagtttgtaatcagttaagtgttgcatgactccttactgcctctcaacacattggaaatgaaaatgaaacttggtagaaaagcaggaacaaagataaaatcttggtaagaaggatttataaactgtttcatatagctgatactccattgaaagttatgaagaaggtaatttaagcattttctttctccctttgtagttctgatgacattctacaggtgtgaggcttctaaaattaaaaagccaacttgtaagagcagaaataaaaacgcacttaacaaagcaagtgtatttagtttattaataatgtgtggtgggttggagagagcccaaaccatagggctaaatatactgcagttgataagtgtgacaaatattctgcaaacagtaagaaatagagaacattttgcctctattcagcaactaaagcacacattatagagatttggtacaggctggagttgtgtgaatagtcacagtttctggactcgccctcaccatgacaaaccaggtgaaaaatgcaccgccttctctgtaaatgcacctcaccttttgatggtgcgctaagggtgacattagataggcttcagttgctaaagaagactctcaggacccacaataacatggcttacaaatccgcgctctattgccagaaaaggctacattacaagagcattactgtcaggatatggatccacagccacaggctgcctccacagcaagggggtctcgagaggccagtgtaattattttgccactctcctacaaaaatctactttttctatataccatgtattatttttcacataggttagaggccatgtctctgttagttctgagtttaagacgtcttgaggacatggccaaactaattttctcagtttatatggtttgacagatattagtgcccaagagaggtctcataacatgacccatctatctcccaggggaaatactgtaatcttgtttagctgttacccactagggaaagaatggttttctctcagtcagatgctaaagagattaaagaacacctcgtaggttccgttttctagtaattattggttccattctccagctatcaaccttggcagcttgccatccctatccttcctcctggaattggatgcccttgaagtgcgcttcttgcactaggaagtctttttcgtcagtttatcatttctcattcaaagcaaattctacctggccaggtatctctagcccagttcctaattctcctaatagaagtttcttttatttcaagtggattcatgccccttggcccaccagacatgttgccattgagaaatagcagctttaatgggaaatacacatgagacacaaaaatgtgactaggctaaaatcatatgaatagtagtcactcctaaaaggactttggtttgggtatgtcacagaaatttctgtagccatccatatccaatttctagcttttcagtctcaggaaagtaggcccaccaaattcaacttaaatatctgtcactgattcaagctgtcccaattgtccctccacccactaatggctttccacacggagtaatggggcaaatagctatttttttaaacacataatgttatgacagatgaaacatacagcacgtaagccttctatcacatgcccaatacctttgttaaaccttcatcatcacaattgatggccacacagtgtttattgagattgttataaatcattgttcttcagatttgactgggtaaatattccctcaggttatttcctgacacagctgattaataacagatatgtcctgtgaaagaagaaccaaaagacattaacgaatactaaccaaaagccacattaatattgctccatggtgttgtagtcgcagttagaacgcccatctcgtcatccagtgtgttggataggttggctgactctcccactcacatcttggctctttcaaggaggaggaggttttagcagagtcccccaccccaagaggcatctgagtctaagccaagggagcatattattctcttattttaaacctctccgtaggcagcaacattatattaggttttccctttaaaaaaaaaaaaaagtatcggctgggctcggtggctcacgcctgtaatcccagcacttcgggaggccgaggcaggcagatcacgaggtcaggagttcgaggccatcctggctaacacggtgaaaccccatctctactaaaaatacaaaaaattagccaggcgtgatggcgagcgactgtagtcccagctactcgggagtctgaggcaggagaatggcgtgaacctgggaggcggagcttgcagcgagccgagatcgcgccactgtcctccagcctgggtgacagagcaagactcggtctcaaaaaaaaaaaaaaaaaaaaaaaaaaaggaaataaaaaagtatctttggtggtttccttccccttgcaacaatctcacctttttccttttatcattaattttaagccaaacctcttccccagctacacacacacaccacacaatgcagacagtccccaacttgtgaagtttcaacttaacaattttttgatttcacagtgatgcaaagtgatatgcattcaatagaaactctacttctagatttgaattttgatcttttccgaggctagtaatatgcggtatgatactctctccccttgctgggcagcagcactgaacctcagctcccagtcagccacaagatcatgaggctaaacaactgacactttactgtgtaaggtgttgctagacagttttgcccaactgtaggccgatgtaagtgttgggagcacattgaaggtaggctaggctaagctgtgagtttcagttagttaggtgtattaaatgcatttgtgacttaagatattttcaacctatgatggggttgtgtgatagcttcaattaggcaaggcacaaggaaggagtaatccattccattgatccttgtggaatgcttgtgcttaagtaccaactaatagccatagtatcttattttggaatattaccagcctttgaaactcttaattgtagccccagttcagggactactaggtctggcatcaaaaaagaaacctgtagtgacatagggaatacctgtaagtgccccacttgaattatctttttaattgtaactggtctcacaggtgtagcccatttctcaaaaatgatagttgcttcagctttttggttgggactccacctgcaggccagagagggtgaagcccagtggaaagaaattctgaacttaacattagcttttgccaacccagccaaggaattggattttttttagcagccttgccatcagtttgcaattgcctcctaatccattttgttagctccttaggttcaagttctctcacttccagattccactagaaagttacaccatcagtaaccaatttcaaagcctgtgttacttttcaaccaagcgtagcttgttgagcaacttcaaaggttctttttcatcccttttatcagaatcttctttttttctttctaaataatgcctcagtcatacttttagctaagaatgagttggaggtgttctaaacaatcttgcttctgacactcactgccctgacagtggaagttaaacagggttcaattgctaaagaggactcacaggaaccaaatgacagtgcttacgaatctagagttccttgcagaaaaaggatgcaatatacccacaacattaaaacaagaataagtgtcacagccacagcctgcctcacagcatagggtccagagaggacaggtgcaagctataattgccctctgtctacaagagccacaccacgatgcattttctctcttggaacaagagctactgatgtgagcacagaacaccttggaaaccagggagcacaaattggagtttcagccagggtttcttatatcccgtgggtaacctaggcatactgttcctatgtaaccagcctcaaactcagtggcttccgttggtctgactgtgcccgggtaaaaatggtcaatgttactgttagcaataaacaatggtgataacctgcaacccatggctacacttcaacacagtaagtcactttgaaaagcaagtgctttgaccagggctctgcactgtgtagatattttagcaagtcatctcgtgccaactccagcctctctggaattaacccttactgcacagacaactacatcaaagtgcattgactttcttgaagtgcaaagatttgcttgggaggtccctcagccataagtgtaagttgcctgtagagtggcatgcctgggcaagaaaaatcagcaaacatacagcagttcttccaccattactcacctctttctgtttctgtgctaattagatcacagaattatttatacatcaacatagaatatacagattgacctataggatgaacttggggttatatgggcaccatgagactttttttttctccactaaccaactttttggtgcttctgttttatcctactgttgtcattagcatggaatgcagaatggttttcctgttctgtaaagtcagtaaggacaccttctgccacccacttttcccccttacaatatgtacctccatgagaaatcagaaaacctggatatcctgccataacacccagagtgagtctccatatactctggtctcagttgtctcaactgcaaaatgattttaaagcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagtgggatccctgtgttgaagtcctgcctgctcgccgccccccacccgccactgtctgcttttcctgcacagcatagaggatcctggagagtcagccatttcttttatcctgtccccaccctctctcacccccacagccctcatgcataggtaccaccacatggtccctgttcttcaatggcttcaaagcctatagcatcctctactgtaaacataatttagaaagtgaagatgtattagaatacttgggtttttatgtagctttaaagatatatctactagtgaatacacacaaacacacacacacacacacacacatacacacatatatatatatatatatatatataatatatttaatggaaattcctagcttaaggaaacaatggttcacacaactgtatctgctggttgcttattgagggtcctagaaagagctaatcattacatttaatgtttcatcaaaaagtctaggtgtgttctctaagatgctcattttgaaaagcatatgcatggcaattaaattgtccctattgatattctcacctccttttcgggtccatagcatggattgtgtatacctaaatggaaattttttcaaaatagctccatgaaagttgaattctgtttgacatgtttgtttagggaaatgtgctcttcagtcttctgtgatggattgttcttgtgtttaaccacatccagttttagcagagcacactgcacagtatttctctcctaactgtgtcatcttctgctcctgtaatttcagagcaattgctttgctcccctctggagctatttctactcaacatttgctgttctatgtgttacccattcacctgtacagagataagagcaggccccataaaatgaaatgcatgcagtttttctctgttcatttccatcacacggctaaataagactcttaatacaaaagtgattcgaaaaattttcactagttacttcttaaatgcctggatcagaggcaaaatatttatgatgactaaagcagagtaacaaaaaagaaaataattgaaaaacttcaaaccacccatagcttccttcagtatataaggaaacatgttgggaatattggtgtttggaagaaatccattcctctcttccagtaatggagctggcataccgtgtttctaagtgttcctactacgtgcacttgagtatgtgccctctgaggaaaacaagcacacagaagagagagagaagaaaagtttgagtcttttgtctctggacctcgctccagcctcccacgcagtcttctttcagccattccctcctcacgtcctcccgtcctcctgcctccttgcattgctttttaaaattctttattatttttctcacttgattcttcagataagtctcccaagttatcttccttcctcccactttaaagaaagtctcagcttccatgaaaagggtcatttctctatctttagagtatttcagagcaaaaacagaggggccttcccttccaagggaggagtgcagactcctgcttccaccaccatgtctgtttcatgcttctggggaaactccaggattttctgttttcctttttttaaaagagaaaaatgtgtgcgcaatataggtggaaaagtatttttgcacaaacctacataggtattaaccactatttttgtttttttcttaatatttaattagaactggccatgaataacttgtaaaatatactaaagccttaagtttgcatttctttattactgggaaaggtgtttactgagcgggatttacctctatttatgtgaactacatttataattgaattgccccttccccctagatgcatgagagatttacttaattagcattgattccttgcctcaaaggactgagaattccaaccagagcttaggtgtataaggtagtataaaagcaatgttgttgtgtttctagtttggctaataaattggctttagagaaatgcatcttttcatgacacttgggaataaagcttgtgatttgctgatgttggacaaggttgaagtttcacttttgttaaatttttgtccccagcataagattaaacacctcctcagatcaagggaattttcctccctcagccttataaagttgttagaggacttagaaagaatattatgaaatacaatttgaaggtgaaaggagaaataagcgagcctcaggtctgaaaactggatagattatgcaattactttagtttgcctatagaaaattttagtggagagtatttttttcacctaatattagggtagcagagagatgctgaggtgactgatatttcaaggagaaaagcgcttaatgattataaatgcatagctagaaatagagtttacacaaccttagccatacagattaatctaacagatcttctctaatgctaatacaagaaagtatcatcggatctctttaaaaatttctgctaaaacattttttttttcttattcaggtgacaattgactctgtttatgtagaacaggctaggtccccttaactctcagatattccccagtaatccaaggatgggaattatatctttgcccatatcttcacccaatgccagtgagatttaagaacaacttcagatcctgaatactgatcaaactcatcaacttagagtcgaggcataaaaataaaacacctttcaaagagagtgtggttcacgtttggtgtttattaaagggtatgagagagtcctagctaggattctcagaggaaaaaggacactgaaaggaaggttttactctttgagtcatttgtgattttatttgttttttgcagtggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgtacgtatggcatgtttttatttcccgggctctgtcacaggaggcttagcgtacagaatggtgaagtgtaattagcattacaacagggccctggaagctgtggacctaatgctcttcctgtgataaatcatttttgcatttatgacttgaaaaatattttgataagctaggagttaagagccagaatgtagattgctctcagattagaaaacaaacaaaaccctgagacactcattttgcaaatagtggaatgagtcgacatatagcctttggttctttccctttctcgcccatggattttggaattcttccatgcacttcaggggtggcttcctctcactggcggccatggctgtgctcctggagatactggcacacctgtctccagatcagaatggtcttagctgatacttaggacacttttgcagaagattatgaattgataggccaaacaaaatgaaaacaagcccttaatacagcaaacttagcttctcaaactgagaacatttttcgttttcttttgttttttaataagattttatgaagtttcagtttggcgcctccattcatcactctctcttagagaacaattgtttgttttggattgcacacaagggagatatccccagttctgatttttttttttcttgagcttaatgaagacaattgaagaagggagcagaaggaattggtcttaattttgcctaaattcttcttagatctcaaaattattacatgcctcatttcaccaatcaagaacatactcccatttggaaatctgggaaggttttctgaaaagagttgcaaaacaactgttttgccttttacctttgttgtagacttctactaccttttgaactaaaatttatacctttttttctttcttattttgataaggtattgctttttaaaatttcaggaccacctgactattacattcatcatagtcatctaccaagtccttgaacatgtcggatttcaattgtgaactacgttcacattagttttgataagagtttgtattcaggtttcccctcaaatatattttggcactgttttctttgcagatgacatgtgaatgcattctgaatgtataacttccttctacctgactgaaaagtatttggtgacaattttaactccttgaaggcctgagttgctgtataaagtggatttgttaaattttgatctaccttttcttaagagggagaaagataagaaaattttccagtgataggaatttggttagtccattagtgcccaggatttctttttgactgagggatttaataaattttagcagctggaagttgagcatattgttcaccgaaaataaccgccattgggacctatcctttgtgattttgaagtgctaataggcgaattattctgaaatattttctcctttttctttttaccaatatctaagggccagtagctttccgtaataaaataagaagccaaaaaactattgaaagacactttttaactttaattttaggtttcggggtattatgtgaaggtctgttacataggtaaactcacgtcacgggggtttgttgtacagattatttcatcactcaggtattaacccatttatgcctagtgttccattattggaacactaagcttgtgggaattattcctatcctactgctcaaggtcatcgccaaggtctgattttcacaaaaagtaatatgcagcctccagcataaatgggttaagcgcagtacccaacagttgtcttttctgctcctctccctccttccaccctccaccctcaagaccccagtatctgttgttcccttgtgttcgtgagctctcatcatttagcttccacttagaagtgagaacatgcagtatttacttttctgtttctgcattagtttgctaaggataatagtctccagctaatccgtgttcaaaagacatgatctcattcttttttatagctgcatggtattccatagtgtatatgtaccatatttctcattgatgggcattcatattgattccatgtcttgaaagacattttctacaaaatggaaaacttttcattcttatttttcctttttttcccccatggataaaattagcttattaataaatttgttatgtgaaatgctttatttcagttttctatatgcaaatatagaaaatgctatgcaaataaaagcaatctatattaaaacactgatatagcaacaggttatttataaatttattttttagatcatatatttgaatgttgtttaatagagtatgatatttttcttacggagataaacatttatattctatattatgtgttatgtggcctgaagtaattaattttctttcaataaggggcaatctgatgaagatctgagcatttaagagggctgagcagttagttgctggtaatttttttggcttccatgaccaaagtaggtaatttgctttagtaaccaaagtagattggtgaagattagtaattcttctgcttaccaacttaaaccaaggtggctttccataggtgaatagaatttttttttttcttaatttacgtagaacttttgcagttcaaataagggtttttaggaattgaaacttggtaaacattcagtggtcaagttggttgaacttccattgcattgtaggtcatcagtcaaagagataatgaatttggaaaagttcaaaacaatcttaataaaacagtggtcaatagagttcacacatcattgagcactttactcttttatttttccttttcaaggctttattcttaactagaagtgtttaccctctaggaaagggtcagtaattgttttctgctttgattcttcataataggggacgaacagggaggatccgtgtcctgtcttttaaaactggcatcatttccctgtgtaaagcacatttggaagacaagtacagatgtaagtcgtgtatactaatgctgtattcttttattaatgttggctaattaccctagttctagatgggaaatgacagactgttcttatttgacagcagattcctcatgtaagatgtagaactgcttttagagtgtcataaaatttggtttgtgccattccttgtcaaacattaaattgcaggcatttaagtagagaatgaggattagcttttccagtccaggtattattttacattacattgactgtgtctgaataaaacacatgttcctaggggataaagtctgattttctaacctctttctgtaagtcggaaaaataagtgtgaagatttaatctctgcacttgtctagtctttgggttcttatttaaagaataccatgtgacattcatgttcaagaaacattgtttattttataatcatcttactgcaagttgtactgacacatccaattccgtgacgtgactaacattttattatttgagagacagatagcttgctgtttcttaaaggatagatacgtaccaccctacagaatttccttttgattacgcattgggttcttctgcttaaaaactgtaaaaccaaattaaaagccaatgctagaggagtgatggttcagatgaccaagtgaccatccattcatattgtgaaaggctgcagttggttttccccttgaaatgcttataagcaatcttttcagtaggaatattaaacaaattcagcctagcttgtcttttctctcttcccctgaggcctagccacacatgtgaggagatgtgctaagcttcaggacaggcaggagataaaagccactctgtctcctactgatcatttctccttcaggagtaagccacaaaatacacaaaccattttggccctcacttttatgtagtttccacttgagttttctcatcctcagaacgagagaaaaataactgaacagcttttgttaaccattttaaaatgtatttcggatgagatgggatacctgtgtgcttttctcctttaaatattgtagttacttagtataggttaggttctaatctaccgtatatatggtatagtgacagcacattgtaaatataatattaaattgaataattgaggaagctttgagttggtgtttcgaataactactaagagggaacatgtttttaggttggtgaaacaaaaatattaaatgcaaaatgagatgtttgaaagtaactcataactttgaaaataaacacctaggtatgtatatcggagagcagataaaaagctgtgcgtacaatctcaatttttagtgccatcttaggtatcctgttaaaacatttaatttcctagagtttaaagtgtgcttatgggtacagaaagctttcttggatttactttttttgaggggcaacttctaggtgaatataaggtatgattaaaattttatatctgagaacaaaacataacattgcaagcattcagtatgttcattcattctgttacatatattgggcacctactatccaccgggtactgccattctactgtagatacttctggcacacaactgaccaagatatggttccttccctcaaggggatataagtctcctgccaaaaacgatagacacatattgaatcaatgccagcataacatgatgtgagctattaattagaaatacgcagccaggcgcagtagctcacacctgtaatcccagcacttagggaggccgaggtaggaggatcacttgaggtcaggagttcaagaccagcctggccatcatggtgaaacacgtctccagtaaaaatacaaaaattagctgggtgtgatggcatgtgcctgtaatcgcagctactcaggcggctgaggcaggagaatggcttgaacccgggaggcagaggttgcggtgagcagagatcgcaccactgcactgcagcctgggcgacagagcaagactccgtctcaaaaaacaacaacaacaacaacaaactatgcacagtatcctgtgggaacacatacatgatggactagaagctcagtgatcttatgactccataaagaagtcccaactgtggtacatttttgaatctctggtgtccaaggagggtggtgctttgggccagttatatgtctcttaatgctaaaacacttattttttgatgtagttacatcctatatacaataattcccaaggattatgttctggcttagaagaaatttaagtgtcgagggtacgtgtaagcttgcgcttcttgcagtgacacagtttatgtaaaagttatcacacttcatatatatacagtgatcattaacttgattcataaaaataataaatatccagattagcacaaattagaagtaaccccactctgtggaaatactggctactcttgagaattgctactggaattgagttggatgtcaggttctgctggcatccatgggtgctgtgttttgactgttgcaattttcttcttcctttgtagaccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgtaagttattcaccttctaggtaacatatttattctttcatattttagaaattaattaaaaaacccacagagcttcgttttctcatattagctcttcagtaggcagtaggtatgggatttgggatatttggaacctctgtaagtaagcagcttctggaactctaggttttgggaaagaagacagtgctgaggaaggaaaagaaatctccatctgcagcagggaccccacagttattgaggtgctagaggggaagaagttcagcaagggaggaaataagtctctagccacagaaatcctatgtatataagaaaatggcctttgtaggcgagtctcttagtctctgagtcctttctctaattctatcattatagcctcctttcaatggctgttggtaaattgttagcacagctgtccttttttttaaaactgtcctttgtagctttgacattcccctattattccaaagtctagaggtgtatactctctgctaatgtccatcactgactgaacacactcttgtccgttctctttcctatcctgtcccattgctttttctctgtcgtagtcagtgccccagaaacaccctcttcttcccaaatgcctgagcactccactggtagacattcatcttgttctaatttttttttctctttccttttttttttttttttcttttttgagtgcagtctcgctctgtcacccaggctggagtgcagtgagtgagatctctgctcactgcaacctccacctcccgggttcaagtgattctgctacctcagcctcccgagtagctgggattacaggcgcccaccgccaccccaagctaatttttgtatttttagtagagacagggtttcaccaggttggccaggctggtctcaaactcctgacctcaggtgatccacctgcctcgaactcccaaagtgctcggattacaggcgtaagccaccgtgcctggcctctaatttttattaggtagatagtgctacaatgaacatccttatcgtttagcttttgtctttgaagctttctttataggatcaattctcaggcgtgtgattgccagacaaaataatataaacattttttgtggcctttcttcaaaagttgttctaattgtaacgctatcagtattgaaggagtaagatgctttcggtatcacattattcacagtgttcttatgtttttgtttttggttttttcaagtgctaagagctgtttttcttatgtagggtttctcaatccattctaattctattaacaatggctgagatttacaaaatggaactagctgtagaactaactgggttatatctgaagtctttgaccacagactaggatgaaactatagaaggtttcctgggcagatcactgtgaatatttaggtgtttaaagcagtttgagtatttatttaatagttggacagatttaccggatgcacacataataagttcatttatgtaaagtgggatatactgtttgaattattttgccaaaattatggcaaattagttgtaaatgtaaaatgcatgtggagaaataaatatcttttcctcctcatacccaaaccttccaaaatgcagatagatgatcaatccaatcaatcatcaaaatgtagacacaagtaacttccatacaatgaatattaatggccacaggcaatctaggttcattttgattttttaaaatccaattataaaacaacttgccataaacgcgagttatttcctaatcttttggttgtgtgttttttttgttttgttttgttttgagatggagtctccctctgtcgcccaggctggagtgcaatggcgcgatctcggctcactgcaacctccgcctccctggttcaagcaattgtcatgcctcagcctcccgagtagctgggattacagggtgcctgccaccatgcctggctaattttttgtggagacagggtttcaccatgttggccaggctgagctcaaactcctgatctcaagcaatccacctgcctcggcctcccaaagtgctgggattacaggtcctaatcatttttcccctttagtcaagtctcagttactctttgagttctagtgaaacacacacacgtgttcatatatagggatatataaacatatgtgtgtgcattgtgacttgggttaaaggtaaggctcagtgatggtccctgctgcaaagtaaactaggctgtattcagggccagctggattctttgttttctcgcccgagtactgactcatcaggaagccaccaccatcctcactgcagcctctggccctcttggatttggttgtcaggataagcggtggccatacagaagctctgctttccctgggctgccccccttatcaggagaccaacctattccatttctgcctgctacatccttttgctggataacctcctactcccctaagcccatgtctctggtttggttacatttctgtctctgtaataacaactctgtattctcagtctcaaagctttgaattcagtccatccttgcatatttgttgaatgcctcctggttggccagccagtctccaagctctttgaaatgtgaaatgtgttttgttttgttttcagaaggggtctaacttcgtcacccaggctggagtgcagtggcacgatcacagctcattgcagcctcgacctctgggctcaagtgatcctcccacctcagcctcctgagtagctgggactacaggcatggaccgccacgcctggcatttttttggtgtatgtgtgtgtgtgtgcgtgtgtgtgtgtgtgtgtgtgtgtgtgtgtgtacagggtctctcgccatgttgcctaggctggtctcgagctcttgggctcaagctgtccacccacctcagcctcccaaaatgttgggagtacaggcgtgagccacggcatccagccttgaaatgttttctatgagactggggggaaatcagtcaagatatgaatggtggtaacaggtggcttttgattttctctgtactatttttattttctgagttttcttctttgaacatttataattagaaaaaaaattagtaaagtgctgcctctttttttagggaaagaaacatgttttgtttgattgctttccattgccattcttacattgtttccaggccttctcatcattgcactggcttcctagcaagcctccacttcacactccagtccttttcattggtcttattgccctcatactagttttagagaaaagcatttcccatatgatgccgtccttgaaaatgtcagtatctttctgttgtctagtgaacaaatcctaattcctctatttaactctcagacctttcctactctggtttcataaccacccatagtttgctttcactatcatgaaacagcttctccttaccatttgtacctattatgcttataaataatattgttaccattgctactaacaaaactttgttcacatgaattctctcatttaatcctcaccaagtctttgaggggaacagaatagtcaggctttggagattttgcttttattattgtttaagtggatgaataatttatttgcgcccttaaagtccctcagctggtggaagggtttgattcctagtccagtatgcccaccgccacatttactacctcattcccaaatatgtagtttctgatacttctgctctccagcttcccaaggccaaacaacagctacttttcctgagtcctggatagaataagaaaaggtataacaagacaggggacccttgagggggaagaggaattagtttgaagtgctggcaaatgtagtatttctaatcagatgctagtaaattccatatgtatggcgaggctttcattacttagatttggggagcctctcagcattttagcaatttgcaatcaggttgaatggatccattgtaaatacttaggaatacttaggaatccacgtcctggccctggcatgcttttcctcggccaggtgcactggcggtcaccttgcctttcattgtgccacgtgcataaaaatacaatgtttgctgtagggaaagataacaggagtgaaaatgtcctctgccctttgtttgaagtataggaccttcagaatgaggctgggctggttccttcagcaagcttgtgctcaaaggctgctatttctaccagcctgaggtaaacggtaataaagtacttgtttatcctacaagtgcattccttgcattgcagatttgatttcctttgatttcttgtcaccacctggaaaccttactttgtttcaggttggtacagttagaaaggtactgaatcttctgattcagacaagggcccagtagtggcaagaagagaggtacgtgtttgtgtgccacactctctggattatctattaaaggttttctcatatccctccccactaaccacttagaaaaggaaatcacctatcaggtctaaatgtaaaattttgcttatttaaaaatcactataggtcttccaaggaattatccattaagccaggaaatgaagtcacatccatggatatgaaaaaggaatagtcactgtaaatttatggctttgacagtggtatcttcgtagatactaaatgaggcaacaggatatgtttccacattaatagcatattgcagtcaacacatttactgggaaattgactcattttggtagtgatagaagtaaagttttgcaacgagtttttaagagatacagctgtaattaatatattgccagcttgttcctttctcatattccatggaaacagccctgttgagagattagattgatttttacgaccttagtaaggccaagcctgccctggcagtgagtcacatagactgcctgaaggaaccttgaggattttctgcacctctcctttttcagatgagaaaacaggcccacagtggcacaatgaatctagtctacatcgtgcaatttacatcatgttatggcttcaaccagttcggagactagattgaaatgacagagtgttaatgtgtcaatgtgatcccctatatgaattttagattgtaatagaatgagatagataaataaacacccctcccccaaaacacatacatgcacacacacccatctttattgaaaatactctaatcccaacatagctgtttagtctatcttcagataaaaccaagtatcacttttaggtgggaaaactatacagtcatgtgctgaagaatgacgttttggtcaatgacaggccatatatactatggtggtcccataagatcaacgtaagaagagattataatggaactgaaaaattcgcattactttgtgacactgtagccattgtaacatcatagcacgaagaattatttcacaaacctgcactgccagtcatttaacaggtaaaaaagtatgttttaaaatatttttaattattatggacacataatagtactcatttatgggttacatgtgatattttgatacaagcatacaatgtgtagggtaacacaatcagagtaattggggtgtccatcatctcaaacattcatcatttctctggtaggaacattcccatttcactcttttagttattttgaaatatacaataaattattgttgccatgcatggtagcacgcacctgtaggaccagcgtttcaggaggctgaggtgggaggatcacttgcgcccaggaattcaaggctgtaatgcacaacaattgcacctgtgaatagtcactacactccaacatggacagcatagtgagaccctatctgtaaaaagatttaaaaatatattgattactatagtggccttattgtgctaccaaacactagatcatatttcttcttactgtatttttgtacccattaaccatcccttttttatcccccgatcttcactacatttcccagactctggtagtcatgattttactctatctccatgagttcaatttttttttttttttttttttttagctcccacacatgagtgagaacatgggatacttgtctttctgtgtgtggctgatctcaacataacgtcttccggttccgtacatgttgctgcaaataatgggatttcattttttatggctgaataatattccattatgtgtttatagtacattttctttatgcattcatccactgatgggcgcttaggttgattctatatcttggctattgtgaacaatgctgcagtcaacatgggagtgcagatatctttttgtggtttcgattttgtagtatcttcttcagtaaacattttaaggactttattgtttagataacgtcaagtataccaactttatattcaatatgcttcacctatgagagctggagtgtcaaaatctgtttattttacatctgttttctgcctcctgttgtacttagtattccaaatgagtaagttgcttttccatctatcttctgaatttctctatttgtatgacaaaaatgaataccatctatgcacagttgttgtaataatgtagaatgatatgaaaatgagaataaattacagtctcaactgttgagaacaagtatttctctgtgttagaaacattcccaattctactcttttagttattttgaaatatacaatgtattattgttgccatgcatggtggcatgcccctgtagtcccagctactcaggagactgaggtgggaggatcagtaacacataaatgagaaagcattccagaatatctggagaagtgactggcagagtggttaagtgcataggctttgaaaccgaactgtgcctgagtccaaatctgagctctgctatttgctggctgtgtgactgtggacacatttcttaaccttcctggcccctgaactcctggaggtgattgtgaggattaaatgaaccaatagaagcaaagcacttaagagctgtagtggatacatagaaggtgcccagtgaatgttagctatgattatctaaagtgtgttgtggcatgaaaatatcctgccaatgttaacagttgcttttatctataacaaaacatcatctgtggattgcattttagagattctggagattctgtttctctgcaaatgttaaaatgccatatcaggagacttttggctggttagacagcattccccgggtcaactgattactttttttttttttttttttttttttttttgagacagagtctcgctctgttgccaggctggagtccagtggtgccatctcggcacactgcaacctccacctcccaggttcaagtgattcttctgcctcagcctcccaagtagctgggactacaggcacgtgccaccacgcccagctaatttttgtatttttaatagagaaggtttcaccatgttggccaggatggtctcaatctcttgaccttgtgatccgcccacctcagcctcccaaagtgctgggattacaggcatgagccatcgcacctggccgattccattttattaatagattttccatcctgaaagtaactcctaaaaaccctccttcacttaggtttcctttggctttttgtgtattaatcagactgtgggccctttggttccatagacattccttttacaccccttttggacggatgaatactcactagtaactaagtaattagtaagagttactacaatttggtatttataaagaggtggcctttcccagaattgaaggtagaccctaatagtccaatcagccttccatagagatagctggctgccatgaaaagctgagagatatcaccgacctcttactgggcctgctcatgaacagttagttaaaattcctgcaattttcagaaaagacccttatcagagtattatcagtattgtcttaagtttaatattggtttccagttgttatttttaaaaattttaagctaccgtgggttaagctttatgatgatctgtttaagtggtttgtttgattaacttctctattggagtaatggatgttttcttcaccagaattttgaagataggtttgtgttgtagttgaaacctgttttgtttatacacttactgctaaggaaaagcacatgtcattttgttttccatcttcatccttctaaagtagcacttcattgttatgaccaaatctttctttcttccttccttcctctcaccctgtcttttccttccttccttcctgccctccctcccgcctctcttcctttcctctcctctcctttcctttctttctttcttttctcttttctttcgttctctctctctccctccctccctctctctctccccttctccttccctccttccttcctttcttccttccgtttctatcacccctaaaattccatcatgctgtatcatctcactaagtcccaatctctggaaaccacagctctgttttctgttcctataattttgccttttcctgaactggattttaaaggattgtaggaggcagtagtggaagagctaactttatatcttgttcttttacataatgcgccctgatccacacttgggaaagtatattccatggtacctatagacagatatatgtgctttaccatgtatatgtgaaacttttctaatttaactttcctgttaaattagaactcggtagcataaattaatactgttgagtatacttagggatttgcatagatttaaaattgtgcatatgttccctagggccatggcgttaattggtttattagtcaggtggagtgcagagcctgaggtcaggacagttgtccttgaacatggaaatgaagagtggataatcaccatgtgttattgtttgggctgattttatctttaatgggtgattcagagtcctgattaatatttagagcagtgactgctggcctcctacctgctcattatcttcagaactttaaataaaatacttgatttctacccaagatggtagttatgggaagccttttacttcttcttgtctcacaaagacaactcttgacctctcaatccttaaacaaaaagttctgcttctgcgcatgtggggactcttaaactcattttcatgcctggagattcacatttagggatctaggaaaagcacatctaggcagagtcgatgaggagatgctttaagaaccgtgacaaggacaggaaggaaatcaattttgcgttaggtttgtatttttagagaaaacgaatcctggggaacttttcacactcattactattgacattaataccattgtcctgtccctttcacagttactaaaatcactcttgcccaccctcctgccttgcccacaacctattcccatgaaggggtgacttgggagaaataacggtttccaaccaacgttttattttggaaacatttcaagcacaaagagtagttgaaaggatagtctaaagaacactcatctgtgtcatacatctgttcaatccatggttgcttttcgctctacttacctcctccaccctctcagctctgtttatgtatgtgtctgtctgtgtacatacacacacaaacacattttcccctatgccatttaaaagtaaaggagcatcacaacataaacccctaaacacttcaccatacaccattttcttaaaggatgacattctctaacataactgcaatgctatcgttacacacaaatttaacagcaatccagcaataccctctgatatgcagtccacactgaactttccccagtgccccagaattgttccttatagccactgttttcttccagcatctagtcaaggtttttgtctgtcatgtctctgtaccttcatttagttttgaacagtctcccagcattttgttttcctttcatgacattgacttttttggtagggggacagagtctcgctctgtcacccaggctggagtgcagtggcgcgatctcggctcactgcaacctctgcttcccgagttcatgtgactctccacctcagcctcaggagtagctgggattacaggcatgcaccaccacacccggctgatttttgtatttttagtagagacagggtttcaccacgttggccaggctggtcttgaactcctgacctcaggtgatccacctgcctcggcctcccaaagtactggaattacaggtatcagccaccacgccgggctgacgttgacatttttgaagagttcagaccagttctcttgaagaatgtcccatactctgggcttttctgatggtttccttgtgattagattaatgttaacattttttggccaaaagacgataagatgatgctctgtacctaccactgtatcacaatctggaggaacaaaataacattttgttcctattggtatcactaagaatgttaaggtggtgtctacaagatactttccttgtaaaatatccttttccctttgtaatgagaaagtaattttttgatattttgacatattataatatccattccttaaccttttaccctatggttttagcatttatggatgatccttgtctaattcagttataatattggtggttgcataatggtggctttctaattctaccatactttctgcatgtattagaccattttcttatgtaaagaagagcttctacctctcccccgtctattcatgaatatcactgtggacatccaaggtggttctgagtgtacaaagaatgatatctctctttactgaactgccattggatactatttttgtcttggaattgtttaaaatggcagtgtatggaattgaaagtcctttctccagagagccacataaacagatgtctaataaatacatttccatattaaccaatccttttatgggaacaacacattgacataattaaaacacgtaacatgaaaactgtgctgaattgagaagctcatagagttttgtttcttttttttcctttttgccacttcaatatatatggacccgcacctgtcaatccaggtagctcatacatgccgtagcatctaatggtacgagggacatgtaatgctgaaaagaagggggaaaggagttgatcagatgagatataagtatgcatttatcagtgttgtggggtattcacttgcaccttccattggctctcgcagccatgttatcggcatataattcagttgaagatttatattcacctggaaattgtcctaagtgggccttgcttacttagctatcagactctagtactttcaaacaaattaaagattcaaaagattttggggatcgccttgctttttcccataggaaatcacttttgtcctgtctttttaagactattttaagcatatatttcagtattaaaatcgtagataatcttaagctgtttccttaacctctttgggccttttcttatctgtaacgtaaagttaaaacaggttatctcaaaagttacttatccctaagtgtctttgattctatgctaaatgttataaaggccgaaagggaaatggattattgtacttatttcaaagcttggccatgatcagcaaagtcttacctgatcttccgggtaacaactcttgtatcagagctgtaagatatagaaaacagtcttgtacatagagtgtggcatttcacatgagaccaagtgttctctgaatggaaacacacactaagagcaagatgtgaaaaaccattgtgtacaacctcatgtaaatgatcccttgcgtccgtacactatagtttcctcagtaactcaaaggtaaaacccaagtatcttgtgtctaagaggatcaaaatgtcaccttccttctgttttatttgttacctgcaggttttgtatagttttatagagtctttttatcactcatttgattttcataaaaattgggattgtttggaagaagagtcattaatattctttacagcttgttcttgttcctccttttatgttctctgctggtgcagacttctctcttatgtaaaatattccactgatgcccttggtagatttagaggttgttaaagaaattgtaataacagatcagggaacagtcagggactgcctgtcctatactgtctgaccctgactaaccgttctccttgtagttttaaatctttgtgtacagactgtaattcaaaaaacagtttttataaatttaaattcagcaaatctttccaaatgctaaggctttttataacgagggctagaaaagttgagttgtcagctattaatgccaatacctattaacaatggcaatgacattgaaatgattttttggatttatgaagggaacatgttactaatgaaaatagcaaatgaaaatggccactgtattagtccgttttcacgctgctgataaagacatacctgagatggggcaatttacaaaagagagagggtcattggacttaacagttccacgtggctggggaggcctcacaatcatggcagaaggcaaggaggagcaagtcacaacttacctggatggcagcaggcaaaaaaagagcttgtgcagagaaactcccgtttttaaaaccatcagatagtgtgagactcattcactatcacgagaacggcgcaggaaagaccaacccccataagtcaatcacctcccaccaggctcctcccacgacatgtgggaattgtgggagttataattcaagatgagatttgggtggggacacagccaaaccatatcagccacaaaggagagattaccctttttaaaaatctgtggtttgcccacaatgttttccataaatttacctttttctgtcaataaaaatgtttaggaattctatttatggatatgtatgtatttaatatttgcatatttagttcttattttttctctaaatggttatgacctgtactaagtaaaatcaaaacacacacacacacacacacacatacacattgtactagcagacctgctttaccttgcttgggataattatctgccatgattaaataaataaatttctgcaactgtttatcctggaatacactgcatagagttgtcagtttgagaagcaacttgatttcaaatctgagtctacaattttagcgtgtttccttgtgacttctagtttggggcttttaatttcccttttgctctctctaccctcagtttatgaacgagtgtggcatttcggcagttgaataggcctatggtagcctcccagtttctgtgttgtagaggatagttgccggcttattaaatgcccttgcaggactctcagggaagtctgttgtttagtgaatagtgatgaatcaatgtggatttcttagttttgacaagtgaaccatatggttatgtaagatgttaacattggggcagggtttctcaaccttggtgctactgatgctttggcccgaatcattctagttctttgttgtgggaagctgccctgtgtgctgctggatgttttgcagaatcctggcctctatctactaaatgctagtagcacttctaaccgccaataccccccccccgcccagttgtgacaaccaaaaatgtctcccgtaaaagataccaggatgaaatcactttttgtcagtcccaaactaactagagccagggcagcatgaaaggaggagggttcatggttacatgcctgagataaagactgtctcaaggactttctaaaatcgccccacaagaaattcctctgttaggactgcagcagtgcacgtaatatgctctcaaaagaacatctgcccagtaatggcatccccactaataaactgacaccagttctggcgttgagcatctgaaacgaactatgtttccaagcagcttatgtaaacttctgtttttaccaataaaagtttccctctacagtctcctcttcagatgcatcttgggttgtaatcctcatttctaattccaaaataaatttaacatatttggcgatgtttttctctgatgttttttggtcgacactccaaacattgttatatttcctctggggtacggcatcatttccggttgagaaccaccgacctagagaaaagctatctgcctgtgcagttcctttcaagggccccaagtgtgaattttgtgtatacctatattttaagccagatcattctgtacataccttctaagtccagatgaagtctgttagccttttatgtgtgataccatcacatagaaaccaacacaaggacatttactgtaatcgataaaggaaattttggacagtttgagaaagtaacttattttgtcttctgctctttataaaatctttacaagtgtatgtttttgctcttcaggatgactaggcagctttttaaaattctgacttcatacagattttataatcttccttttatttcttgcgatcatattgcagttgaattcccacccactgttcaattcagcagattttaacagagactccagaagtatagttcctgtctttaattaatctgcaatttaggaaagaaattaaggaggtatcgttctgtattgtttccaggatggtggtttcttgttatctgagaattactgggcacagtctcttgcccaatgtttacttctctatatagagttgacccttgaaaaacatagatttgaactgtgtgggtccacttataagtggatcgttttcaaccaaatgcgtatcgaaaatgcagtactcaagagatgtgaaacctgcggatatgcgttcagctgggcctactgtgggacttgcgtatgcgtggattttgctgtatctcaacagcaaaatccccgtgggagtggggctgcggcgggccaggaagcaacccctagcatatactgagggatgactgtactaattattgtagtttattaagtgttcacatggttttcacaaacctcacaattgaaatgccaattgccttctcctaaaaaatacaatgtacgtgttcatggtagctgggatgcagggcttgctgagaaatacttaattgcatttcttctgtagccatgaattgattttattaccttgagagaaaaatgagtattcaggtggacctcctggcaggcggttggcccttcagtgtccaaggatttatagaaagcacaacatcaaagaaatccaaaagttcttcggaaccccagcaactctcctacctccaaacttgccatgtaatgcccttttaaacttattatattgataggtaaatcggtttgctagaaattccagatattgagaattctttgtctgtgtaccttgttatatttgtataaaggtgatatttgtatgaagccaccctccagtgtgctgtaacagagcaatagtaatgacaactgattccttcccctagcttttctgttatggatagttgctggcaggtgaggaccaacagaaaaagaggagaaacccaacataattccaaactgtgaccatcataatggaaggagctgtgatagctttgctttctgtgtgtgcatgacatagaaggggaaaatggagttattgccaaaacaacagcaaaagcaaaacaaagccaacaaacaaaacaaaacccagggctaaatgacctttccaagagattttgcttgcatggcttgaaactggtgtttagagatgaggacaaggtcacccttgatactgagaggggattatatctgagacttatatgtatctcaacaaataatggtacttacaaagattatctcagtccagtgaatgccatcatacttatcttttgaccttaataacttcctgctattccaatctatccctatatatttttttctggaatgatcgaaatgtaattttagctgggtttaattctagttctgttaggtctttacagaagcttgcctggcttttaattctttccttcttcattgccagacaaaaggagagggaatataccactaggatacagagtagtttgtcataaaaatgaaagattgaaacagaatgagaacgtgaatccccgtaccttgtcttcagtctgtcagttggcgtaggtgagcagttttaaaagagccaacatgatggatcttgcatcttaggggctagaaatttgagaatgttcaacctttaagcatagaagaatctatagttttttgaaagagtagaacattctacagcctcccttggtaattcacactaatgctttaacaactttcagcatcaggaaattcttccatatgagctacagcctaaattcttcatgctgcttaagtctgtttcttcttgttctgtcctcagtggagagatcgaacagctggtcacaggcccctatgcgagagccattcacataattgaaaactgttattaaatcgccccttcagaagtcactcttgcttgttctctctctctctctctctctctctctctctctctctctctctctctctctctctctctctctctctctctgagaatctgggaagattccagagctgattaacatgttgctttactgatgaccttctcagcttttaatatgttaacgtgctctaagaattttaagaggcagatataatgtgcactgtttctttcattaatttgaccttctcgtgaagcattttgctggacgattgatctgctggacatactgggaaacactgactcagagattttagttgagtaggaaccgtgtgtgagcctacggtacagaacaaaagaaagtaatccagttacactgtctggagaaatagaggtacattctccgcaatcatatttgaagaatagttttctaaatgacaatggcaaactaagccgtgtcatatgaagaagaagtaaaaagaataggaatgaagaggcatggacagataagacagctctggtaaaatatttaaagggctgttcaaagaccaagaacttctgggttgctggtcagatggataataataatgacaataacaatagcaaacatgattcttgctatgtgtcagacacggttccaattgcctttcatttgctgactcacgtaatcataaaataactctatgaggtaggcactattaatatttccagtttgtagcagagaaaaagtaagacacagagagataaagttattttcctaaggtcacacagccagtgagtggtgaactccagtggtttaactctggaacttctatatgctgtgctgatggatttcagctcaatgtgatgcagcacttttgacaggggtatctggacacaggtgttcaggatcaccttctaaggatgtttcccagctctctcacatgggtggtgtagtggctgtaagcacacactggcatgggtaagagtttggactcgatgaatgctgagtttggactcagtgaatcctgaaagtcttacagctctgtggtgccatgccaaaaggatgaatggacttgcatgatctttttcatttttagattgcataattctttataaacttttttttccacaaagtacctctgtgatggaactctacacagagaaaagtgctcagcaacagctttttaaaatttaacttgtaagttcaggggtacctgtctaggtttcttatgaggtaaacttgtgtcatgggggtttgttgtacagattattttgtcacccaagtattaagcctaatacccattagttattttcctgatcttctccctcctcccaccctccatcctctgataagccacagtgtgtgtttttcccctctatctgcccatgtgttctcatcatttaactcccacttataagtgaaaacatgcaatacttggttttctgttcctgcattagtttgctaaggataatggcctccagctccatccatgttcctgcaaagaacatgatctcattcttttttctggctccggagtattccagggtgtatatgtaccacgttttctttattcagtcttccattggtgggcatttagattgattctaggtctttggtaaacagtagcatttgatcggaagtttgaactgataccattttgcagctaggaaatccaaagttaaacagtttattatagtgttgctaaatttagaattaggggtaatgactggagtgctgttgaggtgatcagtgttataagccaaatgacctgtcagtctaaaccctcctgcctttctatctgaaatgtggatatgtcctttattaggaaaccacattacaagagaagcaacttggctttgcagctcaaatacccatgacttgtgtgatactaagtattcccatgtcatatattcaactgaaattggctgtggaataagtaatgcttcttggttcttggcaaaagcaaaggagaatcatctctggagaaagcacttttattctaggctcaagcttttatttatctctagaaaatattggtaaggtcagtttagtacgtggtaaaaaaaaaaaacaaaaaacatattaagcacacaagaaatcaaggtggaaaaagaaagaaatcaaggtgaatgagaaccagaagaaatagcaaaccatagaagcagacctacgataacatcatattccagaattattagacagattattttcttaattgtgtttatgcagttagaaaaataaaaaacaacattgaaaaatatctacagggaaccacaaacctgagaagttaccttaaaaatgaccaagtagtatttctagatgtcaaaagtacaataatcaaaatttaaaactgtatgggtttacagcagaccggcaagagaaatggatacccagacagtaaggcagaaggaattaataagaatgaagcacagaaggatgttttaaaaagatgtggggcagagaggggggaactagggaagtcctgttcagagaaatatagattgaagaagagtaacatttatgtaacagagttctgaaagtagaatggagagggaatggagaagaggcactatttgttgagagaatgacggagaagattccacagctgattaaagactctaaatcacaggtttaagaagtccagtgaatcctaagcagtctaaatcaaatcctagaaacagcacaagatagaaaacagatagattatctttattttttttattttatttttattatactttaagttttagggtacatgtgcacaatgtgcaggttagttacatatgtatacatgtgccatgctggtgtgctgcacccactaactcgtcatctagcattaggtatatctcctaatgctatccctcccccctccccccaccccacaacagtccccagagtgtgatgttccccttcctatgtccatgtgttctcattgttccattcccacctatgagtgagaacatgcggtgtttggttttttgtccttgcgatagtttactgagaatgatgatttccaatttcatccatgtccctacaaaggacatgaactcatccttttttatggctgcatagtattccatggtgtatatgtgccacattttcttaatccagtctatcattgttgggcatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttgcaaaggagcaacagtcatctttactattgacttctcagcagcaacagagatagacgaaagtggagtaatatttcagtattcaaaaacaaaataaaaacaagaccccaaaacctttcaatcaaaaattttatacttgggccaggcgcagtggctcacgcctgttatcccagcactttgggaggccgaggcgggtggatcattttaagtcaggagttcgagacctgcctagtcaacatggtgaaaccccatctctactaaaaatacaaaaagtagccgggtggggtggcgtgtgcccatggtcccagctacttgggaggctgaggcatgagaatcacttgaacccaggaggcggagattgcaggagccgagatcacgccactgcactccagcctgggcaatagagatagagtcagtctcaaaaaaaaaaaaaattgtatttaatgaagataactatcaggaatatggattttttttttaaaaaaaggaggtattttcagacaaacagagcttgagaaatgcaccaccaacagctaaaggaaattctaagggacatatttcaggcagaactaatcccagatggaagatttgagatgaaagaaagcaatgaagagcaaaaaagtagtcaatatataggtcaatctatctaataatataaaaaattaaaacaatcctatagggttgaaaaaaacaaggtataattaaaattcatgaatatagtaacatataaatcaaatggtggtattttgagattgttgagatcattgtcctgtctgggatgaattgtatttcttacatttagactttgaaagagagagaaatagagaggcagacagaatcaacagggcatcatgaaaacagcgctaagccaggaggtttggattctattatcagctctgctgctagctgtatggcctttgaaaagctccttttctggtctacaaaatcagtttgcttgtctgttagatgaggctttggaaccagatgaattttaaagcccctcattatgattctatgagaaacagattctctagaaaaaaaaatcagttgtccccctcctttgaaattttatcagtaaacacctgcatttcacttctggctaacttttatgtatcagttcaaaaattaaagctaaataaagtctcgctcaggtgtgtagtttgcttacctttctcgtttgttggttttgttttcttttcttgtcatctagtagccaaaaagagtaatggcagtttaccaaagccttaggagtgggtagctctttggatatcagggagcatttgcagaaacaagctgtgaaaagccagcctagctttgcaaccattgttctttctatcttttctgtttaacttattaatcgaactgatatacacctcctttgccatcttgccttctttcctttcatccttttgccctccttctctctccctcctgtctttgcaggctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtattaggaaccaaaaaaaaaaatgtcatttttttctcatcatttttcacctttttatgacttgatcttttatctcctgtgccagttgctgttagttcgtaccgtctccaaagtgggagagaaggtgattgggctggaacatcgatcattcctgtcaccctcctgatcgctaggttattttggtggatctcacttattaggctggtgtcccttaccaccttcactcttcagctcttcggagccacatttttggttgagcaggccaaagtgcgtgtcttcacggaggtattacagatgaactgtacctcctccttcctggaaccaaaacatttttaccatctttcctttttcacggtctttcctgtttatagaaacttcccaagaatcagttataaaactgagagatgattctattctgggaggaaccataatagtagctcagtctctcattcactttgcaccatttttttttctcccttaagtaacaagaattgttttcagcatcttagaacttgcttctttatctgtgaatctgattacattctttgtatagtatcccagtgaacttctaaaggaataaaaagtaggcaagtaaatggaagattcacaaagcagctaaaaaacaaccagtccttatacatttagaagtgaaagagataggaaacgtagcaggttattctgatagtcttaaaatatcatggaaaacaaggccaaataaatctttagccctgctgacctgtttggggagacaggatttttttttaaatgaattaatctcacttaacattaatcctaaatcctaattctgaaactgcgatgtccttaaatgtgtgaatcaacatcaaggtttctatagtgatgaataagccacaaagttgtaaactagctctatggtctatgcctgtgcagaatccacttagcagcaaagtaaacactcttttccagttacgtgtgaactggttttgttactttattttctaataactaccttgtactgttgcgtgctttttattcatagtgcttttttacttttggtgtttattgttccatagtcatgctgtttacaaagaggttttacaaaaacttttagaggtttctgaagcctagatagacaacagtgagtaggtactgcttgcaaaggtcaccttctttccttcccggtttcttggcaggtaaaaatgataccatgggggtggggagtggggaagggaagccacagtgactgcattagatttctaagctaccttttctctgcttccttagctagtgggctttgtatacaagggaaatttttataaaataaagaagaagaatgccttggaggatctgaaagagcactttcaccttcaattcttttgcccttatcatattatattattttaggacccagcacttctcattcctcctgtccccctcttgaaagatggctggaatctaaaaaagatagctttccttcccacttccccatatgtgacataagaaatatgtttatttgaattggctaaggttcttatctgagaaagcaaaaggcaggagagtatgaaacaaagaatatcgcattctgataatggaggaaatgtaccaactagtatttacagattataaattcttccatctaatccaaatttcatgttctcttggggcttcagttatcatttgtaggtaatggggtgagagatttctgaagagatagagataaaagagttcattcgagtaactgtttgaagatgaatcgtatcagtcaattagaaaacattattaaagcgagacttgttttaattgaaagttcttgttcacatttcttttgtcttgtgaaattgctttatcttgacaatgttttgaaaataattgcttcagaaaacttttgtcccatgatgggtaaggggcatgcacagcgtaagtctgtcgctcctggaagttcttttaaatttgagtatttggttttcaaaagactggaaattttccagtaccttcctacttaatctcaaagagttcctagtggagtttaaataaaagctgagtttttcttccctccttccatatgtttataggataatctttctgccaaaatgttttggtactgtaggagaggcaccggaaaaatctggaggcagaaagttaatcacttaccttgtgggactaatgaacattgctttctgtttctcaaattagaacgtggtagaaggtttattaaagagtgttctttgggaatttgattcgaagaaatacatacgtgtttgtttttgctctttatcaggtacaggagtctaaagcactttaattatgacatctgccaaagctgctttttttctggtcgagttgcaaaaggccataaaatgcactatcccatggtggaatattgcactccggtaagtttgacgccagcctgacgtgagagttagttcacctgggataaatttcagttttgtacaatactgcagatcatgtataatgctgtgatttgtcacttccccagatgttccccagctaaagtggctctcaactgtaggcttcaggatttaccctatccctggtgcctaggggagtgcctggcacatatggaacatgatagaccctcaataaatattgttggatgaataaatagggttttcattctgtgtgcatggttgtattgaagacgttttcacgttcattttgcacagccttagaggttgtgtggggcgatcttatggccatgaggcatgttgagtatgggggatggttctaggttcccccaaattcataaactaccacttttaatcaatgttgctcacctattatctgtcctgtatactagtgacattttaaaaatccattttatatgctaacacttactaaatgctaggcatttaccttttaaactaccctgtgtaaaataagtactatgatttttatcccctctatacagatgaggaccctgaggtcctgaggttaaataatttactcaaggttctataagtaagagttgaagccatctcctaagatgttattttaggaaaatgttaagtggccaatagaactgtgaaaaatcactagggaaatggcaaggatgtagacttggtggccagacagacctgagtacaaatctgcctaagaattaaagacaggctcctctcaggtttgttttttctaaaataaacctgtccctgttgactgtagagccacccttcgtgtttctcttctctttctttaattcttacagtctcctcttctctaaactttgcatgcttgctattcaagatacggtctgttgactaatcatcatatgtctattggcattaccttggtctttattagaaatgtgaaaccacaggccccaactcctgatgctctaaatcaaaacccacattttagcgagatctgcagctggttcccatacacaacaaagtatgagaagctctgctttagagcatctctctcttccatcatcagagtgatcctcccagatatttgcctgtctcacttttattcctcttatagagatggtcagtgattgagaatgtaccatgctatgaatagaccgaaatttagtgggtgaagcatgctatcattttgtactaagtagtttttaaaataccataaagtgtggtaaaatttaatgtcacctttttgaccttaagacctataaactaccatttattgagtagcctagtaagcttgtatgtttcttttatttatcataacaacgtgttgaggtgttgttgctcccattttactgatgatcagagcctctgagaagtaaataactcagccaaattagtacatgccaggcctggtttcagagccccatttgtctgattccaaagcctttgctcacaaccacaacactctccttaattacaaaacaagtgtcatggggcagaagactggagtggtcattagttttgaaatcatcctgtcctaaatctgatctcaccatgatctcccttttagactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaaggggacgtcttcacctcttttcaacctgctcctcttttttgccttaactctgatggcagtcacacaactgtgtgtttttcttttaattcactttacaccttggtttggctattgctttccatggttcatacttaattggctggattttatttattttgacctttcagtaaatttttttgcggctgagtttgcgtgtgtctccttcaccacctcattttttgttttgcagtcccgttactctgatcaacttctggccagtagattctgcgtgagtactttttttgctgaagggtgctgctaccaccaacacattcgctcgcttggttctcttttgttctgtttatttgtttgttttcttttgttttgttttgttttatggacatattaattccccttccttcatttcagtttttttttttcttttcttgatgagactttgaaagtaccatctacacagatcaggagaatcagagtgggttttttggttcctccaccaggtgaaattcaaaccagcagaaatcctggcttgaattcaaattataatcaaagaagttattggagttttagctgtattcctgggagacatgtttatatatttcttcatataaaagcaaggaagaagcttctgattacataataacattctttagccatatttcttgagattcgatgctttttagaatctttagggtctgttataagtggactattaaaaatcagcagaattcgttttaaagtatgatgctgagtttggttgaataattttaatgaggtgtgcggactgtttatcaggttatgccatgctatttgactaatcattatatacaagggtttctaaattttgaactaaactcactttgctctcctctccaagctaaatattcagctcataaacaattatacatttgctctaggaggaaagtatttctttgttattactattggtgtgtattaataatactgaggttagataccagcagatgatttatctcagagtttataatgctagaaaactcttttttggggcctgtgatttctatattagcaaacaaagtgcctattttaaaactacattatgtagggttgttataacaaacttttggtatttcaaagtatgctttattaaaatatttattgaaaatcagacagctctgttatggataaaggggaaatgaccaattcggaagataagcttgtgtaagaattcaatttctttttattaaatcttttttattgtccaccagtataatttaatctaaactagatccttttttaaaaaccctgtcgtgataaatgcatattattaattgaggtttattttcagtctttaataggcctaaaggaagtggaaggctatgctttcctttttaaaacttcgttattgcgccccttaattttgagatatggtagctataagtagtatattatctgatttatttaatcatcatgcttaaagaacttagggagttatttaggttcagttatgtcctctgcctcttggaaattgtgtttcctaacccaggtagtctgttatagaagttacaaccgttcataaataagaaacttttaaagagttgatacactacagtttcagcttgattggatcctgataagggaatggatttactctatgtggaaataagtttaaccgagtaagaaatccaaacgacaaatatgctaaagaacagttgttacaaatacatagataaaagtagcaccaaataataaacaaagagtaattaatagtccttgaaaggcaaaaaggagctacacgtaagctaatgagaaaaacattatgacaatcagattaacttattttaagtagaagattttgtctgtcttaaacgttgaaagactttaaaattaataacatcttttatttaaaaatattttctaacaactaaaacacacctcccaatttgcctttttatgaagagttggttagattattcagaaatagtgggaagttttaattttgaggaagaaaacaaatctagcagactgaagtctgtgttttctttaatagcagtaattgtatttaaagtatttattcataggattataaatactgtataaaatatattacaaagccatcctattcaggcataagagccaggtcctaacgtgtttcattttgcaagacttgtatctaatgttaacaaatcctatgatgattacaatatttgatccatttgatatggatcacagaatttgaaagtttccagagatacagactgtttggttttccttagactaaactcttatttgcttgtgtttgtcatattactttaaaactaaagctaacataggcctttacgttgtctgtccataagtgagccagtcaaacgatattctttgagcgattctgcattgaaacctaaatgaatgtcagcttttaattaatatagttttcataaaagagaaggtggtggtgggtgggatggaattgaccaagtaggtcattaactcttatagtaagtaatccttctgggtatatggttttgtgtttaggaagtgggaagcggggaacagtattattaccttcttttggaagtgttttagaaggctttgcacttagttttgtttgtggactaagtggctttgtattttcactaattcttggtttttaaatgattcatctctgaccagtactgccttttggctcattttctgggttaataaatgtctcttnnnnnnnnnnnnnnnnnnnnaaaaataccatggaattatccttgaggcaaagaattaaagctctgtataagattttctgtataaaatggtattaaagtattttggatttatatgcctactttttcttggtgtacttatgctccaaggtcttaggctttcattcttgtacacacttccaggatagcaactattacaagggaaaacactactaatgtattttccctgatggtaggctttttgcttattaaaaaaatatgtaattgaaagactggtctgttccaaaagatagttcttataatacaaataatccaagtattaatttatcttgatctgcagtgaagatttcaaaacagaccttagcatttttctaataatgggctatgccagggttctagaagattaacagattaactctccaaaactatagtgaagattcacatggaaatctttggatctgcttattaaattgagtagtcatcgttttgtttcctcttgacaatttaaacgtctttataactcatttcaatttgattatgattacacttgacctagatgacattggtttcataaataagacctttctctctcagggaagaattccatttccctagttatttgctatagtgtgtcgtaattatcttactgtagtatattaagaaatatgaatttctggcacattttctaatgcaagcttagctactggtaactgcatctttttcttttttaatgtaagaagaaacaaacacattctccttagtgtttcaaccaagtccttcaacgctacttggacactgggctaaaccagggtcctctctgaattacattatcgttgacttttggatttatgcctttacctaagggctttctgtgtcagcagagaaatggaagagaccttttgtgctattccaattaaaagaaaaagtccaagcctaaactggttttcagaacagatggttttttttcctaaggttaatccaaaagatactataaaaacttcaaggataattaatagatcagatatgaaaggatgaaaaaatgttaaccctaccagaattctagcctatggagataagaaaagataggtgtttatatacaaaaagcatatagactattcctgctaatgatctcctcttattttctcacctatgttttagcacacagtatctctaagaaatatttcagatatcatgacgttctatgaaatttagtcattcttttttaaaacctcacaatataatccagggtcattctattttgtgctagaaattagtggtatagtcttgctgctgaattggaagatacatttcttctttacaaaattgcatagatcaagacatcttgatacatggagttttaagaagtcttgtactagagtagcctctttgaagctaaaataattgtaagtatctaggcagatatacagctttgattcaataagaagatagcctataaatggcgcaggtgtaaactatttaaaattttaaaccacatagggctaacacaatttcggaattataggatgtgagaaattacaaagtaggaggacaaaatgcttcctagaaactgtctcccccaaccttttctacgatgggaattttccagagaagattttggcctctcttcatggcttttaataaaagcagaagtatgagaaatcatctctcaatcctggattttaaaatacttgataatatttaagatataggagcaactaaatgtatacattatccatagaattagaataaaagcattctaggccatgtgtataacataactgtgtggtgggttttttctccattaatggatggtatctgtgactaatcacattttctgccttataggcctgcctcgtcccctcagctttcacacgatgatactcattcacgcattgaacattatgctagcaggtatgagactagttgtatgccaggcaaatattgattgaaataactaaccaaggaaagctaacctataatattttaaacaaatcttttctttttttccccaaacttgtctgattcctactaatcaacttgccctctaacgtgcatgccgttccactgcatgttgtttttggtcaccaacaagagcattagtccagaataatcttccctaaccctggcttttaaacatttccggtagccttgctatgtttttttatactgagcacatttactaaattggcttacaaatagtttaacctccttagaaaactgctagaccagacattcatatatgaaaaaatgatactatattatatggagaatatgaaagcatcagctttctgtttgtgtatttattttacatgatatgctgtaaagaagagaataattaattttcctaatccttggacttttctgtctcaccttctttgtgtttgagatgatttttatacctaaaaactgaattactaattttaaaatattttatgcttgttaaatccgtaagagtttggttaacttttttagttgtaaaaaaacaaacaaacaaacaaacaaaaaaccccctgtataattgcctgaggtgaagaagattttaaaggtaaaaattggtggcagaatgtttagagagcttactgtgcatccatcctttgtcaatattctaactgctggacatgtttaccaatcgtgaaaagcattagctagctgtgtaagtctgtcatcagtggaaagtagtaattgtcttaaaagacaaggggtagtgtaaggtagggagtgcacttattgttagggaagcttttcttctgaaaacaaagacctgttctcagtgaaagcaagactgatctgtagggggaaaacagtgaaatataactttccttagaatttctatcataaatgtagtgctactaactagctgtggtctaccacacactgcctcaaatggttaagccaacacacacatcctttaatttgaaggattcctttctcttcttgccatgatttatcctttagttttcaggaatgttcgattaggtcttgaatagattctaagacgtcacataagttttaatgagcttttacgttttttatcaggctagcagaaatggaaaacagcaatggatcttatctaaatgatagcatctctcctaatgagagcatgtaagtatcccatctctttttacaaaatgttcctgacaatgaaattgctttgagggatttagaggtaggatagcacaggatataggaattagcatcatattcatttgatcttttaaggagccattcatttacttttttcctttaattcttaatgccctggcatggaatgagctcatccaaattctggcattattagtattcagagtagcaaaaatagtttgccttactcttatttgaacttatttcataccatatgattacaaattgcagagtcccaagtatttatagtaatgcttaatctttgaccaaacctgccagatatttaaagggataggatattaattttaaagtcatggctaagtactattttctccactcatggggagtggaaacgtgatcttggtatagcatggctattcacatatggtaggttagttgggcattttccttcagaaatccaaagaagtagatttttgtgatttagcatcttcacaagataaataaagtgaggcaatcttatgaagagtttccagaggagaagtaccaattcaggttgcaggttgttagcaggatgataagccaaccctgttaaactttaaggacggagatagagcggtgctaagagcagcagggaacacagctatggcagggaaacaggcttcattatagagtgagggcagtgttcacaatacagagcacaaaggaacattgccatgaaccaagtaaatgctgaccggggcttgaggtagagagagcagacattgaagcaaatatgaaggaaaaaataaggatttgccaagtgaataaataacataaagagaagaaatctagtcaaagtattacgatgcctttttagtttgataaagtaaggatatctcacccatcttggagaatatagacaaagggaagaatggtaaatttatcatatgtagttggtgtggcaacacaaagtcatgctcagatgagaaaagaaccttcataaggattaggccaaaagaaatagtatcaaagtggcatatatataactagttattgaagacatgagaataaataatctcatctggtacataaacgatcaagctaataataaagaatcaagtcaaccctcagtcatttgtatatgacttagttccttcaaacaaacaaacaaaaaagcctttccccaaccataactgtgatgccttatctttcttagctatgggaaaaagtattaatggtactaatatataagatacttcaacagtaaaatgtgtggccaaagaatcagccaaatgtaaatagcttgtgcttctttggctcactgattttggtattagaagctctagcacattcagattaattcgagttgtatctacgtaacagtggctgtcattcattgactgcctaagagaacaggaagaaaagtgtagttacaactctaggttataattaaacatgggaagttctagcagtacaacttcagaatttggaatgagtgtgataaattaggtggtaaaactgcttttgttttattttaaaataagctttagcttattctgaggacataaaatccattttgactcaatgttggatggcaaaaactcatggcattttaggggcaggtttggggaagtggtttggtggattggttgacttcacttaaatgtgtgtttttaatacccaataattatttttagtcagcttttcacatctaaaccaggtaactggcttgataaacaaaaataattcaaatgagaaggactttttcctaaatttctgatatttttcaacttaagtgggtatggagaggagaatattagcgtatcatcttaatgatatctaaccagaaacaatgagctttagcctgtcattacggacagaagaaaattcttataacttggaggtaaacaggcctttccggagcttggagcaatgcattcagaaaaaagtttgtcctgtgtattagagagttcctagtttccaggaaagattgtagctgcctccccaaatagaagcctttttgcctccttttcccgcaagattagtccttaaaaccattatgtataaatttaaaaataaataaaacttgtatttaaaaaaactctgccccgaggaatgagatgttcagtcttcttttaatcagtcaccttaatgtcttttttccccttaattttcgttcttctgtctaaacaataactgaatgaaacaatcatgtatctccagtttaattgttgttgtcattctgcctcaatgacttatataagttaaaactgacttactgaagcaatactttttggttacattgccttccacttaataaaatatttcctctgttacttttagagctgcaaggtattttttcctactcagtacaacaatagcgtgggttagtgaacagattatcttgacaggcttggtggccaaagcattatacagccattattatatcttttaatattttttagctattgactaacatcaacgtagagtcccagtatttctgtaattctgcctttcatttatccgtgtaaataggccaatcaatttcatttgaaaatctgagcaagaaaacactttgaattggtaccagtagaatggtagatcacaacctcagcagtatcaaaaggtctttagaagcaggaaaaaaggtctaattaattgttaagagcaaataaatgtttctattttcaaatacactcctgagtccctaacccccaaagcaaaataagggggggaaaaaaccaaaacctttgattttattttccagagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggtgagttttctttctagctttgtcattggtatgcagagtgcatacacttgcacacatagaaaagtgccaggaatcttcacttagagtcattttatgtctaattgttttctaaaataatctgtttagctccatttgcagattctctctctcttttttttttttgttatctgaaagaagacaatggatgcaatagtatgatgaagaactcatattttaggtgtgaaggagttaatgctgatggtggtatttgacttgttgcatgtgtctccaaggctttgattttatatttcagaatagaatttaagaaaaaagtaggttatttaattttatgattatatgattttttttacatgtgtttggccatattatctacctcaaacatttaagaaagtagggttattggcttggtcatattgggaaaccaattgtttcatcttatttttcatcatcaaatgcagaaattattatttatgctcaccatcatagcaggttagtgagacaattccaattgtcagccatcacctgtaaaagacagtcatgtaaaaatagcagaaattgtagaagagaaaaaggctaaagaactctcataatgactgcagggaggacaaagatgtaaacatctggggtactgtattgtgtcaggataatgcaaatcattggactttcagttctgtattacatttattatgtcacaggtcccttggtttaaaaagtcttctcacatgatcacttctaactcacaatgtgccttcttcagacagatgccaccaagcaaggatttaaagtagatgttgctcagatttgtgggtcttaagtactttcatctctttggttgagcccaaggcaccaaaagctcttaacgtaggcaacgcagtgtgtctgagatcagtgccctcgggagtatgccacttcaggatgaaaaaacaaactgccactcttccattgcttcctgctgccactgcgagccttctagctcttaacaccttttacctatggccatagctccttatctggttggcttccctttagtctctttcccacccttgcaataaatcctccatactgactctacttgtacatcttgccagaaccaagacccatcatggcattcccctttcactggatttctgcatgtagaaaaaaatcaagcttcttagtggggcgttcaaacccttccacaatattctcttgacttgctttttctatgccatcttcttttgttctccctgtgttctggctatgctgttgtagctagtatttctgaatacatcctgctctcatctacctttggggtcaagctcaagcttgagtctcagcctaactgctaacctctaacccaccactgccgtatctgacaaaggaatcccacctatcctccatcacactgctcaaaataactttccccatggagccctgctagatccctgcagttggaagaaatctgtcttttgcctctattcccagagcactttggacctttctcagaaaattccttgacagtttgcctttttatcagttattaccagtgcctctctttaatgagctagtgtgtgtctttggggcatggactgtatcttaatcatcttcatatcctccagagtacttagcatggtttgaatatttaatggctactcaggaaatgtttgctaaaaacctgaaaatacagcaagaacatcacatgagtaccatccacgagataatattgaactttttttgttgttttaatgatagctttatttttggccgtacttttgagatcatttgtcagtgaagaccatggtagagaaaacatttctactttattgagaataatcagtaatatccatttatgttaaatctgtaattattgtaggggtcaaagtcaaatcggaataaaaagttggaactgacactgtaaatagaatttgatgttaccaaggagtaaatatatttttgaagtatatgatcgtgtaatatatcttttgagctcattggtcaagagccctgcctcgtttgtggttagcatagtctttctccgtaccattgcacccgggtcaaagaatgtttgtaaagagtactgataactatcatttatttatcattttatcattttgagtgcacttttacatattttagatcatttaatcttcttacaaacgctatggagaagagactgtcgcctttctgtgaatgagacacaggttcttagaggttcacacagcttgccccagatttcccagtcagccagtggtagaactgaattgaaatccagatttttctgactctaaataggcaactctgccttcaaccagataataaagaagagtaagtctctgtgaatgtcatttacatagaattgcggcatattccccagaatgtgccttaacttgagggactatctatgaggactgagtgtcccggaataaacctgttcatctacttgtggcacagcgataaccgctttaccctggaagatatccaagaccattctccaagaatgggatggtttgttctctaaaagaacaaaaaacataacaccaggcctacttagagctccaaaatgaggactctggggttgatgcaaatctttgtgtaagttaccttgaccttcacgaaatgatcaggatgagcttccttcattgtcccttcattttgtcctatttgaccttctaccaaattccaaagaaatgtctccacagagttcccttcctgaaaacagcccgtgtgttttctttgatctgccctgtcctgtcttcttgcagttctgcgcaaggagcttcagagccctagatttgccttcgctacccttgaattcagtgttgcttaaggagcctttaatttgccatttcctgttgagaaaacccaggaattctttagatgccctctctgtgcatgtctagctggctatgtcctaagtcagcattgggctacgcaatctgacaaatacgagcatacttttagagaaaataagaaagtatatttaaaattgagattgccccaagtcctttggatgtgtacttattgatctgttaatatatatattttatgttcctttagctgtgatttatctccaaataacagcaaaagagagaggcctggagagccccattcctgactagatatttattaaattccattaattgttcttattcatgacacctccctacaaccccctagaaaaacagaggatggctgtttgagaagtgtctcagaggtatcttatctctgcctttagaattccatttctcctggttgttgcacatagtattcaataaatatttgttgaatgcattaatgaataaatgaattgaagctgaatttattttaattgtagcatacatgcatgcacttttgactaaagttcttttacaaacctaatttcgtagagaaaagcctttcaaaggctttgttttctgcttgcttttcaaaattctcccctttttcaaactgccttgattagcaccaggcatggctttgtcataaatttagaatgttaagaacccgttttccaaatcacaggcactgtatgtatcccacattggtgttctctgattcttggttgatgccacagagataaggctaaagctctgagtaaaagctaaatctgactgagtttttcccatagtgcctcccataagtttggatgactaatggtgttagtgagatatctaatctttaatatttcgcttctgcatcatatttctccctcattaccacatataattcagatacatctttatttggcaaagagccactggatcttgggtttttgccccattgtgtgtccttagcattgcagactcaaggtttacttttttttcttgcgttgattaaagccttcagtctcctgacttaagcctgtagtgttcaaatacagagatgtatttgtctctgcactgtctaaataaaccaagacttgctctgaaattcaaggtatgatcctagcaatgaaaaggtagcctttctgagagacaaagacattgtcgttctactacctgcagagcaaattgattagattgttctcaagtcaacaaggtggctaaatattaacctaattcaccataaagtctaaagttaaagttgttagtagatgttatataacacgagggaactctgtagattcttaatacctactcaggacctttcatatgtcttgttgggcagtaagaccttatgaagccaaaatttgagttttctctttttcctttaaattcctccagtgattgtgcaagattattattgttacagtcaaagaagttctagatcagttactgataccactgaattaaagtagctggaaatcatgatcccgttgctttactttgtaattgacttgatgactttggacctagtctagtagctatcaatcttcatagctacgggaaatctttattcaatgttctttcattaggtctttgtgcaagtctccaatgatggtgaaaagatggccaaaatgaagggaatctgaagaggttaggaatgggcattcctatggaatataaacaaaggtgtcagggtgaggaatggcagagtttgtttgagggaaactgcagttgtattaccttttttaagaaggcaaagaatgagaggagatgaggctgaccaggtcagcaagggcaggtcgggaagggtgtggtacccactgcagagttgctgcctccgtgcctagtctagggagcaactcaagggtgtgatccaggagtcaggccatgatattgacatgaatatacgccacacaggcagctgtgcggagggtaactttgaaaagagcgatgctggaacgaggaaatcaagctggggggagtcacatgggagcccaggaaagagatgattagagccttaagtaaggtgatagaaatgaagtagacaggctgatctgagtgatatttcgggggaggatagagctgtttgattcggtagttctgtgggactagggtatgaaggaatgattcccagggctggtaactacaaaacaagatgatagtagttatttgcagctgggactgataattcaggaggagttgcagcaggtccatcctttaatgcagcagtgtttattagaggtccttcctgaagggctgagtagctggaaggtgataaatgaggtatggaagaggtcgagttgaggtcctggtgacatctccatgtgtaaatgtctgacagtctgagagatagaactctgatgcttgtagaaaggatataagcctgagatattaggactgtgagtcgccagctcacaggtggtagttgaaaccgtgagaatgaatttatatatcccgggagcatgtagcagaaggagaacactggatttggtagaactccggaagatgtgaacattaaagtgtgtatttaattacttttatttttagtagagaatacatgtatattattatacaaaatccaaagggttcaaaaagacatatagagaaaagtgaatccttctccaaccttctcccctggctgtggtgtttccagctctggaggctgccatctttcttggtttcttgtgtttccttccaaacatgctctctacatatgcaaatatttgcaaacatatttatggttgttggggttacttcacacagtgtcgtgcagtgttcactctggttttctctttttacttaaaaatctctaattttcacatgctggagaaatgtgccagaagaagaggagggcagagcttgggaatgatgggagcattttcccacaggaggcaggagagagaagggttagggaactaaagtatgggaggaggcgtgaccttgaatgagaggaaggactgcctctgaagacaaagtggtaggtaaggaatttagggtaaggaagggaggaaagaagcataatggaatgaatgttaaaatgtccagtagacatcactggaaataattcaagactgattcctacggctgttcccacatgtttttaaagttggagtggagaggaaagcgtggtatatgatacatttaacgaaactaggcattcaagttacttggtgtattagtccattttcatacggggcaatttacaaagaaaaagaggtttaatggactcacagttccgtgtggctgggaaggcctcacaatcatggcagaaggtgaaggaggaggaaaggcatgtcttacacggtggcaggcaagagagcatgtgcaggagaactgccctttttaaaaccatcagatctcatgagagttactatcacaaaaacagcatgggaaaaccccacccccatgattcagttacctcccactgggttcctcccatgatatgtgcggattatgagagctataattcaagatcagatttgggtggagatccagccaaactatatcatttggtgacatgggccccaaaacaaagggctacagagcccttcttgagacaaagggagctagtttgatcacagaaatcagaaagccaagaccttttatggcaaggatgaataagagctgaagggcatacatgccacatttaagaagctgtgtaagaatggggtcaaccatctcagctctactcaggcagggaggacaggaacatggtagaagtggaatcaccattattcacagactcagtttctaactagcagggccagtgtaactaaatttccttcagtttatccaaagttaattgaagtctgaggggactgattcatagtatgcagttcatggcagtgaatggataacccagaatgaaagtttatttctccctttatcctaattatctctctttttaactgccttgtattaaaatgttatcaaggttgccttaaagcttttttaggaggagacagcatctggtttaagtgcaaatactagatctattaaaatgaggaatatattcattttttcggcacacagcatcctgtgtcttagaatccagtgtcttaggaatcacaataaaaatcaaattgtgttctggtgagcctagaatcttggcatctaaaattggatgtttgtgaggactgcttcatactacaaaaaaattgaagcacccctctggcgattagaatattcacatcttacaagtacagctgccatctccctagaacatgctggataagagtttatgttcttacaatccaatttcccttttttttttttttttttttttagatttttcatgaagaccctcatcctcctgttggccttcatttgccaattgtccctctacagtagaattgattatggtcatgagtttctttagctactttccaggcctgaggatgtaattctgttcaattctgcagatagttactgagtgcttaatgtaattttaaaattatgagactacaaagatgaataagccttggttcttaccctcatggagctcaaaatttattttaaaaaagttaaaatagaaacaactacttatatcctgctgttacaagtgctctgggggcacagaggtgaatgatttattctatcagagggagtagagaggcctttacaaagagagtttaagagttgaagactgaatgggagttttccagtctgagagatgggggaaggatgagttttccagactggtggaccagtgagtaatgtgtggcttggaatgaggagaataagagggcagtgggatggtaggtggggactactgtttaaaggactttgtgcatcatactaaggagtttgggttttatcctataagcaggtgaacagtgatggctttttgacgggggggaggattgagaaaaataactgacctggcagaaagctaaagccatgaagattggtagaagcacagtggaatagtccattaaaagatgccaggttcttaactaaggatgtcttaggcaagtgaagaaggggatggagaaattagaaggtcactgaatgaatgagaccaagggaaaatggagagggggaggcatctggtgttacggaaagttttaatttgggaactgggaaatgatcattgaaaaacaaacaaaagcaacctagtgcacccaggaaaaactcctgatttgcaaagggttagtgcatggagagaaagagctacgtatcagacatactgaattctatttgcccaaggacatttcaagtggaaatttcctatgttgattttacgtattcagttttcagaaaggattctttaaaaagtcatagcaatacaattcctgcaatataaataatagatcaatgaacatcatagggattagcatagttgatttgactaagcttcagattcagtttgagcttccctgtagccagggagataataggaaacaaagatttgtctgtctcttaatattgaattaaagaagcacgcagcatcctaaagaaacatcattgttttcctggctctacgtaataataataataacaaaaatagctgtcctttgagtgattgctatggacaggaactgttctgagtacatatgaactcctatttaatccttaaaacaaccctatgaaagagaggctgtttccagaggattacgtggcacagagtattaaggacacttcatatggccagcaagtaataggacctgtattcaaacttgggtggtggtcctgaactcttaagcagcgttacacttgaagtgattattggctagtgtccttatcaacatttttataacaaatcccaagggaaattatatgtggctgtttctcatggcctttgataattgtggaaagcttaacattaaaacaccaaagatagggtgacagttctccaaggataaaggtcactgttgcctaaaatgtattctgcagaataccactgagatactctgagaaaaaaaggattccaaggacagtaaaactttgaaagcactcatactggaaagtcatcattacgttagcatttgcactgaggagtttggaagtgaagaaacctgattagctttgtctaacctcatgttgctcccacttacttgacctcgagcccaactgcaatgttatatggaacacactttggtaaagaaattcaagtctgaagtaaactttgaaaaccagtctaggagatagcatagttgactctctactgtagttgttgagaagcctatccgttgtgtctctgggaacatcagaagataaagctataacaggtgcccacgtaggaagcctggatttttcgcacaaaagtaacttttcatatgctctagtggtgaagcagttaccctgtagacccagaagccagaatgatttagtctgaaaaatctaaagataggtattaaattaactctcatgatcatagaaaattctttgcaccatttttgtagaatatcccaccgaataacttggcttttcacccaaaccaccaagaaaaattgccaccagtgacttgatgcaattaacttgctatcgggagttctttcttgtgaaatgattgaactttgaaagatgtttaccaaagacagcacctttagcttcatcacaattactgtggaatctttctttgtaagtagttagatgcaaaggccagttgttgcttgaggcctctcctggattgtgattttaaagtgtatcatcaacacatgggaagatatttctccctctttatcttatgacagaaatgcaggtatagctttcatctcaaagtaagattaaggtataagttacaaagatgtgtagctactatatggtcctgtgtaatgctacttgaggaaggctgttcctttcctggcactgaaattttagagcttgcataatcagtatatcaacctcgtgtggcttggtgcttagcaagtttcagcttctagagcccatggctaatggagccatccaggagaatgttggagagataggtctgaagccttagaagagaagtcttgattaaggagtaatgagttgcgggaaggggtcatggttgtggcggagatggaagcctggggagaggacagagacctcctaggaagagagtttgtgtaagaagaagaccaaggacctcctgatgtacttgattgtaattgggcatgagcagcccagttagaaatggtttcctgttggtattacatatgtacatggatggcttctgcagatggctaaactcacccattttatttttttactatcttaatagttaaaatatgaccttttcttgtgtctccaaattctgagttaccttatggtgctagtctgtctgttgtaactacaagtcataagtaaatccatatgattcttttcctgtaatttcctagtaaatcaaggcgataatttcaaagataaaaatctgtatttttagctttagcagtgagcatgattcccagtctttttgccttcgagtaaggtttgttaccatggtggaagtaaacaatatcccacactctagaatgtgagctcttcaagggtaagggacagtgtcctacatatatctttatctccacagcactgggtacataaatgtgtcataaaaatgaatgggtaaatatcctttggagtttttctgttacttgatgggtttttggggttgattttcaggtatctcccttgtttttctcatttcttacattattttctttcccaaaatcccttaatatacctgtttagtttgtgatgtcattttccattagactgaaaccatccaagttgtttaggctaacccagacttaagcattttctgggcttatttttggactctttttaaaactcatcatctgaaaatatttaatgtccacacggataattctgaagacatgtgcataccatttttcttttatgtacatgggttaaaccttgatttttccatagtaggagaaagcattataagattttattgttttcactggggtaatatcttttgtgctataagaaataaaattttgaatctagaacttagttttttataagacctttattgagatataattctcgtaccataggagttacccatttacagtgtattagtcactgattattagttaataggttaaccagtattagtaatcactggttattaattacagagttgtgcaaccatcagcgcacaattttagaacatttttatcaccccccaaaagaaatcccatccccattttcaagtcactcctcgtttctcctgcaactactcttttcagccctagcagtagacaatccctgatctactttctgtctctatggatttgcttattctggactgttaatgtaaatgaaataatacaatataaagtcttttgtgactggcttctttcacatagcgtaatcttttaaaatggtatctatattatagcccgtattagtatttcattctttctttaatgctgagtaacatttcattgtatggatataccacattttttaatctattcattacttgatggacatttgggctatttctacttattgtctgttatggataatgcagctatgaacattcatgtacaagtaccggtaattattttaaagaagttattctgggctgggcatggtggctcacacctgtaaacccaacactttggcaggctgaggtgggaggatcacttgagaccaagaatttgagaccagcctgggcaacatggggagataccgtctctacaatttttttttttaattagccaggcatggtggctcatgcctgtagtcccaactactcaagaggctggggctggaggatcacttgagcccaggaattcaaggttacagtgagctatgattacaccactgcactccagcctgggtgacagagcaaggccctgtctcaaaaaaagaaaaaaaaaaaaaagattctatagtttctgtcattgtaatagaggaggccataggatcatatatggcaagagtatatagcagtgcatgccagggagtgaaaaataggccatcaaattgaagttactgggagaacttaagactaagtctaactacgcatgagggattgaagccgggacacacaaagcttaaaattatgattcttctagagactgttacggctttttgctgaccacagacaatgaaagtttgatattttgctgtatttgtctgaaaatggaaacacacttttcccaatggcagtattcctgaggactagagttcttcacctctaaaacctctccaatcctagtttttccttttggctgatgatgaccagccactgccatttttgtcttaggttttgttagtctgtcttatttccagttataagtggttaaaatttcttatgaattcttcttgtgttgaacttttgattaatacatttagtctatagacagtaatgaattagcatctgatcaggaatttgtgaaaaacatctcagtcattaaagattaagaaactgaagccaattaatattgtcatgttctgtctcttggaacttgagcaagatacagatctacgtgtcaatgacatatccagaaaatagactccacctagatacattaaccctgtacccttggtccacatattttatttcagcaatgatccatggacatattataatttgacagtttcatcacatacctagcgtattgggtcaaatcaaggaaatctcatcctagtgatcttaactcagtgatttcattttgcccagatgttcagctgtgataaactttactaaggcacagatgatggatgatacacaataattccaaaatttgggggtggctacaatgtggctaggggctagaactcaggtatctacaggacaaatactgagtgattagtcactttctaagcgctagatatgcatatgttctgccaagctcagtaggtctaagtagattgcttccatttcagataattaagtgctttctttttataggaagtttttagcacatctgaggttctaaatccaaaaagtaaataatatatagagaaagaagtaataacaataataatagtaaccaacatttattgaacacagtatgggctgggcatggttcaaagaaagtttgacatatagaatgtcgaccatactggcttaataatcctcataactgaattagtgcttaagtcagttgcccagcctcagcaagcagcagaggcaagtaagtcataaatcaagatcttctgaatccaagaccatctctcaagccttgttctaattctctcctcagccatggatggtgaaaggcaccacaaaggcagcgtgtcaaaaagtggcattgttcaacctttcccctgatggggcaaagcttttatttttttcctttacgttctttgacatctgttttaaaatgcagatatcactagaagaaatgacaactttattataaaatcccagtaaaatgtaaatgtcttatataaaacctttatactgagcaaatttcagtaggaaagggcttggaagtaaggctctgaatgttttaaagggggacagtgctaagaaatgattagaaacaagagcctggaggggtcctgccatttttactgttttgcttaaggctgacctaaaatatgcatagtcttacttctcaccctgtgagcttatccttattaatgtctttttccacctagtttaggggtatttttgaatttgtgtttgataaagatgtctaaagctgtactgtaaaattttattgtcacttttttttttaaatggagtctccctctgttacccagcttggagtgcagtggcatgatcatggctcactgcagcctcaacctcccagactcaagcggtcctcccaccccagcctcctcctcctgagtagctgagactacaggcatgtgtcacgacatatggctaatttttttcaatttttttgtaaagatggtgggggtgtctccctatgttgcccaggctggtcttgaactcctgagctcaagtgatcctcccacctcaacctcccaaagtgctgggattacaggtgtgagccattgcactgagctttattgtaatttcaagggctcaatgcaatttccagtttttaaagttcatcttgcttgcagaatttgtctttcatttaaaaaaaaactgctgattggctacatttatagctgctgtaatagttctgtatgatttactacatttgcctgaatttagattggtggatatgatttagctgcttttaatattatatgagggtaaagccagatttctttggatctattccttttagatggcaatctttgtagttgttctactttacaaaataatccctgtgtgtgctcatgctttggtatacagttaaatgtatgatactgttaagaaaacattgatcactggaaagtgaccttcatttctttatttcataaatatcattatacaactatataactacacgtagtagggaagctccatttaaagagtagatgacttacactgaaatcatttgacctttgtaaattagtttaaattacacagagattgttgtaatgttctttatcatacataatagttacgattgctagagaggcactcataaatcattgctaaaagggccagctgctttcatgttttcagcaggttgagttaagggaacaagccttgccaatttgattaatctcttatgtccattagttggttgggaagtttttttgagtgtaaatttgtatgtagacaacagagtttatattctttatgacataaaattaatcagatatatctacatatttgtagaatggggggattcttagctctatagagaataagaaatactggatggaagactttttttaggatgactggctacaggaagaaattgtagtgacagaagccatgtgtattgaatttgaattaatgttccttagggagctaccagagaaatataatttacaagataatcaagaacgtaaatagattctctgtggagtcgttgtctgatcactgacatatattcatctgtattgaaatgacttcatgactacattctaacaattagagaatcattaggggtgagatgtacgtgtataccttcaagaaaagcaaaatatgtattggtaataattgacagctgttaaaacgagtgcattgtgtacttgttaaacattagaggctgggcatgttggctcacacctgtaatcccagcactttgggaggccgaggcaggcggatcacgaggtcaggagatggagaccatcctggctaacacggtgaaaccctgtctctactaaaaatacaaaaaaaaaaagccgggcgtggtggcgggcacctgtagtcccagtgactctggaggctgaggcaggagaatgtgaacccaggaggcagagcttgcagtgagctgagatcgcaccactgcactccagcatgggcgacagagcgagattccgtctcaaaaaataaaaaataaaaaaataaaaaaaaaacattagaataacttaccttggaacagtaactctgagggaaccttgatcatttatgagaatgatctcccctacgttaatactgcatcaaaactaacattatggtatacctcaaaaagtattggcatagatgtttttaaatataagaaaattcaaatgcgtaattgataagggctaaatggctcaatttcccaacccctaacaaaaatatgccctaacacagctctgtgactatgactgcatttattagaaaacatttagtaaaaatcatctctagttcaaaccctccagcatcagttcttcttgataattctcatgaacatttagaaataccttaaaagagaattcagactcaaatcaaaaaaccttatttcatttggttgcaggccaagatacctcttttaaccatttctggcttttagaatccttatcatgacagcttgtcctatctcagagcttcaggaggaaaaactagtccctcaaaatcaagtttgctattgagcttaataagaggtttctgtatgtcatatgtttgtttagaagaaaagcacttgttcgactcatttaatcctggcctgatgaattaaggcttgaattaatactgagggaaccttgactatacatctacaaaatcaatgtgtcctggtaggcttctgattaagataacattagctcttgcttgaaggcatctttctctgctcctaccatttatccagtggtagataatatatggagtgaaaaatgaaaaagacatagctgggctttaaagcaagatgaacatctctgtgaaccagaaatgtgaaagaaaaaaaaaaaagtaagtggggctaaattagtgggctttcagctcgtgctgtagtaacagggattaaaattctccttacaaggtagtggcccaaagccaggattactatttgaaatcagagccccacaaaaacacacctagagagagacacatacacacttacacttaaaagcaacatgaaaagaaacagtttgctgcaagggtctacagcttatatgcagctatggccctaatgcatagagccgagggaagaggcaaagattcgcagttgggaaagagagcatcacagccttgaaaccaggacctgaaccaatctacctactgcctggcaatgaaatgagtgatatctctgtatcactcagtgtaggagctgcaaactaccaacagatgtggctctaaactctaagcccctgggtatggctgggagaagccataaaaccacctgagagagagataatgagtttaaaaagagaggaaaatattaaagtacacacacatgagaataatagaaaacatacacatgcatatgtatgcacatgcaaaacatcccttgcaaaatttgtctccaaatcacgatccaaaatacatgaagaaatgggatagcaccccccacccaagttaaacatcaaaaagtgaattaggctgggaacagtggctcacacctgtaatcctatcactttgggaggccaaggtgggaggactgcttgtgcccaggtgtttgagactagccagggcaatgtagtgaggtgccatctttacaaaaaataatttaaaatatattagccaggagtggtggtacatgcctgtagtcccaactactcaggaggctgagataggaggatcgcttgagcccaggaggatgaggctgcattgagccataattgtgccactgcactccatcctgggcaacagagtgagaccctatctcaaaaaaaaaaaaagatgaattaattctagaagaaagcaaaataatacactagtacaacaaagatttttacttacatttaagatgctcagaccaggtgcagtggctcacgcctgtaatcccagcactctgggaggctgagatgggtggatcacctgaggtcaggagttcaagaacagcctgcccaacatggtgaaaccctgcctctactaaaaatacaaaaattagctgggcatggtggcaggcacctgtaatcccagctactcaggaggctgaggcaggagagtcgcttgaacccaggaggtggtggttgcagtgagcggagatcgtgccactgcaccccagcctccatctcaaaaaaaaaaaaaaagatgcttaaaggcataaataaggggtaccactcgctaaaataacaagaaactaagaaacagagatggatgaaatgtaactaggtctgaaaacaaagatatctttgccaaaaaaactagtcattgaagttactaaactcaatatacaggataaattctagactttgtcctgtcagagaaggcaagggaattagaagatgatgctgagaatgttactgtgtacaacactcacagaaaaagataagaaatataaatgagcaattaggagaaatggagaattgaccacaggctctacaatataccttactagaatttagaggtttgtttaggagtgtatttgagaggtttcagaagaaaatggaggaaatggtagagaagtaatatttgaagctgtcatagctgagaatcttccagaattgaagaaggatgtgagtcttgaaggaaatgtgctcccaagagaaatttcaaacatctgggaaggaaagaaaggcctgcattgagcaattgatattctttacagctcagctttggctgattaaaatgagccttttctgttttcactggaaaccaccaaaacagaaatgtaatgtgttgtatataccaaaccatgcctcttgaacaagggtccttataaataaatcataaaagaagagccctgtggacaactaaacccacaggatcaagataccaaggaagatctctctagaaaaggcagtctcctgtcagcacctttgtgaaaaataggtgggaagacagtaatggcttgttgtaccatcttgaggtccatgtctaaaaactgttttcaaaaggaacaccatggctgccccaatctggtagaaagaaaaatttgaataggattctacataaaaagtgttgccagttagaacattttgttgaagttttcttttaatgaagagggaaaaatagaaagtaattcctatggaatgagaccttgtgaacattggatactgcttcaagttcacagaaacattgaactgattgccagttaagttctcagaaattagatttaattaatgtggacagttacatacatcggtgcacacccagaagacccgtgtgcagaatctgactgaaggtgtacttacttcgatgaatctcttctcatcactgctttgtcaaagcagattgctatgaaataaactatacaaacaactacccttgaaggctgatagcaataggatttcaatcagtacagataggagattctatttctgtagatgaaaaagatcatacattgattttctgtgtgactttaaataaattcctggaaaccttgtaatgttaggtactaggtagaatgaaaaaaatgaagcaaaacaaaacaaagaaaaaaaccagagtagattgggttttctttctgcttccatgtggagatctagccttttgaaactgagcattttggaagacatgccgtcccctgtggaatgttcattccgagtatgggacaacagaaaatatttagcagacctggtgatgagatgatcttgctttctcaaactggacaatgggaaaactcttcttggctactcactacttacatttcatctcttttctcattgatatagatctcccacatttgtggataggaatttctctcacctgatgaaatatcatctgtgaacaacagaaatctgtcatcttattttggtatttatcacaactagaagaaagatgtcaagagttctaatcagtcactggatatcaaatatcagaaatgtcctcaattggaattgtattctcagtaaatcctaaagcatttgggaccttcacatgtgctaatactgtttatatttatttggaaattaaccaaatataaccaaaagacagtggaataaccatagaaacctttaaatggaataaaatttatggcaatcaacattattaggaagaaaaagtatactacctagaaacagtgcaagaacaacgaggatcttctgtgcatctaactatataggtctagaaatatataaagtgaattatgatagaattaaaaggagaaactaacaaatccataattatatctcaacactcatctaacaaaaattgatagctacaaataatcaaaaattaataaagatatggacaattttaacaacaaaatcagcacactatgtatttagagactccatctttccaatggaaaaatacacattatttcaagtactcaatgaacatttttagaaagtgactgtgaactaggtcacaaaaagaagtattgctaaatttcaaaggatcagtatcatacaggggttctctgattgaaacgcaattaaattagaaatgcactaagaagtgaaaatggaaatataaccactgtgctcctaaatgactatgggttaagttaaaagaaatcacagtaagaattacaaaacataaggcactgaattgaatcaggtgatgtatataaaaacttttggtatataattaaagtggtaccaaggaggaaatgtataaccctaaatgtgttcattaaaaataaaaaatcaatgacttattcaacctgtaaagcaagaggaaaaaaaagagtaacaagtaaaacattattaatggacataaaatgagaccatagtaagtaaggagcttcactgcattcttggatgtgaagactcaattattatgaacttagttcttcccagtttaacctatgaattcaatgtaattcaaactcaaaatttcaacaagcattttcataaaatcagaaaaccaaacactaaaatcatggagaagatcaaaggggtcagaatagtcaagacaattttgaggaaaaacaaagtgggctgagaaggcctatcagacatcaattgatttaaagctggagtgtgggatctaccagggatatgcagatagaaccacagactagaatacagagctcagaagcacacctgtatatttatggacacttgatgttttgcggaagcatcgttagagatcagtgggaaatagatggaccatacaatgaatgaggctggcttcatagtttatccatgggggaaaagtaaaattagatcgcatgttcacggcaagcacaaaaatagattctgggtaaattcaagtcctaaatgtgaaaaaccaaattttaaactttaaaatgtaggtgtaagaaaagattttcgtgaacaaaacataaaaagcagagaacatacagggatatgttaaaatttacatcttttataccataggatgccataagcaaagttaaagataagctacactaagataagggtagaagatcatatttgccatgcacataactaacaatggattagcatctagaacatatccaaaggtttaaaaagaaaaagacaatccagcaggaaaatgggtaaaggaagcatgaaaagccagttaacatggaagaagtctaaccttgccagtaatccgggatgtatgtgcaaattaaaatgcacccatcaggttaactaaaacttgaatgtctgataacaccaagtatttggtgaggaggtgggccaaatggaaaacctcattcactactgaagcgagagtaaattggtaaaagcaccgatttgtcacccagagcgattcggtgacatgtagcaatgttgaagatgttgctaagatccaacaattccacatcaaactatattctgtaaagaatctcttcaacaggtatccaaggagataggtataaaaaagaatttcattgtatcattgtttataatagtgaaaagttggaaacaacctaaatgtccatggacaggaaaatgttggcatattcaagcaacagaataataataccttatggcagttaaaatagcaaactattatgtatcgacctggagaaatctccaaaatggtgttgaaggcaaaaagcaactcttagaatggtatgtatattcttaaatgtgaagttcttaaatttaaagtttaaaaacatgcaaaataatgttattagattgaatcacataaaatgggtgtttttgtaggtgaaagaaaaatacaggcaaacatcagcatcttttttaagctcaacctagtatttgttgatacattcatggtaacactgggcatgaaattcagtgtggcattatctccttgagggcagcggggaggagagaatggtatggtgttgaggcgggcatgtgagggagcttctgctttggctgttaacttttctttcttcaaaaaacttttgaagaaaatatggcaaatgataaacttatcaaggggaggtgataggaacatgggtatacttactccattcttatacatttctgttgaaaatatttgctaatgtttagagcaaaccaaagtgttgatagaggtataaaatttttaatctcatgacattataaagaaatatttacaaagtgattaaatcctttgctgcttacttatctgaacataccagtcgcgaggcttttagtgtaacataaaaaattgaaaagcatggctcccttcacacaccaggcaaaagcttcaaattttgttttgttcttttagcactggtaagattgtcatcattaaaaccattcattagtgcctcttttgcttgctgttcttcggtggcagtcagatgcatctatctaccatggtatataaaatttggtgatgatattcaaattactttttttcttctttttctttttctttctttttttttcttttttacttttttgatgccaataggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaagtgaggagagagatgggatttttacaaacattcatttttccctcttaaacaaaactaaacctcagagagcactttttataggtgcaacaagcatcaattcttaagtgcttggtatgtgcctgcaaagtgatagtatcaaaggatagaagtagaggagatagaaaaactagtgtgtcttttttgtatttgtccaatattgtttcctaccaaaatggttttttcttgaccaatttgaaatacatcttggggaaaaaaacgcctaaaggtttccactagttctctaaaagtgaatatttcacttcttgaaatggaactatttcatttacaattagttatattttctggtatacctttgtgttttttttctcctaatccctaacacatagttctttaagcctccatcgaaaacctagcaagatactgcattgtaagaggacctacctggacatagttctggctttctgggaattttaaatttttcaattatgttctctctatcttgttacttaatacttcacaaagatatgaatcttccattacagttttgagatctcacatagtctcatcattcacacatgaccttctaaatcttccagttatttaatgtaatgatgtatagtctcattccagtgtagctctgatttttttctcaaatttataagggagcacaattcagatacaaagacagtttctatggattatatcaacagtgaaatatcccaaattaaacaatctttgggagggcttctaaagtaggaagggtcaaaatttatgagtcctgagtgtgtatcatattttgaaatttatacatttgtatgtttattatgaaaagtaattctgttttcttttggatgacttagccccaggcagaggccaaagtgaatggcacaacggtgtcctctccttctacctctctacagaggtccgacagcagtcagcctatgctgctccgagtggttggcagtcaaacttcggactccatgggtaagtgtcctagctactctcagattttgttgtctgaagaaaggtagagtcgtattacagggacatgaatatttggccgtaagtgtttgactcatcttggtatcagggagccactgaaaatcatataccaggcgaaaaaagtctaaaaagaaaattctaaaaaggtgtattctggcagctctatctggcccacagaaaacttgtataggtgagaagaccagttaggaggcaattgccaaggccaagattggtgagttctgagggcctgcacttgagagatgtgggaggagaggactgtgagactattctataaaaatagacttgccagggggctgggcgtggaggctcacgcctgtaatcccagcactttgggagggtgaggtgggcggatcacaaggttaggagttgaagaccagcccggccaatatggtgaaaccctgtctctactaaaaatagaaaaattagccaggcatggtggtgggcgcctatagtcccagctactcgggaggatgaggcaggagaatcgcttgagcccaggaggcggaggttgcagtgagccaagatggcaccattgcactccagcctgggcgacagagcaagactgtgtctcaaaaaaaaaaaaaaaaaatagagttcccagggtctggggactgagtgcaaattgtaagaagaggaatgaagggagaggatttggttggaagaagatagtgaaacttctgattgtggacataatgtgtttgagaaattgacaggtcttctaagtcatgtcccaaaagaaattaagatacagatctatacttgaagtaagtgggcaaactggagagatttgagaatgagtttcatagaattgattgctgaagggtgtgagatgagaaatctataaaatctataacacaggtgcttcgatccagtgccttggaaaagacctccatttgggtaatgggatagtaaaggatggataagtagggaggttcaaggaagatgtgacaaaaaggtgaaatgctaaagagagctcaatggaaattaaaataaatcacagtccattgggtcactataaatgcattgggtaattttgagaaaccattttaggccaagagaagggaaggtggaaaacttctgtttcaatgaaatgaaagactaggtaatcttaaaatgaatgaggattaaggaaagtgaagacaattttgaaacattaccaagtaagaaggaagccttaggcaaaagttggatgaatttgttgaggaaatggtccacatgttctgttctcattcttagcaatgttctctgcctaggactaggttctaagaaaggtggagctgatgaggcataaatgatcaaaggtcaaaacaagagtagggcattttacagtggtaatgaatggctaggacaggggttcctagccagctgctcattggtttttcctgctgtgtctggctagacaatagagggttttatgaaggccacaaatacttggtcccccttcctcatttctctttctctgtaaaggcccagtaggagtcagctccatcctctctccttacttttccctgggacctaaactggttatatacttggtcctctcaaatcttacctcacagaatagaaaagacctgtgactccttgattccatacacttacagctctattgcctgatatgatgatgtgttcaggaattcatttcatacttgagctcttccatgagggtagaataaagggaggcaaagtgccttaaccaaaatggataggacagaaaggaaaagtcaggggtgtgggtgagttttatggcgaaaaatttggagatcacagtcgggaaaattcaaaagttggatatcatggaagtaaaatactttcaagcaatttctacatctaacatggtgcctcccagcgagctgctgaagattttacttggagatcactgaggggtagggagtacagttcatggagttgatgagaccaacgttgctgagcttatcagcagaggggtgaggtccagatcctgacgacagtggtagatcaggatggaaaagatgttgaagaagatggacgagggctctgaggagatgaacatttctgaggaaagagacagggtagttgaaataaatgtgatgaagttcaagaacctggagcagtgggaagaggcacatcctcctctggagaagccaaatcttgtaggaaagccaggttttgatttttttgagaaggaaaaggatatgtttgaggttattttcctgaatttactacacctccatgatttaaggcaatctctgtgtcagattatctccctccacctgagatctgaatatagctaataaactgttgggattgtaaatgacaacacactacatgaaaaacaactgtatgcatttgcaaagtctgtaaattctgaaaacaactgagctttagtacctcttatttttttctacttcaggattttcccccttttttaagtaagtaaagcatatgaaactaagttacatattttagtggtgagattcagagccctgggtgcttagaagcattaataattatttaggtcgttgacaatggcgaataggcagcatactcgttaaagcactcaaattaaagtgcacattaggatgtggtcctgatgatctgtggagctaaaaagatcatggtagaactgaataccaggacaaaagtgctatattccaatggctaagctaagagataacttgctggcataaaatggataagctgtgttaaatttgtcctctgaaagaaaagactgaattcaagggtactttttcttgaactgtgtattaatctgttttcacactgctataaagaactacctgagactgggtaatttatgaagaaagaggtttattgactcagttccacaaggctggggaggcctcaggaaacttacaatcatgggggaaggtgaaggggaagcaaggcatgtgctacatagcggcaggagagagaaagcgaggggagaactgccacacttttaaaccatcagatcttatgcgaactcactatcatgagaacagcatgggggaaaccgccgccatgatccagtcacctcccaccggacccctcccgcagcacatggggattacaattcaacatgagatttggatggggacacagaaccaaaccatatcgaactgcataagctaacttcatttaaaaaggaaaaaagccttaccgtcttcttgaaggatgcacacaggtgtttaaataaatgcagtgtatatacttgggctttgaaggtttgagatacaaggctgggatctgctgaaccacattctggatagagctgcattctttaaatatgcaaccccgatgactgattttcttttaagtgaaacatgagacaagtcatattaggtgatgtgtctaaagagtcaacatatttcctcaagccatgaaatacttatcactgagtctctatgtaccatttgtattctgtacagttcttactgagacaatgtgctaatgaaacgtacattctattggaggaagcaaatacagaacaaaatagcaattaacaatgtttatcccctattggctctcatgggctccatatacaaatctgtgatgtccagacaactccttatctctgatgactcctaactttccaccagattactgttttttgaagcattttatattttattgatttaaaaattaaactgttcctttgctttttaaaaaatttatcatgtacatttgaggtttatgacataatggctccctagctttttatttagaacaatttcaaacttatggcaaaactgcaattaattcaacagtttgccacatttgctttatagctatttatttatgtacttttacattcatgtgttgttaaatggattgcatatatttagattaacatgtatatctgtatgttaacatatttttatatactgtatatgtttatattttatgtgcatatttaatcatattcatgcgtgtatatagtttgtggatttttttttcactgatccacccaatggttaggtttcatacataacacttcacccctaaacacttgaacacgtgccttctaaaatgaaagatattcttgcataagcacaattatcatgctcaaaaagaacaatactgttatataatgtagaatttaaattcaaatacctccaattctgccaattaatattcttcatagcgatattttacattcaggatcagtgatgtccctgtagtctcctttaatctgaagcacttttccagcctctttaaatctttcatgacattgatatattagaagaggtcgggctagatgttttgtagaatgtcccccaatttgaatttgtctgcttgtatccaagtgattgggttcgggttaaatgttttatgccagattaccatataggtaaggtatcctcagtacatcacatcaaggttttcctcaagattctccatccccttcaccgttcttcactctccctgggcgctccttccatactttggcttctgctatgctgacaactcttaagtcaagatttccagcccagacctcccacctgagcatcttctggataaaattataaataaaaatatagcctaatctgaaatcatgatcaacctttggagcatctcttccaatttcccaatctatacaaagtcattttctaccccttcttcctttacctgccttccttagctatgttccaccaccatcaatccagtcaccaaggtcagtgtgttttgctacttatgaaaaagagcaaaattcttcaattcagctacttctgcccaaatttagccctcatcatgtgttacctgaacagacaatatgaatactttcctaattggttcctctgcctttggtctctctccctttctaagctatcttccagaaacttcagttcctcttctaccattcaaattatatcatattattcccctctttaagcattttatgccttctgtttgacaacagaataaatgtgctctttggccttgagtacattatgttcttaacctgaaatatagcatcctttcttttcactcagtgagttttcttttggaacttaatcatgcattatatcattctggttttgttgttgttgttgttgttgttgttgttgttgtttcttttgtgtgagacggagtctcgctttattgcccaggctggagtgcagtggtgcgatctcagctcattgcaacctccacctcctgggttcaagcgattctcctgcctcaccctcctgagtagctgggattacaggctcgccaccatgcctggctactttttcttgtatttttagtagagacagggtttcaccatgttggccaggctgttcttgaactcccaacctcaagcaatccacccgcctcagcctcccaaagtgctgggattaaaggcatgagccaccacacccagccatgttttcagccagttactagtacttctttcttctgcctacaactccctagaacttaagctccttaaggacaggatgtaagtcttgctcattgtcgttactgtatgaggatactctgtgcaacaaacaatcagtaaagtgcttgttgagttaatattttagaaatcaagcataatacattcttgtgtacacatggaacagcccacacgtttaggaaatttagctactagtttcagtatctttcaccaccattcacaactgatcagctaataatcagcaacaacattgtacaccataatatgttaaaggtgttacacacagaatttatgtgtgaaattgaaagcatcggtcctatatcatatggaaaaaaattaattgtagccaaatgttgggtattggatacatcagtgtgctttttcttctaaaaaatactggagaaaggcaggaaatacacaagtactaagataataacacatcaagtcggaaactggttaaaatccaaagaaaaatgttggtgggcgtatttgttcatacacagccccctttatgagaaaaaataatttcttgtacacagctcctttttaaaaaaaagagaaaataatttgtttagattcagacaaaaacacaggagtaattcttgtgtctattctgcataggctgcgtaggttctggctaaaatcactttttaagcagatagaaccattatcagcgtttgaatcaaagggaagtgagtcagatgggatatcttcccttcaagaaagggatctgaaaccatcgttatatttcagaagactgaagaatatcttgccatggcaaagcattccttttcttttttctcggattaaattgagtcatcccacttcttttttcttcacttcagcagtgattaaaggagactatcatattttgctatatcacggtactatttaactttgactatgtctttccttattttaaaaaatgtttcagtgatttatttggaccacaatcagacaagccaggaagaccaaatagctaataatccaaaaaacattatttttctctttttattatttcagtagttttcagggaacccaggtggtgtttggttacatgaataagttcttcggtggtgatttctgacatttgggtgcatccatcacctgagcagtgtacactgtacccaacgtgtagtcttttatccttcacccccctcccacccttccccccaagtccccagagtccatggtatcattctcatgcctttgcatccgcatagcttagctcccacttataagtgagaaagtacaatgtttggttgtctattcctgagttactttacttagagtaatggtctccaactccatccaggttgctgtgaatgccattatttcattcctttcatgactaatattccatggcgtgtgtgtgtgtgtgtgtgtgtgtgtgtgtgtgtatataaacaccacgtacatactgcattttctttatccactcgttggttgatgggcatttaagctagttccgtatttctgcaattatgaattgcgctgctataatcttggtatgcaagtatatttttcacataatgacttcctttcctttgggtagatatccagtagtgggactgctggatcaaatggtagttctacattttagttctttaaggagcctccatagtgttttccatagtggttgtcctagtttacattcccaccagcagtgtaaaagtgttctgttttcaccacatccacactgacatctattatttatgcatgtttgtggaaatcaccttggagtagagtcaagtttaagtgttaaagcattgccatcaactaagtttaaaatcccccaaagactagcaatatgctatttgagcaggcaatgaatctgtgaagtagggataagggctgtgcaggtctctagtgtgcaactggaactcagtattttcttgttgaataagtgaaaaaagtgaaaaggtgtttttgtttttggtgatgaggggcttgtgatgacaggtattattgttagagtcagaaatattttgaggttgcctattaatatggtttggctctgtgttcccacctaaatctcatctcaaattgtaatccccacgtgtcaggggagggacctgatgggaggtgactggatcatgaagaagttttcccccatgctgttctcgtgatagtgagtgagttctcaggagagctgatggtttttaaagtgtgtggcacttcccccttctctctctctctctctctctctctctctctctctctctctctctctctctctctctctctctcctgctgccatgtaagaggtgccttgcttcccctttgccttccaccatgattctaaacttataatcatgaggcctcctgaggcctcctcacgcatctggaactgtgagtcaattaaacctctttcctttataaattacccagtctcaggtagtatctctatagcagtgtgaaaatggattaatacacctattatgttgtagctacatagtgtatgattagacaagccataaatattatatctggcttgtttcatgcccataatagtgtatcagtcagctgttgctgcataacaaataaccacaaaattctcaagttgcatatttctcattcacgcatctgttgtttggctgaacttttgctggcaatcagctggacttgacaccaagttgtggtttgggttcaggtctgttcaacatgtctctcatccttcttgggctagcaagctacctgggccatatgcttcttgtgcacataaacacaagcgggcaaccccaaccagtcaaagacattctaagcctctacttttgtcatgcccgcttacattccattttccaaagcaggttatgtggccaaatccgaatccccaggccagggaagtactgttttcccagctcttgttcactctgctttatctacattagacttcttgctgtgcttgaggaagccagtcacactctcctctcagagtctttgcatttgccaatccttctgtctggagcacttttccctcaaatacttgtgcaactcataccctccagttcttaaagcttttgctcaactgcatctcatcaatgaggacttccaagactccactttctgatgactctcattgtcccttgctagccctctcctcagagtgttcatcaccactcaagatacctatatagtttacttatttacttgttaagcctgtgtgcctccttatgaatgcgagtttcacagagagagtgtgtgggtggggtttgtttgcttattgctatatcttcagtgaacaatatgccaggcactgttcaaccatttgaacagtgcctggcatatatagttggattttaataaatatttgaataaataaatgaatcttactgtttttaaacttttgtggtttttaaaaggcattttaaaaatctgggttagtatcaaatattacaatggtattactttaacttcaggtttcatttagctgttttaacttttacaatatattctgacacagaaaatattaggcattaagcatttttcaatgagttgattcacttctactcatgcacatatgtgatgtctgatttcgattcttaaaaagagatgagcctgggcgtggtggctcacgcctgtaatcccagcactttgggaggccgaggcaggtggatcacgaggtcaggagattgagactattctggctaacacggtgaaaccctgtctctactaaaaaatataaaaaattagccaggcgtggtggcacgcgcctgtagtcccagctactcaggaggctgaggcaggagaatcacttgaacccggaaggcagaggttgcagctagccgagattccaccactgcactccagcctgggtgacagagcaagactccatctcaaaaaaaaagaaaaagagaaaaaaagcaatgcattaaaaccatcttgagaaatcatgaaaatatggagaaaagaagaaaacaagattatactctacttgtttttatactacctagaatgtaataggcactcaaaaaaatgtctgaatggatacaattatcactgccttaaaagttttccattaaagcaaagaagccaattttacatttgtattatacttggacactcatattaaagactcacagagagtttatctggaaaaataaacttggctgacatcattaggtttatactttataatttgatctttgaaataattcaggaacaggaatgccagtcacttcattgaactgtacctgaattttaacacagtacaattgagttcctagagctccaatatgatgtaattaaactgtcagaaatattaacatcgatgttcatgagcgtcgttcatgatgttctcttggttctgatttattcagtgaggcatactgtcactgaagtggacttactgccattaaaaatgcctcatgtttcccagttccgcaaaaatttgcatcagtaatgaaacagagagatgtaatcagccctgcagttgtcaggatcttgatcctcttggtagtatttcattcatttcatcttcaccagataatggtagtttaaaaccgcaagaaaaatgaaactaaaaatagtgaatttcacttctttttctaaaggcataaacttaagcaaatagtgcatgtgtgtgaggggggaggaagagagagagaaagaggagagagagagtttgtaactattccttttctgctttgtgaccttaattcttcagcacccatttcctgtacttaatattgcaaagaggtttcctgtggtatgttaccaggagactcatgtagtctgaggctttttatctaccttacgttcttatccctccattctaataaaaatatgaagcctcacatccacctagaatatgattttgtcttaatggttagcattggcaatgattcttttagcttctgctgttaaaaaaaaaaaaaggaataaatgcaggattctaatcaaacatgaaaatccaagtggcatagaccaaagggaatgagaagcatatttaagtcatttagtcactggcttccgaagcagttccaagtcagatgtaaacctgaggttgtccctaattaagttcattatggttgacttgctaaagcaaggtcttgttttagatggaagtgacaatgtgcaaaacaaacagagcttgaatagaagttattttcactattggaagattgtatattatgaaaagttagtttcaaaggacctttaaagtttaattttgtttgcacctaagaaatttccctttaacttgcaaatgctgtttgaagtgtatttctttaacacatgaacaaacaatacagacacagattcacaaaatctacaaggagatttccattcccagtgaatatcatccatccataggtttctttgcttccagatcatcattctctcctcacataaacagtcaaaatgtttgtaatgtcttctttataaaacccaaaacataattatgataaagtagtcccaagtaacagaggaaaggaccataactctccaatatatgccatatctacagtttttagaatattcatatttcattacctatataggatatatactatttttatttctattacattggagtttaaaggtacttgagtttcgtttgtatttttggttaaatgtcaaaacaaagagtgaaaaaaagacctcagtgtctcaactcccttcttaccttcatgaagtgactgcaaagtgttcaattcttactcttttgtgttgaggagacagcactgcaagtgtgcagtaatacttattttattacatagaacaaagtttcacatttgtgaatggggcacaaaagagagcttgtcagttttacctttttcaattgactttttcttttattctttttaacttttaaatttattttttgtttttttgtttttttgtttttaaatagagacagggtctcactatgttgcccaagctgctctcaaattcctggcagcaaacaatcctcccacctcggcttcccaaagggctgggattacaggcatgagcgaccgcacccagcctgttttttactgtagtataatatttgtacatatttatggagtgcatttgatattttgttgcatacacagaatgtgttaatgatcaagtcagggtatttagagtattcattatctcatgtatttatcatttctatgtgcggggcacatttcaagtaactagtcaacttttaaaaagatacgcagtaggctgggcgtgttggctcacgcctgtaatcccagcactttgggaggctgaggtgggcagatcatgaggtcaggagttcgagaccagcctggccaatatggtgaaaccctgtctctactaaaaatacaaaaattagctggacgtgttggcgcatgcctgtagtcccagctactcgggaggctgaggcagaagaatcgtttgaacctgggaggcggaggttgcagtgagccaagatcgtgccactgcactccagcctgggtgacagagcaagactccatctcaaaaaaaaaaaaaaaaaaagatatacagtttttttttctccaagggtaatgatatagataaactactgtatggatttcttcttccctttaaagaattacttcctcattattaagcttgagggttttctttgttatttatgagcaagtgaaatgaatttataatggtgttaaaaatgtaatcatggccctttaatatctgttttctataaatgtaattttccattatttgtttttgcttttattaaggtgaggaagatcttctcagtcctccccaggacacaagcacagggttagaggaggtgatggagcaactcaacaactccttccctagttcaagaggtaagctccaatacctagaagggactcagatttgctgggatcaggccactcgcttccctacccaactggtgtgtgtattttccatatggaagccaacacgcagtatcagaatggcaatttgggtccatggtgaaaagatttgatttttaagtgtgaatttgtggtttagagtactctgaattcaaatacccgtgagggcaacatgtttccaaaaataagaataccaccctctatttgtcaagtattttacttgcttcacacattagtctgaagagttaattatgaggtgccctttactgaagagcaattattatgtgacttttacagatgaggaaattaatgccctgatagtgcctttgccagggacatatggctactacgtgctacagcaaggcctagaacaatgcctactgattggtagtggtagagattctgacttgccatctgatgccctttatatttaaaaattgtatcttactccatcatttaaatatagggacaattaaatcttcatagagtagttggttattttttacttcgatagaggaaatacaggcttagcaaagaaagacattaatatttttctttttcttcatcactttggccttgcgtattttacccccatacaaaaacagcattttaccctgcagaattttcccactggcttgcatgagcttcagatgtcttgcttcatccaagatgatgttttgctgctactgttcgtttctgggggcatttatttggtttattgccctcacataaaacaaagtcactctctcgccttccttcaacgaataaaaaggatggtggcagtcacctgtgatcaaatagaagaaaagcctagagaaacaaaagggagaaaacacaaggctttgtggccagtgattggcacctctaatgggtagcctgggagggacgggcagcaggaaatctgggctgtttgttcctctccataagggcaatgaggagggtgtattgagtagtgtgtttttcctatctttttgttcagtgtcagttaacaatggccatttcctagctatttgatgtgcaagtaaacgttgtgcagtgcacattaaaagcaataatgttctggtagagcgttgctaaggaaccgtcaggggaagctaattttaaatgtctgcaccagccatcttttcactgctgagcgccactgaagtgatgattttaacagataaaaatcttatctgtcttccacccacctccacatcccccaccgccacccgcatccccattctgactatcttaggtatctccttcttctagatgtcataattcataatgagaagatcatacacaggcttgacagaatcaggtgctttcacgtgtctcctcattactttgtcctgcttgcttttactagcacctactacgtaccagtggaggtagtagggatggaaagaagaaatgacaaattccttgccttcaaggtacttatggtcaattgcagatacagaactccaaagaaattcaaatcacagtacaatcattgattactgtatgatcctggccccttgaactggcagcttgcttacctgctctggaaagttgctggctgccctgttggcaccctgggcatttcttccacatctaaacaagaggttagtagagaagaagctacagcaaggctcatgactctgcttcttcataggcagccttgacttcctagactcctttttgtacctgagtttctggtccaccctaattagctgtaaggtgaaatcctttgcaccatctccctgtgtcccgcttttagagtccttaaagctagataccacatgggtgtagaagcttcctggaagacaagaaatatacctcctctgatatggtatttagcagtcagtatctctgatgttgatttacttacttgtatggaaacttgggaaactcaattcaggccacctggatagtgtttactaaattagtgcttacggaagaatttcaggccttaagtgctgatttaagttctcaaatgtgggagaaggaagccttgtccgataccaattccattaacttaagttccggcttactcagtggtacccttgtggcctgagaaaataaattcacattcttaaaaaacaaaacaattaaatacacaaaaaacacaagagagtagctaaggtattggaaaatctggcctatcattctgtaataccatgatcttggcatttcctcacgttttgctactttcagctaactcaggctttcttacaggcctttttctccccaaattcaagtggataaaaagtttcattattgtaaaaattaggctaattattgatgcactcaaaaaagtggtttttggatgctttctttccaactaaaagcacttttgttttttaattttgaaaaatggcatatgtgtgtgtacacacacatataccgtcaagtttggcaggaacatcttaccagttggtagatgtgttcagctgatattaagcagaaattcttgagaatcttaacatcttgggattacaaagtctttcaaatggaagagccttgaaaggtcattttaacacttttgacatccaggacagtgatttctgactctgttttgatggttatccatatcagaggaacattttacatcacaaactggggtaaagatataaaataaattgtacatgtgtttatgtacacacatgtatatatacacccaccatatgtacacacacacatttacagtgtcatatgcatacaaagatcagaaacaaaagtttcatcaagtgatgccttccatactacatacagtgcatgctgtttttctattttatttatttaaaaacaaaatgctggttgcaacccactaaatggattttctgaaccagtggtttaaaaatactaatctatgtgatctcagtttttcttgcctggttgaattatctttcaaaaaaatttaaattttgagatttttgccgtggaagtttctgccaagacgttgctaatgtctcagagacctttatagttttattctaacactaccatccatgttctcattgttgtgttacaaaaaacaaagttcatggttgctacagctgttttggacagctgtttgagtaactcaaaacagatgtgagagccagaggtctgacatttagtggaaatgtgctattaaataccaccgcgtggtttacttaaccctgctagataattgcccacagaggaaaagccgtttttaaaaaacttatgctcttcataaacataaagtatatagataggtaagctattatgtacctcaaatttacaacttttctgttgccccttgccacagagttggtcctgaaggtgtcagctaacctttctttatcttttattttcacaaagagtacctggaagccaagaaaagtcaagtgccttatttatggccattcagcaggttaagttaggcttctaatcttatcttaatggctttgctaaactgttatcaaaattaataaatgagtggcatgcttctccatttagtgataaaccgatggccaacactatcctgcataataggcaatataagcaggagcatattcaagatatgaatgtgtaaacattcagctttgtgattatatctttctggttggtctctagatatacttagttgttcacaaacacttgggagatttgagtggctcagtgtatatttgaacactgaatattagccaatttctatctaatctgtctatctctaatctcttcctttgtaagtatatgtgtagaaattgaattatagtgtaataagtcattatctactttactataaggtactctctaaagctctgccattctataggaaaactacatgggtacaataaacaaacgtaatttaaaaaataaccccattaagtgatttgtccataagtctctgatcatttagcagactaacaaagatatttttatatgtatgtgcattgatgaaagaaacgctctcctagtcagtagtatggtattaggctctctaaaatgtggtaccactttatatagatgaatgaataataggagccaagataagctcttaatgcagtaaaacaatccagaaagcagttagcagtgctactatttctgctacctgtacaatctcttgcctactgacctgtgccacattatctccaccagcccatgccatcctctttttttcataccatcccctctcaaataagcccgcgtacattctatcaaatacccctaaattaccaacccaacagctttgtaaaacctaccgtcttttaaaattaaaatcttattctgtggttcttttatggaagagcaacataaagaacaaaggcagatagaaatatggtgtgccctttttcaggcaccattctgtttcctgtatgctcccacaaaggatttgagcggttatccctttaatccaggactagcaaactacatacagcccaaatgccaaatctggcccaatacctgtttttataaagctttattggaacacagccatacccattcatttacatgttgcctatagttgctttctcattaccagggcagagtagttgcagcagtgctgaatagctggtccagagaccgtgggcttgcaaagcctgaaatatttactatctggccctttatggggaaaatttgccaatccctgctttacgctattatttcgttgtccattctgactcattacatgtatagagtcacaggcttctgtgctgatcaactttcagctgaacaagattattgagctgaaattgaattgatttatagatttatattcatattcaccaaagagcctgcaagtgtggccatttgaatttttttgacttataaaataacagaaatcctaaaaagggacttattcttccttaagtattttaaatagtcagtgaattaatataaaagaggctaaaagcacccagaaacagtactgtcctgcaattccaactctaaaataatgaattacaatcaataatgtcaattttatagtgcccgaggaaattagacttctcgggacctgaccaagccctttatttagactcaggactgccccagcacacttcccttttgtcttgattcatttcctgacaacacatcacattgccagatggacactgtaactgaaggtctacagaaactcatttccaaaaaaaaataaatgtttagaaaatgaaacatatctgaaactttatttatcggtcaagaacttttaaaaatgttgtaatcaagtagcctctgttttgtcagcgtagaactagtccttttacagtagaaaatatcatttgtttttaactttttctaaagtgaaaaaaaggaccttccttttgtaatgtgttaatgagtacgtggggacccaagtgatgagggaggattttagaagagattagagttagcttggctctgggaggtccattttcataaaatatggtttctgaagaaggatctggaacataacacaagtcatttgctgctacatattaagaaataatcaattgataactgagttctgaatatggcttagtgtagaattactaaagatatgtatcattaagcattcaaagaatcatcgttacattctgaagtacataaccataattacattctaaatcacatggctttctaacaacactgtccttcctaaagatctcaagttttcaaaactagaccaaagttacatgccgaaacaagttacccacctttggcatccaaactaaagtgtgccagtgaagggcaagttacttataacacagaaggactcctcttggtcatgacccaactactactttaccaattcacttcagccagtatttatcaaataccaaaagtgtgtatatacggtacagggcattgggcatagagaggtggatgagcaacatgtggaccccgtcctcaagaggcttatagtcttacaggggaagggaattaattctgccaccagacagtattatgaaacataaagatacttttttaaaaaaaccttgctaaaggaatcaaaaagaaggggtgagtgattcatactgggatttcagccatcaaggaaagaatgatgttctcctccccaaatgatgggaacatcatttggtatggatctcccactagtgacacccacagctgaggagctagtacccatttttctccctcttttccctggcttgaggagcatcttaaatacctggcccttacgtggtcaagctgaaaatctgatactcctaagaaatcgctgagtcatgtaggaaattcagaaggaagagaggaagggagagaaggagaaagggagggaagaaagagaaggagagagggaagaaaaacttagaaactatccttaaatgtatactagaagttttgaaccctaaccttgagtgagttttgaaaggtttctattggtgtcgtagctccatacctcttcattccagactagtagttctcaaattgtttcagggagtttttagtcttcttggagccactgagaatgatgggtggaggggaaagggagatgctgtacaggatctctcacagctctgctttgaactgctcaaaatattggaattccatataagattgttttaggagatgtcccattgctatagttaaaacagtttgaaaaccaagattttaaaggaaattgcatgcccaagacaggctattgacatgtatggacagaagtccctacttttctgtccaattatgacttatcatagaacactttctcatcagagtctacttttgaaatacaaataaatgcatacagatgtaggaatctatgaatcaaggccagtgggtctttagccattgcctcgtaaggctcctgatatttgctgaattggggaggaagtggaaagctcattcctggatctggctctgtggcttgcccattactgggacttacctcttcccctcatctgttctttctgttttctcaaatgcctccaatttcatcatggaaatgctcagcttctatcagatagaacaaattctcccaagaggatggagtccagcctctatgtcgggttctaccttgcatttgatgtgcagactttgggcacacagagtcaactactgtttatgtttcaatgtgctgattgtcaagagtgaagagattctgagactttttttaacattaagtttgagttgtccttgaaaacaatgcccaatttgtcagatttctattctgtgccagttttcatccagtttaatgcgtgaactctatggattttacaaatgacgtcttctggatcatgttatctgtttacactgatcttaagtgtatgtaaaggttatttgactagatgtgtcttttgggttttttgtttctgtttttttttttttttttttttccagcagagaataaatggtcatctcaacatttgtttggtaaaagaagcaaattggtatgaaattgtatatttatgcatgttttttttccctttctgatatctctgcctcttcctctctctattattaaaggaagaaatacccctggaaagccaatgagagaggttagtgagattcaggctcacggccatggcttctgtctgtctcatcctgctttttatgtttggcgtttgtgtaagaattgtgtgtgtgcacgcgcatgtgtgtattacacattgtgtcatcatgtaaggatggtagtcacctctccacttgcagctcatgaggaacattcctcaaatgttcattgccgttgtcatcaccatgacgacaagactggggttgggagcaagaatctctttaaaatggcaatcctttgtagtccctaggttggaatcctgccgttcatcatctgttgccatttgcaacactaacaaaatcttcaaaataaatttagccttgaacataactgatgagtcataaagctttcttccacttccaggaccttagcattttctgccagcgcccttagtttttattcttctgggatgacttcattttgcttttgtttccttttttcttggttcctacgctctttctctcccattttagcgaacattttttgagcacttactgtgtgccaagcattgttctcagcacttgccatctttttcatcatgtcatcttcatgacaaacctgtgaggtaggtactcttattaaccccgttttacagataaggagactgagtcaatgagagagtaagcagtgtgtcccaggtgacagagccaaggatttggatccaggcagtctggctccagacccacactcttaactctcatttgaaaggcttacatcatctcaacgtacccttcagaagatgatcttttttatttggtatttgaagccacacagaacaataaccaattcgattaaaaaattaaatattggagttttgagaggtttttaaaatgcctatttatgggttgaaagggatagggtgcagtcttatcactgaatgtggtttcaggttttacggtgaaagatgcttcttactcctattccaccaggaatattgtctgaatatcgaattacctaattaagtgactgttggatgacaaagtgttaactgacagcccaagtaaaatcaaggttgtctttaccaagaatttaatctgaaggaggagagaaggaaagctctcccatgggatgacagtgttctgggagacaggctggatgggtggagagtccttcttaaatgagaagattctggattccttagcaacaggatggactggagagaccactgattcatttaaacacaggagtcgtaatgaaaactctgccaacatcatgccatacaagtctaatcaatttaatgattcttcagtgtgtctgtgccagtgcctccttccaaggctttgggcagtggggccagggagggaatggtaggctgggaggagaaattgaggaaacctgacttggtgaagcattgaatgcccctgacggtttgcctggttcatgtacttcgtatgtgagacttcttgggttcattcttatggtaagtgccccttaaaatttattcattttaactttttgtagaaaaatgcaccataattttgaccaccttaaacatgtttcactcacaaatgaatttcagaaaaggctagcacatgtaattgaagttatataggcatttgcagacttgactacctgaggtgtatggtgttcagacaagtttccagaagccaaagaatcaaaacaataatgaccttttttaatgctatgaaaatatcccaaatgtacgtaaagcagatttttttcagagattaaattatagagaagaaaagataagcaaatttccctgtagtattccggctttcctttggacaactgaatgctaacaatttatttgggaattgtatttttaaaaaatagagcaccagattgctattgaggtcttggatctttgccagaaagtctcaattccaatcgctgtggaaaacaattccctcaggcagtggtgacgtgtgagactaaatgtgttgcagttagcgccaacttgaaaaacatacaactgccctaatgttcaaggcatagtgcctttgtgttcaataatccttaagaatggattaaatcaatactttctatagacatagttttctgtcaccttgtgcctgaaggtgattgcaaatgcctgaatcctggctgcttttcagtacctctcatacttcatagtatgagattgtaattttgactttagaaaaatctgtcaggtaacattaatgacctcccgaatgctctgccttacacacatggataatagaactaggatacaaatctactttctatagtcatgtcacagtgcagtcttacccctccaacggattaaagtatgattctttagggcagtagtttgtaaaaagagattgacttcttttttctggatctaatgaaaaactccatggaaagaaattagaattatttattctggtaaagcaggtatttagtgaagtaaccaaaggcataatatagatgatgaggtgactctaaaagttctttatttttatagcacaaagatggccacaaggtcatttgtgaaaatgcagcagtgtaaaccggttaaaggccacccaactttttgtcggagtgtgcatggcacattaagaataatgaacctgttttccctggcaaatctttaaatagcagatacccctagaacttatgcttcttgagagactcaagaattttccttccagttagtaactgaacaccatttcaaggaagagaagcaccacttggctatataatccataaatgcatttatttgttttattatattttgaactgccatctacatcccctagcacacagcctaaaaagaaagacactttgtgattatcgataagctgacaggaaaaaaaatgagttttctccccttttcgttgatgttttgtaatatgttttctagctactaggtggactacatactatagtcacatgtgggccatgagaaatacttcgaattacattcaggcaccatgttgtaaaggtcctggactttgtttttactgattttgttaaccgtaaagatcgctagtaattaaaaattggcagttagtccatctatcttcaatttatgcatgaataattatgcagatttcccagggttgctggacagccaaaaatagatacaggggaagccctccaacttgatagcagcagttatatatttgtactctgagctctaaggagcagcaaaggccccactgtgtcgtcttcctgtggtttttatggcacagaaagccaaaaatgatttcagttcttcactgagggctgccaaactattggcccactttatgaatagttgcatatgctttgttaaaaaatttttatacttgcagtctcagccaaaatccaaagtgattttctaaaatataattaatactccatgaaattctttgcactaataaagcacaaaaagatagatatacaaacttggtcaccttaatagaaatgcctgaatgacattaaacttttaataagtaagtcttcagttgatctggtgccatcactgtttaagtgcctgcccgtgaatccgcttcattttgtagagaagctatatctcttgaaataaatattaaaacaaaatactctccctagtctatagctttaatttttattgggatatctttaatttttattggtatttttaacaattattatgggaatctgtaaagttgatacatggcaaggtagtaatagcctagtaaagcatttcagttccaaagacaatacttgaatagtggaaggatttaccaatgtgcaataattaaaattagccatgtaaaactatgggacatagacgaaaaggcaagccataaagtaagtctcagattatcttactctaaatctgaattttgctacgaagtacccagggacattgtgctgttctttttctccgtgctgggagattcgtgctaggtcgtgctgcattattagtaaaaggctattgtgatagttaaccctcatttaggaggagctctaagatggattcacaaaatacccaaatgcatacaatacatgtgggtcaccttataattagggtctagagtaatttggaatgtaaagcaatttttattctgaggtttcctaattcaaatgttaatagtgcaccaaaaggtcaattcaagagtttattattattatttttcaacccaagtaaaagcagagagaaaatagccacctccaccatagcctcagaagcaagccaacagcctgaaacagctttgaaatgaaaagttggtgtggcggtgatggtggcagtgataatggtgacgatggttgggtgctggtgatggtagtggtagttgtgaaggtggtgatggtggtttgattgatagtaaaaaaaatgttcgttaatacaagtagagagtaagtaatcaatcaatcactcatagccaaggtggaaaagatgtatcccatcatggaatattcctgttctgatagaaatcttgtgcttatctatggaattcttttgatatatatttacattgggaacctgaatgtagcttgacatttttccatgttaacaccagtagcctgatccaacattaagctgatactaacaaacaacgtgtaatggcttcattaataaggctttgcttcttcctggaaactggtgaaaaatcaaaccttgttgtgtacaccctcgatgcagcttctgtgttgtcttcacccagaaatggggaatgatttcccaaatggcaaagaaacagagtgatgctatctatctgcaccttttgtaaagtctgtctttctttctctttgttttccaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaaaacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaagtattgactggactgcagtactttgtttttattttaatttagttgttgttacttacttactttttaaataggtaatacatgcatatgagtaaaaaactataatccagaaagacagtgaaaacactcctaactaccccttcccccatatcaatcaatcatcctcattgctctatgagtagacattattaatttcttatttagtcttccagagggtctttctttattaattattatataagcagttaaaataatatatatgttcctatttatttttttcctattattatttcataggatatagcattctctgcacccagttatgcaccttacttgtttgtttgtttaaatttaaatatggactcaagaaatcttttcatttaaatatataaaatgctttctcattcttttttatagctgtataatatttcattatatgttcataggatattttatttaagcagttccctttggtgggatatgtagtctgttgtcagtctttcttttgctataacaaacaatattgcacatttctcattacatcatttcatttgtgcataaacaaacaaatctgtgggatacttcctagaagtgagattgctggatcaaagggggtaagcatttgtagactgggagatgatacattttgtgcagtgattgattgattgatagtcatagtgtttgtttgtttgttgtgttttttgttttaataatgacaagtatattaattaagtcagtttgcagttcatactttgcttctcaagagaatttcatatcacttctattcttaatgtcaccatctaagaggatgcatgagtgagtagtaagaaagagacacctaaaatgatgtctcacaactggttctggggaagaagaatcccttaccatagtcaaccaccaccatggggagaacctctcctttgcccctgccctgctctgtttcttgccctagctgcaaaggaagctgagaaagtgggtagcaatgtcagcacttcttagggagaggctatctatctttacctattcccaaggttcatggatggggtgggcggggttccccaacagtgttcagatactggtgagccaaaggaataacataagtccaccaggtgcagcctatcctagtgattttggaaataataggagatgagatgatccatctcattagaaatgatgtttgttagtagatgtggcatctctgctgtgaatcaatcacttgctaattttttgaaagtagggtgatgatgctgacctaagtgactaccacattgaaacacttcccttgacatccacacataccaagaaaaattttcatcctatttaaataaacaaatcatttatccttcccaccattacccgaacctacctttgtttgaaacacccagactggctgttttggtgacacttaaggaggtaactgaggaatcttcaatacttcaccacgtctaagacaactgtgtgtggatgactctgaggagggcatttggttttccattccatacttggcacacactagaagagacagaattaattcagttaaaaattaaaatgaatcgagctggcacagattatgcaccggcaagcaaaatgtgtgtttgtttgggagaaagcaccaagactaatggatgtgttctgtagagctgcgatgggatttccctgaatttgtaatgctctaatggtggaatgaatacaaaggcaggcactggcgcacttgcaaagactttgccttcaaattaagtgtaggaaggacacaaatcaaattctttcccacagtagcaaagccattggagtaggaactataaatatgttcttcaatgccccttgcacgtcagtgtactgtgatctcatggacttagctgacaacacaagagtggcagcatgcccaacattccataataaacaatattgtgtgaatgtgtaaagtttggggatgtttgtttgagagtagcttttgtgtacagaaaaggttacctacagtaacttgaggtttaaatgtt

SEQ ID NO: 14574 - DNA, 393753 bp, Human; identical to SEQ ID NO: 14573
  misc_feature (1)...(393753): n = A,T,C or G

SEQ ID NO: 14575 - DNA, 32278 bp, Human
aaggttttgattaagggctgctcatcctcccaagtcggtggtaccagctcacctggtggatgggctccttcctttttatgccaagagtctctgatgcctccttattttccacttgggagaaatgtttcagttcacaggtggagaagaaggtcttccttagtgggatcccagtgccagagcaccaggcccactggcctggagaagattgaagggaaggttggaccaataagctgcgaacaaaggttgtgggtgcagacaggttggctcttacagtcgagattcagcctctggactgctgctgggggagtgggggcttcgttgggctaaggcttggggtgatggctacagggacacctccgacactggtggtcacaatgagagggctgcccactgctctcatctaataagccaggcgagtccaacactggggatagagatgtcatttgagaggcctcccccacccacatccctaccccatccctagtattctcttctttccagcaggttagacaagttcagccacattttggctttcaaggctcaaatggaagaaaacaaaaattccccagggcacggtggcctgagatgtctagattcacatccagaaccctttctgtgggaagggaactcctggcttcctttcatcagcactggctcaccaagtcctgcgtggccagaacttggcaggttgccatggatacctggaagtgctgtcccagcagacagcagaggcttgctggggccaggagaatgtgggggcacctgaactgctggccagaaaggctagataaacaggcccccctgccaccctcattttgatcagaccccctccaccagtctcctaaaacagggctttccaaactttaccgggcacaggaatccccctctccgccgacctagttaaaatgcagatgctggccgggcgcggtggttcacgcctgtaatcccagcactctgggaggccgaggcgggtggatcacaaggtcaagagatcaagaccatcctggtcaacatggtgaaaccccgtctctactaaaaatacaaaaaattagctgggcatggtgtagtcccagctactcaggaagctgaggcaggggaatcgcttgaacccagaaggtggaggttgcagtgagccaagattgtgccactgcactccagcctgggtgacagagtgagactccatctcaaaaaaaaaaaaaaaaaaaaaaagcagatgctgattcaacaggtctggggcgggaggtagaaggcgctgagattctgttttcctaacgagctctcaggtattgctgctggtccaccggccacactgagtagccagggcctaaactgagtcctggtgggtttcagaaacctcagccagattctgaaggtcccattcctggacccactgccttaggccaccactaccagccctaaccccagtgggaacctcttgccttcttgtagtggaaggactctctccagtccgtttttgtatcattcaccatcaaccacttcaaagaaaggaaatcagcagccggcattttggggaaacattttaagctgtcctgtcccttctccagctctccaagttatataatgcgtccttgttgaaaatgctgataatgctgtttgggtggcaggaagccaatttcaggctacatattgcttggggctggggctggggtcagggaacggggcagggtctggggaaggtttaaggagagaaaggggccaggcagatggagagaggacaggagggccagggtggtcaaggcccggggataaagccgattggtatgtcagcaaaatctgtcactggctttagtgattcgaaaggcagacacattctttcatctctgttaatcctcatgtgatacagaggattttcctgccattaaatctggagaaagaaaaataagcactcaaacctgcacaagtaactattcctcttcaccccttcctcccgtccccccacccccacctttacttctctctcaaaccattttcagcatctgtggctgcctgacttgggagatggatgggctgagggagtggagggggacctcagaggagcaggaccagggagactcccaggacggtaagcaacatttgaggaccattcactaacgcttctctgcaggggtttcctctccatccatttccttgctgggttgtcagtgatgccatctgagttgctgtcagggctgtagcctgacaaagggtttcctaatagatccaaactgtccatttgtggggagcttctgattttctgttgttactggtttcccttagcccaacaccagggtcattaagaaggaaggaatgtgaggaagaaagaaaggcagggcattcaggaagaagtgtggaggcatgggagggttctcatggggccctcctgggcactgggtgacctgtcctttctcccctcaggtaggggtcccacggctgggtggtcctaagccactgggtggatgaaaggccgagggatgttggtcctgcttctgcatggtgagttctcctgccggtgggtgcaagggttgggaagaggggtggaagccacagagcttctgcccaaagagtctttaaagtggcttctgggacagcggtatctggacacttctgatcaggtttcactgaccctgtgatcgtgggggaggggatagagaaagcaagaaaacagcaggtggtggggatttttgtttcctaaaaacaaaactcctgagccgaatatatgaaatagtcctcttggtgattttcttattctaatttcagatatgaattcattggtgtgataaccaaaagctacagtgctacagtgtttttttgttttgttttgtttttggagatggagtctcgctctgtcacccaggctggagtacagtggtgcgacctcggcacactgcaagctccgcctcccgggttcacgccattctcctgcctcagcctcccgagtagctgggagtacaggtgcccgccaccacgcctggctaattttttgtatttttagtagagacggggtttcaccatgttagccaggatggtctcgatctcctgacctcgtgatctgcccgcctcggcctcccaaagtgctgggattacaggcgtgagccaccgtacggtggttttttcttttcttttcttttctttttttttttttttgagacagagtctcactctcgcccaagctggggagcagtggcatggatcttggctcactgcaacctccgcctcccgggttcaagtgattctcgtgcctcagcctcctgagtagctggaactataggcacctgccaccacgcccagctaattttttgtattgttagtaaagacggggtttcgccatattgcccaggctggtcttgaactcctgacctcaggtgatctgcctgtctcggcctcccaaagtgctgggattgcaggcatgaaccaccgtgcccagcctacagtggtttctaatcacattattttaagctcatttagttaaaaacaaaagtccctttaaaaaaccaccttcctaaaggaaaaagaaaaaatgaaaaatgccttggaattataggattatggatattgaagttatttttcaaagtttctcgctctgttatgtgcactttaatataccaagaagactcgttatgaaatattttccctggctctagctgttccaatctgactgagatagcccaaggaaaaatcctttaaattcttcagtaaatgattctacacaaagaatctgtttttttctgaccctcaagtgaatttaattatttgagatatgatgatctatgtaatagacctctgtatgcgatgctgatagagaacattttaccagatcatctaaaacaggagtaatggagttttcttcctctttattccaccttttcaaaaaccggaacttgctctgttcagtcaaccaacaggcatacactgtgtgccttcaaaacgctcgagagatatttatgagggatataatagcatgctctttgtctttgagaaaattcttttataagagattcaataaataagcaataaaaaaaattggagcaaggcacgtggaacactgtgataaataggacatgacttcctacctcgaagaggttctaaagaacagaggttgatatttatataattactaacagtcaacttcttgccattcctcctaccttgaaaaaaaaatgaaacttgattgactcattggggcacaatgtttgcttccaacagccagtatcattttaaacgtgcaccaaaagctctaccgttcctcacagaaagcagaccgtattcatagcctgcacacttcaaaacaggaactgtccctgctacagaaacccgaaatatatccagacttcttgtgacaagttggagagctcagcggtgacatcatttgctaacaatagatgcacttaaaattaatgaccatctccacatcccctggcactttaatttaaaacacactctagcaagcacagagaatatttctctgactgcgagtcacaagcaatacggacaatatgttcccgagaagcaggcagggatagtgctctacctccttggccagaaagaaaatgactaagtgagcctcacaaaacaacaccttggagaaatcagaagtggctcgcagcagggaaatttggggcaagagaaattctcctctggacacacagggctcctggaagtgccccacttctcagatgcataagtgcaaatacctccacctcctccccccatgttaacccctggggtcttcccgctgttcacagcataatatctgaaacccttaacttcttttacagggtctttcacatgtgacttcctctacactgagtcttcaaagagagtcaggggttgtgtgtttgtgttttttgtgtgtgtttcttttgagacagggtctcgctctgttgcccaggctggagtgcagtggcatgatctcagctcactgcaacctctgcctcccgggttcaagtgattctcgtgcctcagtctccagagtagctgggatgcgccaccaccacacctggttaatttttgtatgtttagtagtgatggggtttcaccatgttggccaggctggtcttgaactcatggcctcaagtgatctgcctgccttggccttccaaagtgctgggattacaggtgtgagccaccgtgccccaccaagatttgcattttaaaggaagtctataggaaaataaaatcacaatgaggtgccactcacacagctagaatggctacatttttttttttttttgagacagggtctcactctgtcgaccaggctgaagtgcagtggtactatctcgactcactgcaacctctgcctcctgggttcaagtgattctcatgcctcagcctcctgagtagctgggattgctggcgtgagccaccacacctggctaatatatatatatatatatttttttatttttttttttttttttttgggtatttttagtagatagggggtttcgccatgttggccaggctggtcttgaactcctgacctcaagtgatctgcccacctcggcctcccaaagtgctgggattacaggtgtgagccaccacgcccagccataatttttgcatttttagtagagatggggttttgccatgttggccaggctggtctcaaactcctggcctcaagtgacaggctcaagtgaggctgcctcagcctcccaaagtgctgggattagaggtgtgagccacaatgcccagccaagaatggctacaatttaaaacactgacaacaccaaatgttggtgagaatgtggagtaactggaactcccatacattgctgctgggaatgtataatggtgcaaccattttgaagaactgtttcttagaaagtgaaatacatacttatcatataactcagccatcccactcctagataaatgagaaacaaaaacacatgtcacagctttagtcacgataggctgaaactagaagcaatgcaaatgtccatcaacaggtgagtgaataaacaaattgaggcacctctatccagggaaatactgctcagcaatagaaaggaatgatcaactgatattcatgaccacatggatgaactttacagaaggttgtgcaaaataagcatttgatttcatttccttttgagacagagtcttgctctgtcgtccaggctggagtgcagtggtgtgatcttggctcactgcaacctccgcctcccgggttcacgtgattctcgtgcctcagcctcctgagtagctgggattacaggtgccccccaccatgctctgctaatttttgtatttttaataggcatggggttttgtcatgttggccaggctgttttcgaactcctgacctcaggtgatccacctgtctcggcctcccaaagtgctgggattgcatgcgtgagccactgcacccgaccttgatttcatttctgtaaagttctaaaacaggcaaaactaatctatagttcagaaagcaggtcagtggttgcctggagccaggggtgggaaaaggactgaagtcaaaggagcctgaggaaactttctgggtggtagaaatgttttaagtctttttgctgttgctgttgttgttgttctgagacagggtcttgctctgttgcccaggctggagtgtagtggtgcgattatggctcactgcagcctcaacctcctgggctcaaaggatcctcccacctcagcttcccgagtagctgggactaaatgtgcaccaccatgcctggctaatttttgttttttgttgtagagatggggtttcgccatgttgccctggctggtcttgaactcgtgacctcaagcaattctcctgcctcggcctcccaaagtgctgggtgcccagccagaaatgttctaagtcttgattggggtggtggttacacaggcatgtgtacatttattatacttactgaactgcacgcttaaaatgggtacattttattgtaagtaaagtataccttaatcaacttgatttaaaagaaaaaatgaaggctggagggagagagtggctgtaccagaagcagaaaaaatgcttcactgtccacagtcaggcagtgtggtatatcaggcaacatgtatgtgagattcatcaacgttattacgtggattagagtagtttttccttttgaatgcctagtaatattcatttgtacagattgactggttagtttatccattcccctattgtcgggtgtttgtttccagtttgaggtgattgtttatatttaggcccggaggcctttctggggccttgcgttcttctccttagatgggacagatgttcatcttcaagtttcaccaggcctgcgaggctaccagcacaccacccctctggaaacattgacttctccatcccttatgactcacgttagccagcaaaactgcagctcgaatcctttctttcctgtcacaaaaggtacctgcatggggtgaaaaccaagttctggggtcacaggaggccagaggccacagcatggtctccgcctccgcacttctgtttcctccagccagtcttgttttgaagatccagcattgggttttggtccgaggagccacttggtagcatttgccaagaatggaaggaaagtgatttctagagccaaggtagctaaatagattttgctgaaaccagaaatttgaccatgttttcccttgctatttttggtttcataaggctcaagttcttttaaaacaatgagaataaagaaacattccaatctcagtctgtggttggaaacaccaagtagctgttctcctagcaaacctcaaggtgggaaagcacatatttgaaaagccgagggcttaggaaagagaaactgctcagatggtctgcattagacctcattatgcgggtgcctgaggctggccatccctgcctccttgcagctcgggggctggccaggacacccgatagggacacacaggcagggagccatttctggtgtttattttcccagattcagggacgccttgtaagatttttaaaaaactgaaggaaaattcacacaagataaaattaaccattaactatcttattttcttcttcttcttcttttttttttttttgagatagagtcttgctctgtcgcccaggctggagtgcagtggtacgatctctgctcactgcaacctccgcctcccaggttcaagctattctcatgcctcagcctcccgagtagctgggactacaggcatgcaccaccatgcccagctaatttttatatttttagtagagatggggtttcaccatgttgccaaggctggtcttgaacccctggactcaagcaatctgcctgccttggcctctcaaagtgttgggattataggcgtgagccaccgtgccaggccttcattcctttttaaggccaaataatattccgttgtatagttatgccacatttgcttatccatccattggctgatggacatttgttgtttctaccttgggctgttgtgaataatgctgctgtgaacgtgcatgtgcaactgtctctttgagaccttgctgtcaattcctttaggcatatgcctaggcatggaattgctaggtcatatactaactctacattacactttgtaactctttatatcacacagatgaatcccatttttataaaattggtgcatctagacctttgatttttgactttggctgcatatggtaatcacctgtggagcttcaaacataccaatgcctgatcccacccctgaagattctgatgtaattgatctgatgtatggcctgggcactgtgagttttcaaagctccacaaggtgattctaatgttcagccctggaaatgaaccatcctagactccagactcctctttacagcctatccctagtaatagcttcagtattctgacaactggtgtcttgctttccattctagggcagatttccacatggtcccttttttttttgagatggagtctcactctgtcgctcaggctggagtgcagtggcgtgatctcagctcactgcaacctccgcctcccgggttcaagcaattcctctgcctcagcctccggagtagttgggactataggtgcatgccaccatgcctgaataattttttgtattttcagtagagacggggttcaccatattggccaggctggtcttgaactccttaccttgtgatccacctgcctcagcctcccaaagtgctgggattacaggtgtgagccactgcgcccggctgatcctttttttttaagatgggctctcactctgtcacctaggctggagcgcagtggcacaggcacagctcactgtagcctcgacctccttggctcaagcaatcctcccacctcagccttccaagtagctaggagtacaggtgtgcatcaccacgcctggctaatttttgtattttttgtagagatgaggtcttgccatgttgcccaggctcatcctgaacttccgggctcaagtgatcttcccaccttggcttcccaaagtgctgggatcacaggcatgagccactgcacctggcctccacatggtctttgaaggatttgtgccttagtgaggtttaatcctgtgacaagaatggttcataagagcccacaactagcttgggccagtgttttcacagctgtgtcaagcaacgagacacatctgtcccccataactgtctacaaattacagatgaggaaactgagagacagaggttgtctgaggtttttgtttttttgtttttttttttcttttgagacagagtctcactctgttgcccaggctggagtaaagtgttgcaatctcggctcactacaacctccgcctcctggattcaagtgattctcctgcctcagcctcctgagtagctgggattacaggcgcccaccaccatgcccggctaattttttgtgtttttagtggagacagggtttcaccgtgttggtcaggctggtctcgaactcctgacctcaggtgatctgcctgcctcggcctcccaaagtgctgggattacaggcatgagtcactgcgcccagcctgaggattttttttttttttaaagcagtatgacagaacagggatgagagtgtcctcagagtttatgagagaactaggtcaagaggctgtgccctcggggtgagtattttaagaccgaatgttctggaaagccttgcatgtgaatcccggggtgatgacagaggctggctgagtagggacctgtcatgagcccagggcagtcctgctacatttatttctcatcttcccctccctacctcagactgggaaaaaaaagctctgaagcctttttccgatttccagatggatccttccccaaaataccggtgcaagaagagaaattgctaagcaactgccaaatgagtttcaccttctcttttcacaaactgtaatctttatttttaatgtggtaaatgtttttctggccaaggtattcccatggaacccagctctgaatagccaaggagattcgtttttggaatgatcactgctgattctgggagaggctattttttcatttggattcagcaaaaccagggatgtcctaaacagtgtttgatttgatgttatgtatttcctgtcagcgaatggggagcagtttccttttggttgaggggtgctgcatggtcctgaatttgagttgttttctctgccaaggtgaagaggtcactggctgggtgcggtggctcatgcctgtaatcccagcactttgggaggctgaggagagcggatcacttgactaggcggttcaagaccagcctgatcaacatggtggaaccccgtttctactaaaaatacaaaaattagttgggcgtgatggtgcgtgccagtagtcccagctacttgggagactaggcaggagaatcgcttgaacccgggaggcagaggttgcagtgagctgagatcctgccattgcatcacgtggttcttcaggaaaaggaggagaggccaggaagagggagatggttctagagagattaagggagcctgtctgattcaggatattgctcaggactcttgttgcaaagcatctactctaggtcattgaaggcaagaaggagtttacttagggacattaggtattctcaggcttcctactagaggccacactgcccagagcaatgcctaaaccaggaagtgcacagctccagcaaaaatcctgtggccactgccattggtggccatacctggcagctccagggaatcatgttgggtactgggtgccagaaatgcaagcctaaaagcctctgccatcattctggccagacattggtttctgcctggtgcctacttctgaatccaagtcttactgggtgtttgattgacaaagctatgtcacatgcctgagccctaactgtaaagggagttgagaaagagagtttccggcttccatcttgaggaggcaggacgtatgatgttggaaattctctaaatgtagaaagagtgcttaaaaggtactcaggagccagaacacatgctatggtctgaatgtttctgacccccattccccacccaattcatatattgaacccaactccccaagatgatggtattaggaggtggcgcctttaggaggggattaggtcctgagagtggagccctcatgaatggaattagtgccctcataaaagaggcctcagaggccaggtgtggtggttcatgcctgtaatcccagcactttgggaggctgaggcgggtggatcacctgagctcaggagttcacaccagcatgggcaacatggtgaaaccccatctctattaaaaatacaaaattacctgggcatggtggcgcatgcctgtaatcccagctactcgggaggctgaggcaggagaatcgcttgaacccgggaggcggaggttgcagtgagccgagatcgtgtcattgcactccaggcttgggcaacaagaacgaaactccatctcaaaaaaaaaaaaaaaaaaaggcctcagagagctcccttgccctttctaccacatgagaacacagtgagaagacaactgtctatgaaccaagaagtgggcccttggcagacgcagaatctgccttgctcttggatttgccagcctccagaactgtgagaaatcaatttctgttgtttgtaagccaccgagtctacggtagtgtgttatggcagcctgaactgattaagacaatacaccagcttcttcaccttgcccttggctcctgctcccccataactttgacctgcacatggctttggtacaaactccagccccaaagctagacaggttggtgctcacatcaccttactgactagttattcactgcctattccattttcacggagaaagaatgaatctgattagctctgtttaggtcaaagtgttcaactgcggtgcaaacagctgtggttgggaggagatggcagagacacatggggctctgagtagggtatttttttcttagaggcagtggctggcaacacctgctgtcagaccgtggaaaatgaaagctacaagggctctcaaagaccaggatgtgcagtgtcttagtctatttcgtgctgctgtaacaatactagagactgggcaatttataaagaacagatatttatatcttacatttctggaggttgggaagtccaggattgaggggctcacatcaagtaaaagccttcctgcggcgccatcccatggtggaaggtggaagtgtgagagagcaagatggggctgaacctgcttttattacaaatctacttttgcaataataacattaattccttcatgagagcagaggcctcacgacctaaccacctcttaaagagcccacctctcaacactactgcagtggggtttaagtctccaacacgtgaacttaggaggacatattcaaaccatagtatgcagtttcttcagtttacagttaaagcaatgaaatctcagaaaggctaggtgtgtggggtgggagatagtacagtatagtgaaaaacaaacaaaggttggcatcatttaaccgtcctgaacctcagtttcctctttcatgagaagagaagaataatccttatcttgcatggctgtcatattaaatggaataatgtctatggcaagcttagccctgagcaaattctttttgagacggagtctcactctattgcccaggctggagtgcagttgtatgatcttggctcactgcagcctctgccactcgggttcaagtgattctcctacctcagcccctctccccctgagtagctgggactacaggtgcgtgccaccatgcccagctaatttttgtatttttagtagagatggggtttcaccatgttggccaggctggtctcaaactcctgacctcaagtgatctacccacctcagcctcccaaagtgctgggattacaggcatgagccaccacacccggccctgagcaaattcttattaaaagctggttgttggccaggcgtagtggctcacgcctgtaatcccagcactttgggagaccaaagtgggcagatcacttaaggtcaggagttcgagaccagcctggccaacatggtgaaaccccgcctctaccaaaaatacacaaaaaattagccaggtgtggtggcaggtgcctgtagtcccagctacttgggaggctgaggcaggagaatcacttgaacccggcaggtggaggttgcagtgagctgagatggcgccactgcactccagcctgggcaacagagcgagactccgtctcaaacaacaacaacaacaacaacaaagttcgttgttttaagagcaaaagaaacccatacaatttaattaatttgagtagcattatacatgttcatattacccagataacatatgttaccacagtacctaaactatgtcctgtagatatttgctgtcatttgggggtgcttccatctgtaggtcttgttctgttgagctgccccgagccactcccagcagctctgttctaggactgcacgtaaatgtcatcatataggctgggtgtggtggcttatgcctgtaatcccagcactttgggaggccgaggcaggtggatctcctgaggtcaggagttcgagaccagcctgaccaacatggtgaaactccatctctactaaaaatacaaaaattatctgggtgtggtggtgggcgcctgtaatcccagctactcgggaggctgaggcagaagaatcacttgaacccaggaggcggaggttgcagtgagccgagatcatgccactgcactccaggctgggcaacagagcaagactctgtcttggggaaaaaaaaagaaaagaaaaaagaaaacaaaaagtcatcgtatagtatgtttcttttgtgtcaagtttctgttaacatgtttttattgcttgtatcagtagtttgttccttttattgctgagtagtattctactgtacaaataaattataatttatttctccattctactgttgggtaatttctactttttatcaattataaattagcctctatgaacactcttctatagtctttttgtggactttttttttttttttcatttctcttgggcaaatacctaggagtggaattgctgagtcatatgataggcatatatttagctttaatagatattgccaaagttttacaaagctattgagctattttacactcccattgactatgtgaaagaatctagttgttctccatcctcatcaacatatggggttatcagtcttttgaattttagcagaaaatctcactgcagttttaatttgcatttctctgatggctaatgatgctgagcaccttttcatgtgcttaatggccatgtaatatattctttttcttttttttttttttttgagacaaggtttcactttgtcacccaggctggagtgcggtggtgccatcttagctcactgcagcctctgcctcctgggttcaagcgattctcctgcctcagcctcttgagtagctgggattacaggcacccgctaccacatccggctaatttttgtatttttagtagagacggggttttgccatgttggcggggctgttcttgaacccctgacctcaagtgatctgcccacctcggcctcccaaagaagtgttgggattccaggcgtgagccaccgcacccagcctattcttttgttaagcattcaagtcttttatccattttttaaaaataaattttaaaaattttattctttttctttgctggcaaagtgaaagcaatcaccgatttttacttagttgtcttttcattattcatttgtaggagttatttttacattctgtatagtcatatatataacacatacatacatacatacaattcatatttaaagtgtatcctcacgaaaccatcacctcaatcaagataatgaacatatccatcacccccaagaatcatgccccattataatctctccctcctgcccttctttgcctccctactcatccccaggcaacccctgatctttctgttactatagattagtttacagtttctagaattttatgtaagcggagtcacacagtatgtattttttttttttttttttttttttttttttggtctggctcctttcactcagcagaattatctatcacgtgattcatccatgttgcaggtatcaatagtcattcctttttttttttggcaattttaacattatttttttctctttcattttttaaaatttccataggtttttggggaacaggaggtatttggttacatgagtaagttctttagtggtgatttgtgatattttggtgcaatcatcacctgagcaacaaacactgaacccaaattatagtcttttatccctcaccccctcccaccctttccctctgagtccccaaaatccattgtatcattctcatgcctttgcatccttatagcttagctcccacttatgagtgagaatgcatgatatttggttttccattcctgagttacttcacttagaataatagtctccagtcccatccaggttgctgcgaatgccattaatttattcctttttatggctgagtaatattccgtcatatatatatatatatatatatacaccacagtttctttatccacttgttaactgatgggcatttggggtggttccatatttttgcaattgcgaattgtgctgctataaacgtgcgtgcaaggatctttttcatataatgacttcttttcctctgagtagatacccagtagtgggattgctggatcaaatggtagttctacttttagttctttaagggatctccacactgttttccatagtggttgcagtagtttacattcccaccagcagtgtagaagtgttccctgttcaccacatccatgccagcatctattattttttgattttttgattatggccattcttgcaggagtaaggtggttttgcgttgtggttttgatttgcatttctctgatcattaatgatgttgagcattttttcttttttctttttttcctgagacacagtctcactctgtcgtccaggctggagtgcagtggtgcgatctcggctcactgcaacctctgcctcctgggttcaagcaattctcctgcctcagcctcctgagtagctgggattacaggcacgggccaccacgcctggctaatttttgtatttttagtagagacggggtttcactatattggccaggctagtcttgaactcctgacctcgtgatccacccgcctcggcctcccaaagtgctgggattacaggcatgagcctccgtgcctggccaagcattttttcatgtttcttggccatttgtatatcttcttttgtgaattatccaatagtcattgctttttattgctgagtaatattccactgtatggctatatcatttgtttgcccattcaactcttgatggacgtttgcactgtttctagttttgggctattaagaataaagctgccaaagtctttgtatagacatacgcttttatttccctaggagtagaatggctggattataaggtaggcatatgtttaacttttaaagaaacaacctcattgtttccaatttggaagtcccattttacattccaccggcagtgtaagacagtcccacctgttccacatgttctccaacacttggcacctgttttagtcccttcaggctattgtatcaaagttccataaactgggtggcttataagcaacagaaatgtatttatcacaattctggaggctggaagtccaagattggggtgccagcatggttgggttctggtgatggctctttcctgggctgcaggctgctgtcttcttatagtatggccagtctttctaattttagccattctaataggtggctactttaatttgtatctccctaacaactaatgatgttgagcatcttttcatgtgcttatttatcttctgtctatctttttttggtgaaatgtttctgcaaatattttgcccatttattaattggattattttcttattgagttttgggagttcttcatatattttaaatacaagtctttaatgagatatgtgacttacaaatattttctcacagtctattgcccgtcttttcatttactttgcagtgtctttgaaagagaagaagttttaaattttgatgaagtctagtttattattattatttttaattttatggttattgctttttcttcttctctctctctttttttttgtcccaagaaatcttcacctacctctaggtaacaaagatactctcctgtgttatctccacgaagctttgtaagttttagcttttacatttaggtttacggtccatctaaaatgaattttgcgtatggtgtgaggtaggtgttgagattctttttactttccagggattacactatgcatccttgtcgtggtctaccttgaattaatcttgtattgcttcaagtataatgtaagatccttatgagagtacaattcaattcacctcccttctcatccttcatgtaattgttgtcatagttttcatttacgtgttttaaactccacaatacattgttatttttgttttaaatagtcacttgtcttttaagcaattaaggtgagaaatagtagtctctttttttttttttttctgagacggagttttgctcttgttgcccaggctggagtgcagtggcgcaatctcggctcactgcaacctctgcctcctgggttcaagcgattctcctgcctcagcctcccgagtggctgggactacaggtgtgcgccaccacacccagctaatttttgtatttttagtagagacggggtttcaccatgttggccaggatagtctagatctcttgacctagtgatctgcccgcctcggcctcccaacgtgctgggattacaggcatgagccaccacgtccagcccaatgcctggctaattttttgtatttttagtagagacagggtctcatcatgttggccaggctggtcttgaactcctgacctcaggtgatccacccccccatcggcctcccaaagtgctgggattacaggggtgagccaccgtgccggccagtagtcttttatatttagtaacatacttaccatttccatcgctctttattccttcttgtagacctaattttcatctaccagcattttctttcagactgaagaatgtcttcatttcctgtgcagaagatctgctggagaagaattttctcagattttgtttacctgaaaatatctctattgcccttcatttctgaagatatttttactggagagagagagaattctaggttgccaaattttgcttttcattcagcgcttaaagagcactaatcccattctttttttttttttttaaaacaaggtctggctctgtggcccaggcaggaattcagtggcatgatctccacttactgcaacctctgtctcctgggcttaagcgatcctcccacctcagcctcccaagtagctgggattacaggcacatgccaccacacatagttaatttttgtgtagagacagggttttgccatgttgcccaggctggtctcaaactcctgggctcaagcgatccacccacctcggcctccaaaagtgctaggattacaggcatgggccactgtgcccagccactaatcccattcttgatcatccactctcctgacctaagtacctctcaaagtctccatctcctaataccatcactttgggggttaggatttcaacacataaatttggaaggcggacataaacattcagaccataactgtgattatcttttactgttttttactctatgtaatatgtctttttgttttggatacttttaagaattttctatctttggctatgatgggccgtgcgtgtgtgtgtgtgtgtgtgtgtgtgttttatgttacttggggcttgctaagcttcttgttttaatcaaatttggaaactgtcatcaactatcttttagccatattctgtatcttctctcctctgagactccacatacatgtatattagtctaattgcttgatattgttccacaggtcattgaggctctgataatttttcccccagtcttctttttattttctctctgtgcttcactttggttaataactactcgcctctcttcaagtttatgaagattttcttctgcagtgtctaatctgctatttatcttattcaataatttttaaaatttcagctattgtttcagtactaagatttctactgggttcctttttagagtttccatacctcttctaaaattcagattccccatgtctttgcccatgatccctatcttttcctgtaaattccttaacatatttatagcaaatctttgcttggtaattccaacatgtgggctgtctgaatctgcttctgctgttttttttttccttcttgacaagtgtcatgtttgctgcttcttcacatgtctactagtatttggttgtacactggatactgcggagccagtggtagaaactctggattctcttgtcttctgttgaagagtgtagaattttgttctggcattcagttaaattactggcagatcaccttgttccctgaaagccttggttttaggctttttaagggtaggactacttgagttttgcctttagtcctgggaaatggtcttcactcctgaggcatggtcctttggggtttcagtggaaagctcaaggtatttgacaagctcctctaacttggcagaccttgaactcttttttttttttttttaagatagagccttgctctgttgcccaggctggagtgcagtggcatgatctcagctcactgcaacctccacctgtagtcccagctacctgccccccgagtagctgggactacaggtgcctgtcaccacacccagctattttttttttttttttgtatttttagtaaagatgaggttttaccatgttggctggtctcgaactcctgacctcaagtgatctgcctgcctcgccttcccaaagtgctgggattacaggcgtgaaccaccacgcccagctgggaccttgaactcttaaactgcctcctgtcactgggcaattgctaaaatctctgtttaggtcttttggtgtttagttcttgctttccccttgggctccctggagtcatcccacacatatgcccttcagaactcagccaaggacataaggggaacctgtatactaactttgtggctcctcttttgaggctccctttttccatgttttccctcctcaatttccagccactgtggcagctataaatgctgacctctaagctgtcagcttgctttctgctttagcttcactcaccatgtgctgtgtggacttgaaattgccctgagagagccgggcccagaggctcacgcctgtgatcccagcactttgggaggccgaggcaggaggatctcttgaggtcaggagttcaagaccagcctcggcaacatagtgataccttgtctacataaaattagctgggcatggtggtacatacttgtagtcccagctacttgggaggctgaggtgggaggattacccaagcccagggaggtcaagactgtggtgaaccgagattgcaccaccgcactccagcctgggcaacggagagaagagaccctgtctaaaaaaataaaaaataaaaaaaaaatcctgagaggaaaaatcagttagatgcacatctcacctagtttgtgtctcttctttgaagggttgcatcgactctgattgcctgttttggttgttccctggtgctttaaaacaatttttttttttttttgagacagagtttcgctcttgtagcccaggctggagtgtaatggcgtgaacctggctcactgcaacctctgcctcccaggttcaagcaattttcctgcctcagcctctcgagtagctgggattacaggtgcccgccaccatgcctggctaatttttttttttttttgtagttttagtagagacagggtttcgccatgttggccagactggtctttttttttttttttttttttttttgagatgaattttcgctcttgttgcccaggctggagtgcaatggtgtgatcttggctcactgcaacctccgcctcacgagttcaagagatttgcttgcttcagcctcctaagtagctgggattacaggtgcctgccaccatgccaggctaatttttgtttgtttgtagttttagtagaggcagggtttcgccatgttggccagactggtctcgaactcctgacctccggtgatccacccacctcggcctcccaaagtgctgggattacaggtgtgagccaccacgcccagctaaaacaatttttttaaaaaaattttgtccagagtctaccatagatagcagtgggaatgttagtctgatagaagctactctgccatgattgcagtagaactcatccacatatattattattaaaagaatttttttttggtgccttgcttttctggctcactaaacatgtacttagtctttatactgaacaaaccaatacagttttgctgtcagttctgagaatttacttgacttaatttattattattattatttattatttattattttagatggagtctcactgtgtcactcaggctggagtacagtggcatgatcttggctcactgcaacctctgcctcccgggttcaagcgattcttgtgcgtcagcctcctgagtagctgggattacaggcgtgtgccactgcgtctggctaatttttgtatttttagtagagacggggtttcaccatgttggccaggctggtctcgaactcctgacctcaggtgatctgtctgcctctgcctcccaaagtgctggaattacaggcatgagccaccgcgcctggagacttaatttattattttttgggaggacaaggtcttgctctgttgtccaggctggagttcagtggtccaatcatagctcactgtaatcttgaactcctgggctcaagtaatcttcctgcctcagcctcctgagtagctgggactacaggtgcacaccactgtgcatggctaatttttttattttttatagagataggggtctcactatattgcccaggctggtctgaaactcctgggctcaagcgatcctcctgccatagcctcacaaagtgctgggattacaggtgtgagccactgtacccggccttgacttaatttaaatgtcactaaataatccagtaaattagttattgctcctaatggctatcaaagtttcagaggctaaaaataagtctctaatagtgacaatttcttgagtgtttaattaaagtttaaactctaatctattttttgaaataggtaacatagccacatggttcaaaatgttaaaggctaaaagcagtgtacattgagaagcttcagtctcactcttctcatatatgttttttaaacataggcagctacctttctgatctcttgcattatacaaattggttgtatcctgactgttgtaatcccaggagttccttgacaaataatttttttttttttttttgagacagagtctcgctgtgttgcctgggctggagtgcagtagtgtgatctcagctcactgcaacctctgcctccctggttcaagtgattcttatgcctcagcctccagagtagctgggactacaggcacgcgccaccacacctggctaatttttgtatttttagtagagatggggtttcaccatgttggccaggctggtcttgaacttctgactccagtgatctgcacgccttggcctcccaaagtgctgggattgcaggcatgagcaccatgcctggccagcaaacaatttttaaaataaatggaggaatccttgcataggaaggcatcatttaattctacaaacgtttattgagccatacagtgcgcctggaacagtgttagctattgtggggtataaacatgagtcatatgactgagtgtactttccttaattagaaagaagagagtagaatgaaggactatttgtaaagaaacctgatgcctgatacttgacctagttggaagggttgatagaaaaaggttctgcctctttccagctgaggcctgcagttaaggttatattcttggccctgtctccctagcagggtgtctccccagcccagcagcagccctgtttacagccaggctcagcacagagcccaagaaccttgctggaagcttggtgtctatctcagtttttagggagatggaaaagctaagtcaggcatcctcaacatcagaatgttgaagtggctccagtttacaactgaggggctgttcaaaggcctgagtgctcttcagctgtgtctgagagggctggatccacttctcagctgcttagaaaacatggagtgtccataacagatgacctgaaaagacactggaaaccaagcagagctacagaggtggcagcaagtgtattctacatatcccttttggggccacatcttcaggttcctgcagggacttggataggcaaggccgggtaatgtgtacagaatgggaggatgtgagtggcaggccaggggtatttgctaggaattcgggagtactgatgaggaggggtagaaattatgaatcggtgggcatatttacatctgggtaccgtttgctctcctacaggaatttcagatagagctgcccctgaccatgaaataaacattgtgcatctaccatgctgtcttttccattggtcctcaagattgggcttggggcctctggcttccacagggtagcaggccacgatgacattctactttttttttttttttttgagacggagtctcactctgtcacccaggctagagtgtagtggtgcaatctcggctcactgcaacctttgcctcctgggttcaagcaattctcctgcttcagcctcccgagtagctgggattataggtgcatgccaccacacccggctaatttttgtacttttagtagagacagggtttcaccatgttggccaggctagtctcgaacacctgaccttaggtgatccacccgcctctgcctcccaaagtgctgggattacaggcatgagccactgtgcccagcctcatgacattctactttgctgcaggtggcaagcctacttgtgggcttttgaagtctttatctgatcctccattcaaatgctcaaaatgaaagtaatttataagcaacttactctcccatgatgatgtaaaaaagtttctagcaggcaaggactggtgaatggaacttaactgcagagtgtctataattaattcttttgagatgtgcaagaaggtcattgattttatttagtatgctgtccttttggcttaattttagtgactgttacagaaaaaaaaaattgattgacaggcttttctttcattcccaatctcctgctccctaattctccctcctccttgaggcataatttactcaatgggggtgttcaggaattgaattcttccggtgagaggaactatagtagcaccaacagaaatataacacaagccgcatgtttaaaaattctgagtagtcacattaaaaaatgtaaaaagaaacagttaacattaattttaatattttatttaacccaatatatctaaaataccattgtaacatgtaatcagtataaaaatcattgatgcagctgggtgtggtggctcacacctgtaatcccagcactttgggaggccaaggtgggcggatcaactgaggtcaggagtttgagaccagcctggccaatatggcaaaaccctatctctactaaaaatacaaaaattagccgggtgtggtggcacatgcctgtaatcccagctactcgggtggctgaggcagaagaatcacttgaacctgggaggcagaggttgcagtgggccgagattagcgccattgcactccagcctggcgacagagtgaggactctgtctcaaaaaaaaaaaaaaaaaaaaaatcattgatgcagtattttactctttttaagtctttgaaatctggtgtgtcttctatatgcatagcacatctcaatttgggttggccacatttcaaatgctcagtagcccacggggctagtggctactgtattgggcagcgcagatctagggtgaaggccacagcgatgtcctcggagatcccccagggcctgcagacaacaaaccctcaaggccacattctagtgttccccgaccaaactgagggtggggctgctatttctcacggcccaataatgagatgcagatgaactgggaaaggagggagttttttatttctgtaactggttacagggaaaaggcctggaaaatatctctagaccaactcaaaattacgaacttttccagagcttatataccttctttttttggaggggggggatggagtttcactcttttcacccaggctggagtgcaatggcactatctcagctcactgcaacctccgctttctgggttcaagcaattctcctgcctcagccttctgagcagttgggattacaggtgcccaccaccatgcccggctaatttttgtatttttagtagagacggggtttcaccatgttggccaggctagtctttaactcctcacctcaggtgatctgcccacctcggcctctcgaagtgttgggattacaggcatgagccaccgcacctggcccagagtttatataccttctaagctacatgtctacgtgtaagtgtgcattcatctaaagacatgtgattaacttcttttaatctataactaaggtctgagtcctgaagaccttcctctggagcctcagtaaatttacttaatctagatgggtccaggtgctggggtgattacccttattttgtctcctgctaaatcatggaggtttggggagttcctccagacccccaataaacttgtctgtggaggtctggggagtttagacccccagtaaaacttgtttaatcctaaatgggtcctgttaagaattatttcataatcttgtcatgctttaaggcccaggaaaggcttgggcaaaactcttggtgggcttttgttaccttccagcctttgtataagggcactggtgtatatatatatatgtatttttttttttttttcccctggggtaactggttctttagcaagaggggagcactggggagtatcttcagggtggctgaactttgcaacctctttaataaacaacttccccctgtgcagtttgtcctcctttatcaccacactccgatgccctggtattcaggcaatggcatcaggcccatatttccgtagagttcagagttctgtgaggtagagcattccttccaatgggatcttagaattcttagagttgcagaattttactgactagactcaggaggtctcaggagtccagacttccttaaagcttggctcaaaattccaagggagctcataactccatggagcccagagttcctggctcgggaacattgggaggcctgggatacagtggcttagcctcaagcaaaaaggtgaacaatatctttatggcttgaaggtatacgaaataatgtcactacatcggagcagcgcctctgcttgcacacctatgggagtctgtagctgtgacacatagaagttggccacatccatgtcggtggctccaaagtgggtggccacacgcacaccctcgtgcaatgtgaagctcacctgatgactcaccatggccagcaggccgcggaggtaacgatcccgaagggcggctcgggcccgctgcttctgggattccaaggattcttgagctatggaacactcctggatttcaagaacctctgactacaggggggctctgcgtccatcaggggcaaagccacggctgagaccatcagggcctcggggcagccggagcacaggcacaggaaaggtcactggagcctgcattgtcttggcgaggtccgtggctactgtgcgcgcccccacttccgccggcaccccgcagtagaggccagggcaggccccgagccgcggagcctgggttccgcctgcgccaccgccaccaacccacgtgtcacgggcaaatttatttatttatttatttatttttgatatggagtctcactctgtcgcccaggctagagtgctgtggcgtgatctcagctcactggaacctccgcctcccgggttcaagggattctcgtgcttcagcctcccaagtaggtgggattacaggagcccgtcaccacgcccggctaatttttgtatttttagtagagacggagtttcaccatgttgctcaggctggtgtgaactcctgagctcaggtgatctgcccgcctcggcctcccaaagtgctgggattacaggcgtgagccactgcgaccggtcagcttttaatatttaacttaaccattcagtcagtgccgaaacagtagttatggaggcctgcattagtgagtcctggcctgccacactaggagcacacaagtggtggtacaggcaggagggagtttagaacggggtcagctgcagggattgcagctgggttttgctgattaaggtaaccggaaagcaaaggagcgggtgtcttaggtggataaacccgtgtgaggccgcggaggtgggaagaggccatgtgcctgacacaagataactcggtggagggcctgcatcctgctgcccggacaggcaggatttttcctggggtgacctttggctgacggttgctccttttttctcttttctcctccttcccgactccccaccaccctgtccccgcagcggtggtcctcggcctgcccagcgcctgggccgtgggggcctgcgcccgcgcttgtcccgccgcctgcgcctgcagcaccgtggagcgcggctgctcggtgcgctgcgaccgcgcgggcctcctgcgggtgccggccgagctcccgtgcgaggcggtctccatcgacctggaccggaacggcctgcgcttcctgggcgagcgagccttcggcacgctgccgtccttgcgccgcctgtcgctgcgccacaacaacctgtccttcatcacgcccggcgccttcaagggcctgccgcgcctggctgagctgcgcctggcgcacaacggcgacctgcgctacctgcacgcgcgcaccttcgcggcgctcagccgcctgcgccgcctagacctagcagcctgccgcctcttcagcgtgcccgagcgcctcctggccgaactgccggccctgcgcgaactcgccgccttcgacaacctgttccgccgcgtgccgggcgcgctgcgcggcctggccaacctgacgcacgcgcacctggagcgcggccgcatcgaggcggtggcctccagctcgctgcagggcctgcgccgcctgcgctcgctcagcctgcaggccaaccgcgtccgtgccgtgcacgctggcgccttcggggactgtggcgtcctggagcatctgctgctcaacgacaacctgctggccgagctcccggccgacgccttccgcggcctgcggcgcctgcgcacgctcaacctgggtggcaacgcgctggaccgcgtggcgcgcgcctggttcgctgacctggccgagctcgagctgctctacctggaccgcaacagcatcgccttcgtggaggagggcgccttccagaacctctcgggtctcctcgcgctgcacctcaacggcaaccgcctcaccgtgctcgcctgggtcgccttccagcccggcttcttcctgggccgcctcttcctcttccgcaacccgtggtgctgcgactgccgtctggagtggctgagggactggatggagggctccggacgtgtcaccgacgtgccgtgcgcctccccgggctccgtggccggcctggacctcagccaggtgaccttcgggcgctcctccgatggcctctgtgtggaccccgaggagctgaacctcaccacgtccagtccaggcccgtccccagaaccagcggccaccaccgtgagcaggttcagcagcctcctctccaagctgctggccccgagggtcccggtggaggaggcggccaacaccactggggggctggccaacgcctccctgtccgacagcctctcctcccgtggggtgggaggcgcgggccggcagccctggtttctcctcgcctcttgtctcctgcccagcgtggcccagcacgtggtgtttggcctgcagatggactgacctggccagaggggggaaagtttgcttaactgggcttgagtgtgtttgtggtaaggggagaggagccggaatggagggcagaggtgaaaatcccagtggagggtggaaggaaccgtttgcctccagagatggccccagggagaacacagggacgtgccactcgagggggaggatggtatggatttctgcttttgtcacacgggcatccattggaaaagagaagcaagaatgaacgtgggccctcgggtgggaagactaggaatcggaagcttctagggcttcacatcccttcccctcccctccccttcccctcatcttccaggcaacagtgcctgcaaggcctgaattagagagacttccattggctaagtagttaagagccgtcccatttctcctggcggggtaacccattacaccgaagtcctttgttttctaccacaatcctcctcctcctctccaggggcctggaaacactaggattcaggaaggtaggcaggacgtgagagaagggagatgggagagagatttaagacaaagggtggcggtggttcctggggtctgagatgtgttaggaggcgtttaaaacaaagatccagttcatttactccacagttattcccagggctggccctagccacaaaggaactttagggcagggtagggaaaaaaggggcagcagggggtgtgtttgtggacaaataaatttgtaaagtccgaggattaaaaaaaaaaaaaggttaaaccggtttctctactgctggacttttcagagtctttcatatgctaacattcattgtgaatctcccaagaggccacacaatccttttttcttagcgttttgtgggatgaatgtccggaagacacagagagcggggcagggaggctccagcttggatgattccattaggtgtggaaattattatgggctgcacacttcggggctgactaacggccaagagggaaggaggcagccagtagctgggaaaggggatttagagatttctcaggttgggggttggccaactatattccccccggcttgactgcaagggcaaaggccagccaggcctgcagcaagcatgcatggctctgggtgtgctgtgcctgagggcggggctaccaaatcccacctaggggccctaccaaacccagcttttctcagggttgcagtgggaacaaacggtgtttgttctgtctgcctcaggatcagcagctcgtttagcatatgctgcaagaataaggctttgcaggctgagttgcaaatgctggctctgctggtctgcagtggccatctctgtggtttgcagcagaaccgtcctaagctggtcacaacaggcagggattcctgacagactgtaaggcagtcaagtcaagaaaagtgcatatgctgctcaccacttacacaagaacccaagctgttctctgcactgcatgctatgactgcatttgtcaacattctggaaattgtcatctttttaatgtcctctctatatttgaagaggtgggttttgaaaacccacatgaaggccaggcgcggtggctcacacctgtaatcccagcactttgggaggctgaggcaggtggatcacgaggtcaggagctcgagaccagcctggccaacaaagtgaaaccccatctctactaaaaatacaaaaattagccaggcatggtggcacgcacctgtagtcccagctacttgggagcctgaggcaggagactcgcttgaacctgggaggcggaggttgtggtgagccgagattgcgccactgcactccagcctgggcaacagagcaagactctgtcttgaaaaaaaaaaaaagaaaacccaaatgaattcggggtgcaccaagctgtcacttctttttttttgagacggagtttcattcttgttgcccaggttggagtgcagtggcgcgatcttggctcaccacaacctccgcctcctgggttcaagcgattctcctgcctcagcctcccgagtagccgggattacaggcacgtgccaccacgcccggctaattttgtatttttagtagagacagggtttctccatgttgatcaggcttgtctcgaactcctgacctcaggagatccgcctgcctcggcctcccaaactgctgggattacaggcgtgagcccccacgcccggccaagcagtcacttcttcatggggacactcctgtgtctctgtgtaatactaagtattggaagtgtcgcacaaagtactgctgaggacaggtgtattcaaatgtttcaaccattaatggtcattaactcaatgggttttaaattcttaaaaaaccagaccgggcacagtggctcatggctgtaatcccagcactttgggaagctgagccaggaggatcgcttgaacccagtagtttgacaccagtgtgggcaacatggtgagaccccatctctacaaaagaataaaaaattagtttggcatggtgtcgagcaccaatagtcccagctatgcaggagactgaggtgggaggatgtcttgagcccaggaagttgaggctgcagtgaactgtgttcataccactgcactccagcctgggtgacagagcaaggccctgtctggaaaaaaaaaaaacaaaaaccagcgtttaaaaaaaaattatagaatagaaaagtcacagagtatcacgtaatattataagactaagtattgttttgtgaaacctttttttttttgagacggagtctcgctgtgttgcccaggctggagtgcggtggcgtgatctcggctcgctgcaacctccgcttcccgggttcaagcgattctactgcctcagcctcccgagt

SEQ ID NO: 14576 - DNA, 20841 bp, Human
ctagcagagcgagggttgggagggagtcccatctggggccccctccttggaggcaaggccagtcccccgaaattggtcaaagcacctgtgaataccccgttttaggggagttgctagtaaagtacattctccaagacaaagagagcgacctcaggaagccgtgggcaaggcaggtccgtggttcaccccccacccgggcagaaggttcccccattggttcaggcagcgacttgaggacgagcagagctctgaaatagtttggcctgggtttgaaacccaactttggcacttcctggctgcatatggcttcagacaagttgtttaaactttccgagactcccttgtttcatctgtaaaatggggatagctgtacatataaagtacttgtgagtgttaagcgaaatagtgtcataagcgtaccccgtataaagtatttcttgaacaaatatttatcgggtatttatttttatgccaggcaccaaagatggatccaacggtggacaaatgtacaagcccactcttaaattttgtattctagcaaaagagagcaataattttaaagtattaacaatgaagtataacgtacagggagcttatgttagttgtcagggtcccctgcagcgaggcctgctggatgttgacagctcccttaatgtgagcagaaaggaaatctacaccagagtcaaaggtttctggctgttctttaagagggaaagactcaggttggaccattgagaaaatgagctgtttctttccacaccaggactcattccttatgctccagggaatttccttaaaattaataatagaagcgaaaaatcagatctattccacatgtttggttgcaaatacctccaatagtcatagaagtttatttgccttctttccaaagatgaatttttgtctttttgtacctcactatttgtgatgtatgttgatgtaaagaacaagctcacatgtgcctggttatgttgtgagctggtaatactaggaaaaaatttcctaagaattgagctaggtcctgacatggtccctctttccaagtagcatacaatctagccatattgataagttaaaaaaaagttataataatatagatctgtgtaaactgtataggaatacagatgggggagcagttaattctgcccaggtaatgtatcaagaaagttcccttgaggagaaaaattttgaaatgggctgtgaatgatgaataaaagtttttcaggtagactctcaaaatttattcccagcatttatgaagctatttaccattataagagaatgtgaagttcattgtcataccaattaccttttgcactgcttccaggaataaaatgctgcctaattttaataaaaattgttatcccaaaagcatgatacagttgctgatcagggagctgtcagtatctggtaggccttgttgcgttggaccctgataatacatcactttctattctcatccttgtatcagtctgatgaaatgtttacatggcgtcagcaaaatgttttccatacaagaggtagcttagtatcacaagaaaaaacctgaaagtacatttctaaatatccccagtactttattttagtcatttaattctaatcaaccaaatgacctataagaactagttaaaatacacaaaaggcttaattactaggaattaaggtgaagtaattttactcagaaataccaattaaattaccctattcattaggaaaacattctcgtatgcttgctgagttttgattctcttttttttttccttttttttttattttagtgtctcagattcattcttaaggaactgagaacttaatcttccaaaatgtcaagtaagtttcaatttttatatttatcaatctatgttaataagagactaatgccctagcaagtgggaattccaaaatactctcatttttttttcttcaaaacaggaccattggtagttttgttgcatagtattatatctcagttgtttacaagaagttatttattttctttcaaacagaaagaccatcttatgccccacctcccaccccagctcctgcaacagtaagttttaattttcttgttaatgtaatagccaactctggccttgatacaaaaacccagatgtcttccagtgacagtcactcaatcatcacagcaacaggatgaaattcagcttaaaagaaaaaaaaaaaagcacttcctactaaataaaataattatttgcatctttccttgaaccaaccccaacatttaaagaaacagtactgtaaaactccaacctcctgtgctcagtttgttttgttttttctttgtaaatgggaaataagtgaaagttttaccatttctttcttattaatcttcactattaagagtctttaagttgttactgagtgaatgctcattctggctattttgttaaacctaaccttcaactggttatgtttttctctcctttcttgtctctctctaaaattttcatattaaacaataaagcttctgaaactactcattgtaaatattttcaagctgttcaagtaaagatttcattatctatggggcagatcttgctattgaatcttattccactccataaattatattttattggtttggaagtatatatgttttaagtagttgtgaacgtgttttttcacccaggaagctctggcccagcttggtcagcatgtaaaataattttccaacccacaaaacagatttagcagtaactgttcaggtcttgctgaaatggcttccttgttggttttttgggagggggggttttgtttgtttttaaaaaaacactgttagcatgaccaaattctacaaaattagttctttaatattaatccttccttccatacccccaccacctaaatttcaggctagtctacttttcactactaattaggtccttgtgtaacttagttttctccgctaaaaaactactcatatttactaaccctcagatacatattttagttacatttatcaacaatttgtttttctttagtgagatactttagaaaagagataccgtaccatatgttctcatttcaatttatgtcatatacaggctctaaagttaattccagtagactataaagtcctatgcttgctttgttttctttcttaaatcgaagaacatttgttatgaccatctccatggcattctgctagtggctatacaggtggagctgaacaattgagattctgacctcaaagagctaaccatgtacttcagctttggaaatggtataattataatgttttgctttccatttttttttttttagttcccttatttttataacattattgcctcataatgttgaacagtgattcttattatttatgctacctttgaaggtgtcattttgacaaaaatactgcctctgacaatgcatcatcttgacaaacttgattttttgagattaaaatatttcaaaaaccaagtgtccccttataatttattatgcataaaaaggaattttttttgcctttctttagttatatttttgtgtcattatagtttcacattaacacacaaaatatagaagactagggattaaaacatccaacagaatggatactaaatgaattattcttcttccttttttctttccattacttctaccaccaccaccaccatcaccaccactaccaacactatcaccactatcacctctgccacccaaatgtaccgctgcaagtaatatacacttctttcatgcctttgatacttcaactgtgttttgcctacttaaatatgctttatttgcgtcttttctaactgtatagactagaaattgatcagccgttctcttttctcctaaagagtatcaaatgtaatatctgcttaaatgtctttcttttgggtactaaggatatgtgcagcggcatgttttaggaaattgtgtttattttgtaacagctacagcttagttggaatgtgttaagtgtattttacattatacaattaaggaccgatattgttaattgcatgtaaaaatgaaattgtcacatattttgattgaattttacaaggtaaaataccctaattttggtctctctctactatattctttctatgcattatgccttggttctcatgaacattgagtgtcattgtattagccccaaggctactgctatataagagcccatttgtgattacatcaacacataattcacaaaaaccaagggttctgttgctgaaatgagcagttgtattttgaaagggtgagagctatcaggaaactagatgaaaaaagaagtctataaactagaaaagtagttcacattgagacaaaatgcagaaatgttttcatgattgaccagtggaagatggatcaaagaagaaatggaagagaaatcctataaaagaatgactgggttaaaaagatcagatagtaccccagaatgaaatccatgcatttcttacaagtctttgttttaaatcatgtatgtgacatccatcaaatccaacatatgttcttttcaattgacaaatcctggcttcccgatttgagtctctactcatttctcacattatataaaatgatttaaaactgtcgttgaaatcagatccatttcttttttttgtttttagtagataaatacattggtggcatccacatgtcaaataaattgtattttgttttgcatgtagtgttttcagagttctagttgatcacacttcaagccttcctatttcagtcttcatatattgctaagttgttttatcctattgttgaccataaagtaatcctgaatgttttaaacacttcagtgtgttgcttacctcaaaaaacaaaacacacattcacagtcacacaaacacccccagcccctgcaaaaaagaaagagaaaaacaaccaaaagacactgcagacaggtttctcaatgaaagaaaaatatttaatttcctcagtggaaaaaaagaacaattacaacacatcattgcttgtttaaattcaggttgcttttgcatgccatatgcagatcatttttcatttctgtgttttcctcgtttgagctcatttctcattcgtgtttttgtctcatttgtttccatcagcaaatgcccagcacaccagggtttgtgggatacaatccatacagtcatctcgcctacaacaactacaggctgggagggaacccgggcaccaacagccgggtcacggtaggagaatcaactattacagcatccggcaaacaactggaattgaccagaaatgccttcagaattaggtctttttgaatcataagcacagccatttaaaaaaaattttttaacctagctttttgagtattttcaacattcgttgtagcatctcacactgaaaaaataaatagtgagatctggaatgtatatagaagaaaagaaaaatccattctgtttggtggttggtagggttaaagccttgagcacttgatgcttatactgtatgtaaacaaacagaatttcttaaggtaaaaatatcctttttgacataaagagtatttttcatttttataaggtgattggcattagtctcaaggattgagtttctagtagaggctggtctttcagacctggctttttcagggctggaaagcttttggctggtacaccagtttgaatcgctacccatagttatttgtcttttggatttagtagttgaccttctaactaagactcatttctctacagtgaaaaagagaaaaacgttttaatgtcacctcaaagaaatgcagagtgaaggttgaatgaaattaatttgaagtatcagactagatatgtacaacgagaagtgcatttctaatccttagtataagagataggatttctgaaacttagcatgtttcatttaagtgatcagcctaagatatcaaaattggatgatacacttcaaatcttttagtttagaatcatcttaaatttcattcaaaaaagtttaagcaccaaaaaatgccaataattataaaaatgacttactaaagataaaaaatccaaaagtcaaatactacattggaatgtagtgttggtgagaatttatacaacccagaatggctgtaaagtttttaatacctggtttttgtttgctgtattcataaataacaagtgccttctattaatgtaacttcaaaaaagccctctcaccctgtagtcaagctggaactgaaagcttgtagctatcaaatgaatgtctatcttgataagcatattgcttagcttgataggttttgtttgtctaaatttttcattgtttctgcataatatgtacttcataagcatatcaagttttatgtgccatgcatatttcatggtatctgaaaaagaattctgacaaagtgtgtgtatgtatgcatttcacaatgcatacaatttttatgtgcatcaatacatgtttttccctggcctaaacatgttgtttcacaagtgtaatggatggcaaggttttcaaatgataaagaacatttcagtttaaacaatgaacagaatcaatcatggatcttaatgttaatgcagcaattttttcacgggcagtaaacaagaatgattgcatttaatagctctatacagtcacctcttgattatctatgttaatggaatagaaatgataactataatattacagtaatttgtcttttggttttgtgtaagcattttgctcttaacttggatgtagctgtgggggattctctgttaaaaaagtgagattgttcgatggagactaggaagagaaagtgtactccctatctgaagtcactcatctgtttcttcccattccttcttggcgaatgttaagaactgaacatttggcgtggacactagctacatagtagattaattatagagagttgttggacatggaaaatttggtgttttggtcctttgtggacatttactttgtattattgtcctcttaacaccaaattgaagtataatcaaactgctatatgaagaagggcctagaaaatgtggaggttttacactacttgccctgctttctatatctagtttaagctgttaggactcaatggctctgattttgaccataataaaagcattttgattttactatgaccctagttatgcattacttttgggggtgaggggaagctcctgtatggtattgttgtgcgcagattgcattagtggttttcaaggaacgaatctgtgaagccctgtccagtagcttgtggtaggctgtagagaacattgggtttccctgatgactccagtatacttgggtagttctcagacagtaaatactttgtatagcatgtcgagaccttttggagtgcttatgatagctacaagatggaattcactcctagtcagttcttcattcagatgatgattaacattctcttaagtacaggtgtgaaaacacattgagacaaaaatgtctttaaaaacagcctatttctgtacattaatagaaattctgccccagaagaaagctcttaaataagttcttgctagagaaacagctgagaattgcaaaagaaacaacaacaaaaaactgagtaaccaagataaatttcacaaaaccatgaactttattcataggagatttcctaggaccttgctcttctgtaagcacagttctacccgcctccccattggaaattgaaagcagaaaattggaaagagagttgctgctagaggtgggtttcctgatagtagcaaggaaagaaacagttcaaaaatggaaacacattctccaaaagcatagcccctaggccgttgaaagagtcaacaacagattttgacatctgacagagggttacagcacagcaaaacagtggttgtttctaattgaatcttatccagaaagggtctaaagtatgttcagctttttttaaagaaatgtttaagacattgtagaaagatgtctgtctgagacgttaaataaattggaggtgtgtaatgatataaatctttactatcctgaaagccatctggaatttaactttattattgttttggggtgtttttttagtttgggtttttgttgttgttgttgtaagttgactggtctcaatatacagatgatttgtgtacctttctttgggagaaaggaggggaaatagcaattccattaatataaaatgtgattctttgaaaaatatcaaagagcaaatactactgtgtttttaaagtgttttaattcatattaaagctcggaagcataggcattttagaattctttacctctttaatttcaaaaaattttgacagtggtcttaccacctcagttatgggcacaattccaactttatttgtaatccatttcatggaattctgaaggtttgtgttggatatgagttggaaatactttctagtaactttatgtgtgaagaagcagacttgtgtgtgtctgttcctctgaatccataaggttagtcttataggaattctctttccccttgaaagaactatagaccctgatacaggtttccctgtattggctgcccatcctaccacttttgacagtttccatgcccctggccatctcactctcttacccactgctggccaaaaacagtgtctgtctacctgggcactagcatgaggtgtgacaagaatgcatgggaggaatggaaagagaggaaatactgcttccaaggcgaaatgctttgaagaagtagagttatagggatggagagagacccttgtaggaagaggaaacatttcttgatcatagtggaaaaggacacaaacatgctaatccctgagccctcaaatgaaaaataaggttatgattggggtcccagcccagagtggaggagtatctctggggttttatcatagcaacaacagaaggggaagcgaacaaaatgttactttagttttcctataaggatttgccaatcctgtctttcgataattaaaataaagccaacacttcatttctccagcctagcagggagagtcaatatcagagatctcctgaaaatttgcaaattgtctgaaatagcaatgatttttcttattctgggtctttaatcaaatgcagtcatgtatattaacaggagactaaaaagttcagaaatagatacttttagatgggtgttatctgggtggtctaccagaggctgtctggaatctcacctagactttaagccacaggaaaaactgatcactttatctttctctttccttctttttttattttttctttcacctatttttgctttacctttttaaaaaatatttttcagtcttccctccgcctccttttcttctgtctctcttttcctgtacatcacatctttccttttcctctgtctttcccataaaactgaacatttttaatggaatggagcttcttgatataagacctcaaaaataacgtaatcaggcccgatatctgccacttctctgttcctgataaacttgtttgcttttacactgtgattaggactcaggacaaaacaatgtgtgacttttaattcacacttctcattcccctttacaagaaaaccactaggtaacagacagaaccttaagagaaataaaatctctagcctggcaaaggaggtaaggtggtttgttatttcactaattgtttttgtttttgaacctgggaagttgtttttgtggtggtgttgggagtacattcctagtgctaataggttaaggcccctgtagacagtgtgagaatggtaagtgttaagggttcagatcctgctgcagataatcaagtgttgactgtatgtgtaatggtaattgagcagaataagagggtaccaggtaatgtcctgaacttgagacggttgatatataaccatatattttcaatgtatgggttactgtgtaatattttatttgttcttgcagccaggttgtcaaagcattggcaataaactgctaagtaaaacatttaaaaattatgtgcttaaagtcattttcttttgaacatttctgaatttgcagtgatagctattttcagtgaagaaaatatttggacgaatagaagaaaggcgcattagaattttttaagggactctcttttcagtttgccagtgaactccttacagttgaataatgaatgtatttaactctttcgtaggcatcctctggtatcacgattccaaaacccccaaagccaccagataagccgctgatgccctacatgaggtacagcagaaaggtaggtgcttaggacctggtaaggagtgaggacactgtctttgctgcttctttgcttaacatccaactttagatcggcttagccagcttttctgtgcatattcagaggaaaggtccaaaaaaatacggtttttaaagcaattagttctgatttcaaaattccagaactaaaatccaacaagaggagcgtgattaaataaactgttaaaatccttaagatagaatgttctatagccattaaagtcatttcttttggagaatatttaatgacgtgaggaaaatgttaagtgaaggaggactgcaagactacatgaattaatatctcatttttataaaaataatagcaaccacatgttagtttgaagggggaaaacacagaagacaataattatctctaagcagtaagcttatggtagtttttattttcttttcctcaagttttcctttttttttttttttttttggtgatgagcctacattactcttaaaataaaaaaagtagccaatatctttattaaaaggcagagcattataaccactatctagaaatgttaaaccttttgatcttgactattatatttgtatttgataatatgatgtaccgtgttatgcaaattaagcacttttcttctaaattcacatgaacttttagagacgtagactatgttattgaagtaactcatcctaagtgtctgtagtgattggagatattcttgcttatcaaattgaagtatttataagtgagtgacgtgatgtctgagatctatcttaaagtaatccagtagggcaaagataacttgagattggccagttcttgataatttttgaagtaggctgatgagtacctagaaatttgatactgttttctctgctttgtatgttgaaaagtttccacattaaaaactatttttaaaggtctatacgtttagacatcagtattaacatttcatctgttttctttttaaggtctgggaccaagtaaaggcttccaaccctgacctaaagttgtgggagattggcaagattattggtggcatgtggcgagatctcactgatgaagaaaaacaagaatatttaaacgaatacgaagcagaaaaggtagggtaggggctcacagtgggatagataatgtgtaaagtacataaaacattggcttactatttataaaagtaacataagatttggtcagaacactgatgcagtactgaggctctgtctacctgagtcaagtcagtttctcaaggcctcagatttcttgcctgtaaaaaggagataattatcccaacaccctgtttacatcatatcttttgatattcaagtgagataacataggtctgcattataacctgcaaaatgttaattataaaaccaaaaaacatttgaatttcagatagagtacaatgaatctatgaaggcctatcataattcccccgcgtaccttgcttacataaatgcaaaaagtcgtgcagaagctgctttagaggaagaaagtcgacagagacaatctcgcatggagaaaggagaaccgtacatgagcattcagcctgctgaagatccagatggtaaaagaaaaaaagtggggttttgtttatgctttctctgtgagttaagatatgagaaatctcttaagtataagtttttatttcttatcctaaatggaaaagaaagtataatttaagtatcgtcttagtattttggttatattgagtaagatttgtatgtgaatttcccacaagaaaaagaaatatccttttcagtgcagaaaatagcaaaaattattgattgtttatcaaaatctttgtactcaaaatgcacgaaaggtttttaaatcacaatcaggattttgcctcatctgcttttaaaaagctaaatgcattctaattatatcttgttttcttattggttcactaaattcgctgaattaaaggctcttaagggagaagctaatgagtatgtggaaacatgaagtttcctttccatttaattcagaaatccaataagaatgtataaatatagctcatgctactatttgtatgggtgtacatgagggtatacccatacaaattgtatacatgcacacgaatggcagagcttcctaattgccattctgtatgagtagttagcaggtgttctgattgttctggtcttgtgcagccaggcagggtctgaagctgcgaggagacccagagatagccacctgcagtgtgaacacactcaaccacatatctagtgtgctgtataaacattaatagtttctctgtatactgctatgatgtgcaaaaggttagaagctttagctgcaagcgacaagaacatcaggaaaatgatttaagatcccatcttaaagtagcagtaacaaagaggaaggctataagaactttaaagacaatatcaatgagggaggaagcaataatagtacctgaagacaagaataagttgataaaagtggggaaaaacagaagtcatttttaaaaataatgtactggaatattgtcaaatgttctcataaatacagacagtggaatgtaatactatagagaatagaatatggaatagaaacagtattgaatgttaagcagaatcagcagtgctaaagacacactagcatcctcacactttaattactcaaatggggtgattaatgcaagagaaacatacagaactaaaaaacagaagacaatccagtctacagatattgggaggatggaggtcagtacaagaggaaacaaaggctagcaacgtaagtagaaaataactaaagctttcattaacaccatgaacactgagaaggactaaagagattcactcagaaacagtctgaaacttgggcctatgatgtttttaactttcagattgggtcttaaagttgctagtaaattcaggtagcaattaagatgccaatatgagaatgtctttagcataccagtacgaaaatgattagaaagaggaatacttgggaggtggaaatgtatgtcaaatgtacataacagaaaggtggcatctgcatgaagtacaacagctactgacttctttaacagaggactatcaaaagatagacattgccaggcgccatggctcacgcctgtaatcccaatactttgggaaactgaagcaggaggatcgtttgtggccaagagtttgagaccagcctgggcaacacagcaagaccttatctctacaggatacttaaaaattagctgggcatggcggcttgtgcctgtagtcccagctactccagctgaggctgaggtaggaggatcagttgagcccaggagttcaaggctgcagtgagctatgatcatgccactgtcctccatcctggatgacagggcaataaccagtctcaaaaaaaagaaaaaaaaaagagggcatgtgcaattatccacacaagacaatgaaggcttttattcagtgagagcctcttcatcataggataaatagctgttcaattagatcataaccagagaagccattcccccaaaaaaggaagcagacgactaacatgcaaagaagaacaagcccaaattgcttagaccttatgtccccatctgtggtcaacactggggccatataaatgaaagaagaaaacaaaagctaacaacaaaaacagataacttagacagatgtagcacagatgtaccatatataaccctaaaggtgaaaaactcttaaaaagtagaaaggttacagagttttaaaaaaactgtatcttacccagtagttttaatttcagaagtttatttcctaaagaaattactcaaaaggaaacaaaagtaatttttttaactttttacaaaaacaacagtttttagctgtagtatttataataatgagaattttaggaactacttaagtgccagacaataagggaggtgctaaactgacatagcagcgcaacataggcctctgtaacagggtttcccctgtaacaaggttttcttaagtgtggttcctccctgtctggtgggtcactgaggtgattaagtggttcagagaggagcgtttgttttaatatgtattactaaagagaaagctctttttttttttaagtgagttagtttaaagaaaaatattaagtaaacgatagtacaggctgttagtagatatatgaaaaactatgaaggtgatagagcaaagactgagattaaggaaacactagatagctattaaaaataagcctgtagtgtgtgtgcagtggctcacacctgtaatcccagcgctttgggaggccaggatgggcagatcacatggggtcaggagttcaagaccaccctagccaacatggtgaaatcccatctctactaaaaatacaaaaattggccgggcgtggtgtcatgcgcctgtaattcctgctacttgggaggccgaggcacaagaatcacttgaacctggcaggtggaggttgcagtgagctgagactgggccactgtactccagcctgggtaacaagagggagattctgtctcaaaacgaaacagaagcatataaaccagacccatactgtatgaacttgggtcataccattacacactgacaacagctggctaagtgtaaactgacaaaaattaaatttggaatcagacatttatttttcttctataaaattacttgagggcctgggaaactgaatattgttagaggtgatgtattctctgctgtcataattttacaaatgggcattttcattcatttttaaagtgctacaagtgacaaagtcactgcccagttcatatgttgttcattagttgttaaatgccttaagttactaccaagagagtgaaacattgggcagaatttcaattactgccatcacatacagccttcacattgattccgaagccagaagagacatgttgtatctcgtttatgttttagccaaatccttctcagacacaacattatcacttaaagactgtgagataaattactaccttggccaatgaacacattacgtcctctgtatggtttttatcaagtaactgccccagtgctcccatgacgctgggcaggtccacttgttaggccagtgagggccatagttcgttggtaattaagtgttaacattgttacactcctttttatggttactggtgacctgatttccagaacaatttgttcactccagattatgatgatggcttttcaatgaagcatacagccaccgcccgtttccagagaaaccaccgcctcatcagtgaaattcttagtgagagtgtggtgccagacgttcggtcagttgtcacaacagctagaatgcaggtcctcaaacggcaggtccagtccttaatggttcatcaggtaaagtcataaaacattcatttcaataagatgtgcctataccacaaatcccaggtgatatgattcctacaccatgcctaaatctacctgttaaatatgtcaatctaacctgttcctgatttggagaagaggtttaaggaagtggacctttcccagatgtttaataagtttgtcattaaaaactataatatagaaccttgtaatggaaagtatattcgttaagaaatacgtgtgaacttaagaattttgaggcatcctatcaatctttactgctatgctaaatattttttcccaaggaattgctcaggcctgaaacagtattctttaacatttacctattgatcataatcatttctttgtgctgcattttgtattttttaaatcttagctagactcatgtgataaatgatctaaagttcaaaacattatttggtacactgtttgaaagtatggaccattaaaaaatgagacacaattatgaagcctgatcctgtcttgcagcgaaaactagaagctgaacttcttcaaatagaggaacgacaccaggagaagaagaggaaattcctggaaagcacagattcatttaacaatgaacttaaaagggtatctgtttaatatgttaactatacttttatcactatacctgttactttatttttcctcattcttttttccaaaatagtgtttttattgaatgttgttcactttgaaacagggctaactttattataaacctgtaggatcctttttttataagattgttcccattctctggcaaaattgcaataaatttgaaatatcatagagtatacacatatcttctaggcctgtaaatgctagagccctctgatatgttaaactcccatacagtcattaattactttcattttattgtgatttattcatcaaatgtcgtcattaaatgtaatttataatttgcactttgcattcagacaaggaaatctagttggtagcccaaaatgtaaaacggaagccttatgtataccccagaactttcactattttgcctcaccagctgctctggaatatcctatattatacaactgctagagctgctgttttttcttgtagacccaagagtttcagagaagacctagaaccacatttttttggcacacacacacacacatacaggtgtatagatatatatatatagtttataggcaagaaaaccaacttttgaaagaatatatctggctcaaaaattataaggaaaaaacattacggagttctgtttttttctgattagttgtgcggtctgaaagtagaagtggatatggagaaaattgcagctgagattgcacaggcagaggaacaggcccgcaaaaggcaggaggaaagggagaaggaggccgcagagcaagctgagcgcagtcagagcagcatcgttcctgaggaagaacaagcagctaacaaaggcgaggagaagaaagacgacgagaacattccgatggagacaggtaacccactagcaacaaacgcagaggcagtgccaagactttgtacggctgtctttaatttaggtttttctttctaagtgcaagtattctggtacctgccactgagggtgattcccagtactaaatttgacatgatattgacattcagtattttaacctttaaatgcttacattatttatcaagatgtggttattaccgttaagattaattgtctttggtgtcctaggacagcattctgcaaagtaatacctgtaagccaatcctgcccaccacttgtttttgtaaataaaactggaacacagccacacttgtttgtttacatactgtctgtggctgctttggggataaaacagtatagttgagtagttgcaacaacaactgcctggcctgcgaagtctaaaatattttctatctggctctttacagaaaaaaattgccagctctgtcctagaaaaacccttacttctaggtatactgattttcctgattaaaagcatccctcaaggtaaaaaaaaataataataacttgtataaataaaacttacataaagtactgattacattgatcgtcacttgtaattttgagatcaccttacctcatggcactgttttaacactgcctagtacactgtgtaaacaggactaagctaaaagtagttatggaaaacaaaaccaaaggcttcctggagcatcgttgcaagaagtgggagggacagtagtcatacttggtactcagatgacaaccatctggaaaacatgtaatggaatatagatatctttaccaggtatttctgcaaaatttaatccagcagattaacatttgaaatggtcatattttaagtttcagtatctgagtctctttctgttttgtatgaatgtgttttttattgtaatgaatttggagcatgagcacatttttgtggttaaaacgagcttgaaaattaaaataactgatttttgctaattttgcaactagacaaacactcagtcctttgcctctgttttggcatctatgaatggggcatgtcttatgcttaaggtttgcaggtctttactcagattctgtcctagttcaaggaaaaaacctgaagaaaatcgtttgagactattagagctaaaacctcatgcttttaatttcttacaggaaacagcccagcatgactttaaacaaagtgtctaaaagaccaaccttatattatttctacaactgctttctcctcgtttaatccatagcactacagactaactctcattcactgtccaacagaaataaaatgcaagtcacgtgaaattttatattttctactagtgacatatttttaaaagttaagcaaaacaagtgttttaacaatatgttttatttaattcaacatatcctaaataaaattatttcaacacagaaggaacatttttaaaatcagctttcctttttttaaacagtctttatacacatctcaattcagaagctaaattttcatcggaagtatttgatctgcatttatttaataaatttcattcatttacagctaaaaagtagattttcatacccaaattgttccaacattcttaaaagttctttagtcacactggttcatttcaggggtttaataaccacatgtggctagtggcttctatattggacagcacagctgtatactgtcagcataactagagtaaaatttcatcttggaactgacagtgacaaatgtgtgattacagaggagacacaccttgaagaaacaacagagagccaacagaatggtgaagaaggcacgtctactcctgaggacaaggagagtgggcaggagggggtcgacagtatggcagaggaaggaaccagtgatagtaacactggctcggagagcaacagtgcaacagtggaggagccaccaacagatcccataccagaagatgagaaaaaagaataagtgttgccttgttttgtgtgttctaaatactttttttaatgaaaaaatgttttttggttttaatggtgttacgtggtttgtgtattaattttttttcttgtccatatcataccaccaaaggcttttggaccatttagcatcatgagcctaatggctcagtcagtcacctttcttaagtgttgtgaagatggctcttttctttggatcttgtttctagccctcaactgctgaaagcctcagaatttagattaattgagaaaacacccacctcttttagagaattatcctttgatgctgcagaatctactcttacaatgccttcctacagctcactggggtgcttaccaaagccatagctttaaaccttcccagtccccatcagtagcttcctgaaagtctcctctcttgtttacttctgcaaagggtagcttcttaaaaacgtgatcatgtatgagtatgtatttgttcacttacccttttttacttttaatcaatgtcagataccaagagttgtgttaagctgagtgtagtgtgtaactaactacacttggatcttactgatccagaaatagtccccatagttagagtagttacttatgaagtggttattaaagtgaacacagcacatatacattatctatactgctttttgttatgattaatactgggtatgttctggtaaatccatccttattgtatagaaaaaaaattacttttttaccaggttttccaaagacagaatagatcacaaagctcaaggaatttaatattcttgtaatggactagataattcaaactgattagcccattccagaagaaaaacagctgggaattaagttaatccacttgaaattgttttacaataatcagaacatccaaacctcaaggctcaggatcccatagaccagagcccacctttttgataaacttagtaaagtcttggagactagaagcaagatagtttgtgacacataagcttcccaaaaactagaatagatttttactgaatagtggtatatctgatggtatatgtttcttaaaggtccaaatgtaataaaaaaaaaatgaaaaaaaggtctcagtgtttttaatgcactacatatttgtatgcaagacaagcatccagtttttttctgtaatgcagtgacagtgtggaatgaccactcagccattataaatttgtgtactcagggcccttgtctcacccaactatctctataaactgctgcagtagcttatttgtacaagacacttgtgaaaatcagttttcttacattatagtcattgtcacatatggaagttggtctttgattccaaaagtaaagggaatatgtttctacattaacaggaatatggagaaatctgtaacgtttgaattatctttgaaagaatggctaaatgataaatgttaagtcctgtgcctatatggagaggactctgtaccagcatgagttaatttaagtggattcactgctattcagttcatagcacattagtgactaggaatgtgtgttcagcctcctgagagaggaggggaggaagcttgatactgggtggaaacaactcttgacatctgtttccttgtgtgtcaaagaacgaatttgtatcaaatagatctgttttgagctttggccattatttggctaagaacttcagccatctcatctcagacaaattggacagcctctttgatacattttctagtagtcaaaatggggcagatgtagtttaatatgggtggaaaactgccccagcaagataccaggttatttactgtggtatcgaaagctctaagagaatggaagtggttcttttgcccggctggaaatagcagtgggaagacaagtctatccagaccaagcctgtccatacaacactggcaatcagttgatgagggaattaagtcagatgggagacggcttttttttttttttttttttgagttggagtctcaatctgtcgcccaggttggagtgcagtggtggcgatctcagctcact

SEQ ID NO: 14577 - DNA, 678533 bp, Human
  misc_feature (1)...(678533): n = A,T,C or G
taagccagtacctttaccattttaaaactgacttcacaatatctcctaattgttgtgtactatagtcaatggatggaacgtctttgttttcatattaaactatatgttcatacattgtatgtaaagtgagtatttaatatattgaaacattattaaagttatattgatacattcattaattttattgacttttattatctttattgtctcctgatctgaatacttttatttgtataaagatacaattgcaggactcattaacttgtttcttacagaaatgttctctttacttgtagggtattaatacaagccattaagctagaatttcttctggcaaaaacaatcctaacagatggcaacttttctctctattaattttggattggacatgcactttggcttgtttggtcatgtcatagttgtaacataacaagagtcattcaagcaaatacaatgataatatagctgtggacatgtacagtatgcaaatttatagcctagcctatcaaaactatttaaagatttacatgatttcctgttgtaaataggaaggttaagtaatccattaaagcataagcttcatactaacttatctggtatgtctttaaaggtaatgccaaatgtatggcaaatatttagtcagttgcctaagtgttttatcttgatacttgaatgttcatagaaattagactatattgttgtatcattcagatatctggtcatgttagaaacaaccttaatcagcccttttaaagcatgtaacttttgatttttgaacatagatgtgaggcagataggctaatctcccaaaaagcaacttaaatatataagatacagattcaaaagtaaagcataccttttaatctcttctccctattttggaaaaaataactctatcataatagatctgtagatgtcaagtcaaaatacatttgaaatatttgtctttcggtaatatatttttcccatgctaactattaatttatttgtgtctgcttctataaatacttagtatctttatataatatgtttttttccgaggattccccttgtagtttgccctttgagcactcttctactcattgcattctttaaaaataaaaaaataataaatttaaatggcatcttttcagttaaacaattagccagttaccttagatttgagcagcattttccaaaaatgctacttaggaataatttatggaatacctggcacttagcattttgttgattcccttctagattaaaattaccagcaaataagttcctttttataatagggaatctcaaaatcagaaggtaagaaaagcaaaactcatttttcggtatcaatatatttaatcaaatactttacttgaaaacaagctcttacatatgctttattatgaaatgtgcattagtattagtctcccagtgccttctaattgatcttaattcacttccattattttttcaaacctagtaaattaattcatcttaattatatattttaatactttatatattttgtacaaatcatcccattaagaggatggagagagtttaaatcaatgtaataatttatctaagttatcactgttccctgtttaatattagggtacttttatatctttgatttattttagaagtgtttataaccctgtagaattgaggccaagtgtactgtgaggaccactggacatgaaagatacattttgtgatcttttcaaagggctctgtctgcccacttttgcaatttgggtttttcagagggagtttaatatttcttcatattatttttaaaagcataacatacttggtcatcacatctttgttagaattattttggacattatacactttgtcgttaattttattgtttataattaaagtcataatcattatacttctagaaatatttgcatttcttattttatcattatgtgtgtatgcctttagtgaatatattatcttaatgcattatttcattaatttaatgtgtttttttaaaacaaaatttgctttctaattgcaggtggcctgcatgcagtttataaatgcccttgtcacttctccttatgagcttgattttcgaatacatttaaggaatgaattcctccgttcaggactaaaaacaatgttaccagtaagttgaatgtatacatttattatgctgatgaattttaaaatttttttcacttccacaaaagtacttgaagcagagtaaataaatgtgctttgctattttgttttgtaaagcattagacattttgtaagcttttttgtattccagtaatagcattctctacatacaaatgatgattcagaattcagctaataatgtacccagaagcgatgtgtttttgttttttgttgtttccctcaagtcaaaagggacttcttttctttgaattttgaatattgaaaacatgagactttttttttggagtttcaattttcatttaaaatattctgctttcctctttgataacctagattgatttcattggtattcaggataagcatgcatagagttttgattagcatatgctagacacattgcttaagaatgttactcttgttacaaggctataggaacttttcagatcaaaaacaatttgtttcttaaattaaatgtgaatatttgctgtaattatgatagtgttaaaaacatttttggaatgattttgtatgctgaatctgaaataaatgagcacacttatttttataaatacaaatacaactactgtggttttatattttattaagtatattaactgaagagtgactattgcagactatggcattgttcaagacaagtaaaattctgctagtgtctttaagctactcagaatatacctgagagacaagaagtaaaagtaaggaagtgagaaaaaagcactaaggagagaaaaaaacaacaacaacaaatgtcattgaatgtgcatgtgtgtgcgtgtgtgtgtgtgcccatgtgtatgacctagtctaccagaaatacccaaattggggacatttcctggtgaggaatcaatatgtagcataaatttgtaacatatggtgggatacttttaactgaaactagttgaaacccatcataataagttgtgtgattggacctgttaaatccattttaataagatgtatgattgggtccacctggttttggaaatttctatgtcaatcccacctgaagcagttctttcattcttgacacttaaaaccaaggcattggttgcagagaatcaaagcaacattttaagtgacccatctagagattaactgtgcagttaacttaggcatattcaccaattatagttagtgtgacatgtgattattcttgttttttttttcactaattttcttttcatccaaagcctgtagccttggatagctaaagataatcgtatggtcttgattgtagtttgcttttgaatttccttcttgttggtttccatgcttgtttttactgggctggttctctgtttatagtagcatctttgaagacttgctggctgcaagggctctgtagcatcctctactcgtttattaatatgccatgttttctgccatagttgttgctcttacttttctctctttcattcccctctatttataattgaacattcactttctgctttatactactgaatggctagtcaagagaactgtgactctcattttaatttattttagtcctcatttttcagaaaaggtatggtattgtagctcttgtccttaaccttttgcacttttgtctgggtatattaatctctgctgggctcagtggcctcatgttattcatttggttacacagacagctaagattatgtgtctgtgtttctaagctacacttttccattggccatatagccctatataaaactttttgtggtaccatgtgcttcttaatttatatattcttttttaaaattaaaaataatttttaattatggatataaaatagttgtatatatttgtgtggtaaaatttatattttgatacaagaacatggtgtgtaatgatcaaatcagggtgattgggatatccatcacttcaagcattcatcatttctttgtgttgggaatattctaatcctacccttatagttattttgtaatacaaataattatgaactatagtcactctattgtgctactgaacactagatcttattacttctatcaaactgtatttttgtatccattaaccataccctattttcccccacaccctactaccctttctaacctctggtattcttaatatatacttccaattagacttttctttatcacatctcttcagtatgccctgcttctcagatctcagtgattcttcagcaagataaaagtgggaagagaaagttttggaatagaacctacaaggattctcataatttttttttcctctctaagacagtagagctaaatatgattaaatatgactctgattctcaactaagaggttgggcatgtccccctaaaatcttactgtattgaggatagggcagacatatttggttgggaaaaaaaaaatcctccgcaggtatttcttttccttttccttttcctttccatttccctttttctttttttctctttttcattttccttttccgttttctttttcttcttttctttcttttttgagacagggtcttgctctgtcactcaggctagagtgcagtggcacaatcacagctcgctgcagcctcaatctcctgtgctcaagcaatccttccactgcagcctctcaagtagctgggaatacaggtgtgccaccacacccagctaatttttgtgtatatatatgtatatatatatgtgtgtgtatatatgtgtatatatatatgtgtgtgtgtatatatatatatatttatatattttatatgtttatattttttttattttatatttatttttgagacagagtcttgctctgtcaccaggctggagtgcagtggcgtgatcttggctcactgcaacctctgcctcccgggttcaagcgattcttgtgcctcaacctcctgagtagctgggactacaggtgcgcgccatcatgcccggctaatttttttttttttttttttgcatttttagtagagatggggtttcaccatgttggccaggatggtctccatctcctgaccttgtgatccgcctgcctcggcctcccaaactgctggaattacaggtgtgagccactgcgcctggcctaatttttacattttctatagagacagggtttcgccatgttggccaggttggtcttgaactcctggcctcaaatgatccaccccagcctcccaaagtgctgggatcgcatatacaagagtagaatcattattcaggcagatagaccttgagaagattagcgatcatatatttagaaccgtagatttcactactattgttttagtttatcacaacttgggagcaggacagaatggtcatgggttaacatatactacatacctcacatgtcaactactatctaacctactaatgaatgaaatatttaaatttaaaccactggaatttatagtaacattacatatcctttacatatgcagtgaagcttaataatatggtcatagattgtctttaaaatccttacgttttcttctatttattcttttttttatatccagttctaacaagaattccctaatattctagaatacagtatattcaaagcagcaaattagatgtgactagggctaatattaattgttggtacatggatgaaaaattatatgtatctagaaccagtatgagttgggaaaaactagttcttagtatttcagtaatccttgagatcaacactgtagtagagtgaaactttttttcataataattatcagaatcttcaagacaacgaatttttaaattatattctttaaaaatttattttcaaggttcctctcatccctatggttaaatttagatgttgaaaaatagtttgtatttcatttatatggaatttcacgtctgataaatttgctttagtaatttagaataaatgagttgttacaaactctacagtgaattttaaaataggatttttttctgtacttaatttacattgatttcttctgaaattttccccatttgccttttatttagttaaataaattaagaaaatattagttaaatcagataagcgaaggaaaaacatagtaagaaatggtgttggtaggcagtgggcatacttttatctctttaaaagtctgagaaactctttcttgttttaaagactcaattttggttgtttgactgttaatcagcagtgtactggcaatggactttgatttcctttgaagtgcactatgttatagaaaattacatatttcaggaattctgcaaaaaataattttagatctataccgcatgtctttttaaaaaataacaagcatagagtgtttcacataattaataacagtgtgtttcagtaactttgtgatagttcacgttttaaaatataaaacttcagtgatagatttccatttacttttataggatacccatcttattatttgtactatgtaaaaatttttattcagtaaatgattattttatcaagaatttatgaatatttcaaggcttgacattttgctggaaggaagtttcataaagataaacatatatatgtgtatgtatatatgaatatatatttacagtaagttcttagttaatgtcattgataggatcttgcgaactgcaccttgaatcaaaaccatatacagtaggtccttgaataatgtcctttcattataacattgatgagaaaagaaaattggttttgctatacgtattttgcttcaagttgcagtttccaagaactactgaggacaattaaatgaggactgactttgataggtctggagcattattaataaagaatatttataaaatactgcatttacacatgtctaaattttatattgtgctatatgtgctcatatactatgtatattgtataaataatgtctgggcctaattaagaactaaattgcacatttaaccagttattttcactgaaagcattttaattatgctgactgattttcatgttttgtaacgttctatgctaattaaatggcagtacttaaatttttctgtttttctgaaatatttgaaagtgtttaagttttatgatgaatttctgagagagaatatgtggtgacaagaataagacatactgtaaaatgcgtgacaggttgtttctgcagtgaccagtgtattgggtttgtctggcttatgtaattttctaaatagagttcagaaatcacctgataatatgacccagcaatgttagatgattttgcattctaataaatttcttcattccatttcaaactggaaaactagagctaaagcaagttattactaaaaatgaaaccaaatataaatacatttacttgttatgttttatatgaaattgtgtagaaactaattattttcatatgctctgcaggtaaattttcaataaattattatgtatgtgagtgttagaaaaaaaagcatctagaaattgctgaaatttgtttggcttcagtaatagccattacatctctataatagttctattgaataaagatagaaacaagaaatgtatcccattttgttttatcgacctaatttgaagtacaccatgcttgcatttccttttagagttcaagctcagctctgaaaatcctagtcccactttcggtatcacccttgagcatccacagttgtgattatcgatttgggttttgaaagctgcaacttaatggacacatattaaaagatattccaggtgatatatattgagcccaacaatctctagtgtggcatgcttctaaattttttatactattattatgaaaattatcagaggtttgtaatgcatgtgcttataatgtattacaaaaacataacttttatgcccaagttggtattttgtgatttagctaagcaaaaatataaggtgggggaggaggttagatgtacagcttaataaaaagtccaaacgcctttttgctttaaaatcacaaaatagcttttaaaataaatgtgtttatacatcttttcaagccatacttgggactgttgtgcttgaatatatccttgcatttgttcttcattaatacaattgatttgtatttgcattttttgccagaggcatatgtgaatgttctgactgcatgagttcttttgcaatctttgattagtgtgtttagtcaaaatgacagcatttaatttgggttgttagcaattagtttttttctgttgtagaactgatcgttaattttttaatgtgaataatcaaaatgtagggcatggaaaaaatgaagtgaatgcaatgaggtccttttatgttgaaacagaaaaatttagctacaattactttcagaaaaccaagtgcccgcataaatatttgaaattgcttctgtgtttataaatgaataattgtgttctgccctttattacctaaatatgccgttgtcaaactgttattcatgtgttaaattttatgtttatatattaggatctaaaagaaaaagagaatgatgagcttgatattcagttgaaagtatttgatgaaaacaaagaagatgacctaactgaattatcacaccgtctcaatgacattcgagcagaaatggaatatcctttgacaaaccacaaaacaattttgtttgcattgtgagaaagggatttgtgggcgattttgtggaacattattagagttcttgtctgccctcccaatttatatccatttatttatattagaaccttactatgatgctgtccttgagattcatgttgaggaattgtcaggctgtcttgatgatttacacagagtgtattgaaatctgcacaatggctcacagtattatagatatactctactcagtggtcttgaataaagaatagcataaggcaatatatcttacatgtaaggatttttttggggaaaatttcactgcgttcatatgtgactataggtgaaatacttattcagtttattaaatcaagcttcagtgacttagagataaaaagcaattcaaataaatgtcttattctgtattcaaatatttgtgtttcttaacaataacaaaaatgtttagatgcaatagaatctgaatatagcaaagctatgtggtagaagcatctgagtcaaatacagctagcatataaccttccgacggcagcaattttatataaaatgattttagatctaagagatggttgtcacagcattgctggccatttgtttcgcacctgttatgtttcttacttaatggattctggtgaacctgggaaacatgtcaaaaccaaagtgacctttgagttggattttttctcaatgatgttttcttccctttcctactgcttgcccccactccccaaagctggaagtaatattcccctccttgaaatacccaaagtaccttgtttgttctattttatttatgtacacttctgtgcccctgtgagattgagggcagaaatgttatgtttaatcttttttccttcaatgcatctatgaaagtcttacacataggtattggataaatgtgtgtgcaatgaataacaatgttattattttaaggaataatttctagtaatttttattcatcattagtggtgccagtctactgtggcttctataatattaaatgtttttcatatcaattaatatcttgctttacatagattcctcttataatcaaacttcaccataaaactatttttggatgcattgtgtagccatttaaggacctcatgagactttagcacaacactcttatgtggggtctaagaagtaagccatcgtatgcttaattctactttggagaaaatgttgacatttcaggttattttaggatattgaattacatcttgtcttttatctttattttaccttggttttccaggtcctcacttttattacaaaaatggatccatttgtgaaatctgatttctagtttactaaaagcatctaaatttctgcaactctatatcttgtctctactttccattttttatcaaataatgaaatacaaatgaatgcaaacaataataatttcagatttagtatttcatctggataacataaaactgattttgtgacctcttagcagtttacagcatgctcatttgccttctatcttatgtggcagtgaaaatagagtagtagtgatttgcatgaataatataggtcctctatcacaactacagggagatcaaaaggaaaccattttcactgatggcattgctgttccaatggtaccagctataatctggactttaaaatatgtataacggatcatttaagattttgacagtcaaatggtcttggacatgctcttgaggtctgtctctctagttaaaagatcaaaatgattccatagaatcattactttatgcagatgtttaaatactggatcatagagttgaaggtttaaaaacagtaatggaagcaagattataagtcaatgttttaaaaagttaaactcctttgttatgaatgagacttccatcaaggatctttaatatttttcctttactttctactgatatgaatgaagtctaccatcttctatataatatgctgaaggacactgctgctgaaaattacttcttatctattctacaacattttttgcttatcagaaatgattattatatcaggtaagaggcagttctgagagtactatatttataatttgaatcggatattaaaggaaaatgaacaatgtagtggggcctaagcaatatatgcatatgtgtgtgtatgtatatatatatgtatatatatatgtatgtatatatatatatgtatatatatatgtatgtatatatgtatatatatatatgcgcggccccnnnnnnnnnnnnnnnnnnnnacaccaccacccagggtataagagtttgactctttaggtaacattttttttttttttgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaggcgtgagccaccgcgcccggcccaggtaacattttttaaaaggtgttcattttttaaatttggccagaagagacagatgcacttgtaaaaatggggtactccagcgacaggactttggtagcaatgaacccaacagattgcactggccctgcaatgaattttctttgctagatagtgatatcacagaaaaagcactgaagattctgggatagaactttaaaggttttatcttgtgcatattaagtaaggttttactgttatttctctttttacagtatttatctactaataaatgtgatcttaacatctaagaaaataaaagtgctaatatttcagttttatgtctagtagtgtcatccttcaaaataaatgagtatgaaaataaccattaaagttaaaagttttagaatctagttaactgggaatatatcggaaaaccacaaagttatgaaaaggcttctgagtgactgaaattatccacagactggtgaccatgatgttacatttaactgttcaagagactcttagttgttcttcatactctgatttgcgtgaaattctgacaacctaggttctttgatttctcaaaacctgcttgattaaatggaaaaggaaagctaccatgaggtcagcacagtctcaacaaaaattacaactgtaaagcagcatagagaactattatagttcagaccagtacagtaatttgttgggcatcgtgacattacagagagataaaaaatgtttaaaatattaaattgtgtgctgttttttaagcaacaaggctggttatacgttaaaaattattgttgtatttttaattaagttctaacaaatttaaaaggggtactgtgcccaaaggtactcagttacctggggaacatcatttatgtgaaagtatccatttctcagcaactatgaataaataagaagttatcctcatatggcatgtttttcatcctaagaacatccatgtgaggcagaagtgtgacaagcattttattccacttagggatgattaacctggccccagctgtgttttccttatttaaccattgactagactgaggttataatccaatattatttactctagacccgaagatgacttgaaaaaaaccagatttgtaatatgtattactatttattcttattcttgggaccagacccattactaaagacatagaagagcaattagagtctatttggcttcatttacaaacttttagtaggttggctatttatcagcacactatatttagggaagtttatatcataatttgtctatagtcgtacttcttactactgatttttctctgttgaatttattatcctttgacaaatactaaatcttacccaaattttaatgcaaaagtgccttttaaaaaattttgcagtatgtgagtggtcatttttaaggccagaattacgctgatggattacagaattaggatatgttttaaaacctctgacactttaaacaaattgaagcaatagccatgcatattaagtgtgtatgcttttataaaatgggtcttttaaaatgtgttgcataaatagatccttggatagtcttgtaatataagtggctctgtccagttttgtaagctgttatagctatcttgactaaaagtgctgtagtaaattcaagacattgcttgccacgtaatgtgaagaaactcatcccttattgaaattgagaacctgtggatgcgtagaaccatttctgtatccatgaatgtaggactaatggctcatttgtttttattaactttagaaacaatagcataagtaaatagaaaaggttgataagtatctttcaacacaagcatgaatccctgcaaactagattatgaagtcactagatgtagttgattacatcacaatgggtttggtactgtaacacccagaccatccttaagcttaggcatgcttgtcctaagaaagtgtagtggctgcaggattttttaaaacaactccagaaaaaagacctagttcttctaatatgttgaatgttttctaaagcaaattgatctgcatggttagaaaggcattcatgagtactttctctccttttcaggccacaatattataaaataattgaggaatgtgtttcacagatagtgctacactgcagtggtatggatccagacttcaaatacaggcaaagattagacatcgatttaactcatctgataggtatgtatcataatcctcattgtcctctgattgtgttttgtgccttctgtattataagcactttttaagtgaagaagttcagtaagaagcttcagttcttactgaacttctattcatatctggtaaatcattgtgtctctgggcactcaattgctgtaattgttaattataatgatcatgagagttctgcctgtgtgattagaaatattaacctgtttaataagttccaacactcctggaggtagtttaagcttagtgttccacaaaaacccattacattattatagatgaatgcattactatttagaaacatgactctgaaatcttttcattttatactggtaccttagtggtcttgtagaaatcatgtatacaatggggtctcattatagttatgttattaatgcccaagttttagaaaagaaatacaggctcatttcaatagcttgagaccttctaagggtatcaaatggatcaatttatattttcatagaccttagagttagaaagaatttgaggtgatcatattcatctccttagattgctgaggaaatgactttatatcatcctagactggtagttagcagtacttttcagaacaacctctgaaggatgatctgaaccttcccttgtgaaatgtgctatgctatctagccttatggctaagcagtcttatttatacttaattggaatcactattgttaaggtttaagcatgaactcatttgtcttatatttaaagaaagaaaacaactattatatgccaattatatattatttttgactccacagcacaaggcagatacacagtaacattcaaagatggataacttattatttatgtattatttctgttttaaatgtaatgcatacttatttcaggcaatccagagacttacataagtgacaaaccaccaatcacattcgtgatcgctcccttttcagcttggtacatttccttatatctctttctctatgacctatctatctctctgtatgctgatttttcttggaactttatattatgagagtttttccacattaaccttcaaaatgtgacttttaatgtctgtataatattccattttgtgaaataccatagtcgttgtaaccagtcctttctttttgtgcgttcataattgcttttagattttcacagttataaatgaatgtgctgtcaacattcttgtatataaatgtttggctttttctcactatttccttaggattgatttctgtaagtgagggtatgaactttcaaaaagccaaatgcttttcagaaagcttgtgccaatttacccagaagtgattgtgaattttagcctcattgcatatttttcaatgagtttgaaaaacaagtttattttgcattttgttgagggagtcataagggactattttcaaatatgtatattagcttataatccattatagaccatagttaggacacatacactattgttgattttgatcttattaatcttaaacatggagtcattgtcacctctcacataataaactatagttttttgaagtattttatagttgaaaaataattgaatacctataaaaaataataatttagtcaagtagtattcagtattcaacagacgtttgttttgtgtactgtgtaccaggtacttatgattctttactattaatcaaaagtgttgggtgaggagagacgaacggatcaggtgagagaggatagtcagcatcataaacccattgtgatgttatccacatgtcatctctgcgactgtgaacaaatcatttaacttctctaggttttagtttcctcaactttaaaattgaataagtcacatatatgagtggctcttaatattttatgttcaaaatcctttgtgagaagttgacaaatacttggaactttgattagaacacacatatgttcatgtacacaaaaaattatcaggtgcttcaagaacttctaggaaacccatggatctgtatttcaagatgacttggacctgaagagattagtctcttgtaatttaacaattctttgagtctgatatctttcataaatcagatcgtatcagatctctgcctgaaactctctgatgcctttccattgaaatttaaattctaaatcattaccagccatggctaggacagcttagattcggctgttctttgacttcgtcatttcctactttcctcctcagttgctttaaacaaacaaacaaacaaaccagctttattgaggtacatttgatgtaagaaaaactacccatatttaaggtatacaatttgataaattttgctattaatatagacacttaaaaccatcatcaaaatcaagataataatcctgttaccccctaactgcattgtccttttagttctttctttccatgtctaccacatcttcccatcctgggatattactgatctctctcttactagttacattttatagtctctctcattagttgcattttttaaaattttataaaaatagaaacatacagcatatatactttttgcctgtcttcttgccttcagcataattattttgagattcattcatgttgttgtattgcatgtatcaatagttcattcctttatattgctgagtagtattccagcttatggatataccatagtttgtttatgtatacacttgttgatggccatttaggttctttcgagtttgggattactataaataaaactgctgtgaatattcacataaattctgggtactggtatatgtttttatttctttttgataaataagtgtggaatggctagatacagaatagagtttatatatacataaaataatgagagatacaatattgcccaaaagttgtttatattctgaagtgtttgatttgacctgagaagtttgaagttagtttccttatgtacatgatacattttgccccagatcagaagttaagtaaaaatcttttcatgaagaagcctgaattatcgaatgttattctgtctctctctagcttttttgtaggacaattttgaatcttgctaagactattcatatcttattaatattattaaggttacacatggagtctttgccacctctccacccataataaaccataggattctgaagtgttttgtagttcaaaaataattgaatacccataaaaataatttaatgaaatatatttttagatgcttggttttgtgcctccacaatactatcagtgaattcagtttgtatgctaaagaaagaatatatgatttttatgttttatgtatagtataggtcaatttccatttaataagggttgacataaaaatgatagtctgcattgcagagttataggctagaagacgtcttttgtctagtgatctcatgccataatttcgaatcacttttgtttgatcttaatagattcttgtgtgaacaaggcgaaagttgaagaaagtgaacaaaaagctgcagagttttcaaagaaggtaagcttataaaatattagccataatcgttaggttaataatttaatcacagtaatactctaccttctttattaatatgagggcttctaaatgtttcatttatgtagtactttatacttttgggttcaaacatagccgtggaatattgatttatttccttataaggtaaggttgctattgttccctcatcatcatgtttaatccattatggaagaaaaacactagccacattatactaaagtgatacatgaaataaaattacattgctgaaagggtatagttggaagcaatcaaccaaaataaattctccctttgctttcttgcagctgtcgcttgcaataggtagctctttggagaactgtgagatgtttagctagtcttttctgttgtggtcttttatgtcagtgctattgatagtaccaacatgttgcagtgttttctctctttctcactctctttctctctgtttagacttagcttctttgaatttcataattatcattttgtaagtgatgctgctacttcatgtaggcctggtggaatttgaggatcccttttctttctgtgttaatgtcttaaatgcctttgagtaaatgccagctttgtgaatatccgaattgtattcagatctaagcttgtcttttccttgtttcatggaagcatagctataattttattagcttctaccacaagtttctctttttttgttctagagcctattaagcattagtatagtatttctgtcctgttgtgtgcagccagaaggattgaagcacatgtctaaaagctctccagttttcagccttctctcagcaagataatgtgcttacatattgctgtctcttcaaagttatgacttaccttggagattagataatcacttttgctatcactctagaaattatagagtattactgaagaagttacttcagggcatctgaagaaatatctttgctcttttagttactagaatagattctaagagcttgagcataaaatgtttgtgtggagctgtcatttttattggtgaaagaaaatgcatgctttttgattaatagaccttcatatttctaatgttcttgttttaagtagcacatttaaaattccctttgaaaaaccttagaatctccttaagttttggctggcactgtgattagacactgcaagactggagcaaattgtgattatctgtctggtaaagtttttttgtgagcatatatattatggaaaaggagtcctaaagtaatagaaaagaaatttcagtgtttgatgctttagtgtcatcaccaacatttagaatgaaaacatgtatggtctcccagtggttagctacatgcatccccttgttctgggtcattttaagaggcagtataaagtcattttttaacaagtactagaatgagaggcagtagttgtgagatctgatctcagcttttccactaattagctgtgactttgggtaagccacttactctctttagatcttagtttcttcatcattaaaaggaaagaataaaattagcggacttgtaagaagacctcttccagctcacatatttcaggcttctgtgatccccgtttgctgtgtttgcagattaaggtaattttaaattaaaagcagaaacattgtgtgcctctcctccaacatactaataaaccatttttagaggaaaaaatgtgtatagtgtgcttgtgtaggtgccatgatttagaagcacataggagaagctaactttaggagtggggatgggagtacagattgagataaatcttaacacggatagtagtaaaggcaaacaagctcacattggaggatatccatcttcttaatgaagtaggaaaacgaggtcattgactgaaggatatatggatccttcactccaaggatctggggtaggtttgaaatttaaagaaattagagaatatttgggccaggatctgtgggacattttcccgggattcaaggagagatgaataaaagcatttcaggttcgacccaaacagtattattatccagtttgctcacccactcttcagacttagatcagaatggcattttataatttccaaaggtcaaagctactatgaggatgaatatttgttaacagtgaacatacttttgcattgttccacaaactcttaagatggttttgggcagtagatgtatcacttttagaaacagaaataacattgttagaataatgtatagacttctaaattgacttgaaacaacattgacaataaagggcaaataaaatgttctatagccagtcccaggcagtattcactggaaatatgcaggcaggtttgtgcctgcttagagccctgtctgaggtaagggctaaggcaggatacagtgaataaatattaaccattcagtctttttggcttagcaccccatattttaacctctagtttttcctctcataacatgctatacaaatgttttggttaaccatctgaatgagactgctattagggcatcctactgtcagagtttgtgaagtactgctttatggattctagacaactaagattgtaatagaaacaattccaatttgtattaatatacgtacatttgagcattctaaaagtgcaatttcttttcaagattaaatatagttaaggagttgaaactgcttgatggtttatttttagatttcattttctaattcattaaacttaaaagtatgggatgaggctgcacatggtggctcacgcctgtaatcccagcactttgggaggccgaggcaggtggatctcccagaggtcaggagttcaagatcagcctggccaacatggtgaaacccatctctactaaaaaatacaaaaattagccaggtgtggtggtgcgcacctgtaatcctagctacttgagaggctgaggcaggagaattgcttgaacccaggaggtggaggttgcagtgagctgagatcatgccactgcactccagcctgggtgacacgagtgaaactctgtctcaaacggtatgggatgaaatatttttaaaattattaattctaaaattgaattttcattaccaaaacaataaaaatgttcattatgtgtgaagagagacttttcagtctacctttttgtctttgtattttttttcagaagtgaaaatgtgttttcttaccttgggtagggggcatatttcttctttactaccccacctccacttggatacttaattgttatgaaaataattacaagctgtgattttctgagtgatctgggaattcaactaagtaaaaaccactccacttatttaatacataatgttctttaaagcgttctgaaaactatattattaactgtacattgatggtgatcattgcagttcgatgaagaattcacagctcgacaggaagctcaagcagagcttcaaaaaagagatgagaaaatcaaagaacttgaagcagaaatccagcaacttcgaacccaggtaatgaaagaagatatagactttgtgtcatgtcacaatgagtttgatggtagaaaattatcttgttatatagaaggaaaaatgtgaccagaagcagactttttggcagttttacattttcattgaaataactatacagattttatattccagggcaataaatcattttaatgcttggaaaaaaaataaagcattagttgctcaaatggccctgaatatttttaatagaatatattacacaagcaaaagtgtttttgagatgaaattttcgtgatgatttgaaaaattgggtacatgctattttctttcaaaaagaatgtagaaatagtcattaattgtaattatcccaaaagcttcttgagatctctttgaatctcaagtaaatttccacctacatttcctatggtgaaaagctcccatatatacttaaaatttcaattagggtgtctaaactttcaaactgattgtgtattctcctcaatatactttatgtcttaaattaatattaagaaattgaagatgggccaggcatggtggctcacgcctataatcccagcactttgggaggcggaagcgggcagatcacgaggtcaggagatcaagaccatcctgactaacagtgtgaaaccccgcctccactaaaaatacaaaaaaaaaaaaaaaaaaaaaaattagccgggagtggtggtgggctcctgtagtcccagctactcgggaggctgaggcaggaaaatggtgtgaaaccaggaggcagaacttgcagtgagccgaaatcccgccactgcactccagcctgggtgacagagcgagactccgtctgaaaaaaagaaaaaaaaaaaaaaagaagttgaagatgatgtcttaacatagtgggtgctcagtaaatatttgttgattgactaggtctgtttccaccagtctagtgaacgattacttcaaaagtcaccaacaaactccataatacccaatccgggggccttttcctacccttagcctgtattacttatctctaatatttgatcatttcttttcaataaattaatctctttctctgtctgtttccctccctctctttttcttggacttctttttctacatgtttgagaacttagtttctccttattttttcatcctcaaatggtgaccttccacaatattctgtcctctgctcttttcttttttgtgtatatttttgctgtactgttccattcagtatcatacattcacatatccccttttagtaggggtcaagtctcttgagtttgtcttctagttccagctcgtgattagctacccccataggatggtcctgttgcatgttgaaatcaaacccagttttgtggttttgtctctttcctcaaaccagtttgttgtccatttcctgtttaaattttactaccaattttaaagatggtgaagctggagttttctttcccttttccctgccccacccactgacaaattaagctagtcagttttatgtctgttctttcttcaactccactcatactacacctcttcgcatcaaaccccagaaacctccaggtcccctctcttatgatgtctcgcctggactattacaattgttgcctaacttttctccctcctcaaattcatcctttatgtcagtggcaaattaatcttcctgaaacaattccctgattattgttactccagcctttaatatgttcacttgttgcctgttgcagacaggattaaataaaatctccttaccaggaatgttaagaccctctggcatgagtttttcctcctttatctcccctttgcagcctaggctctgactgctcccctaactacagcctctgttgcagctaagtcacctttcctcccttcacatttggaaattactgtctccatacttaacccttctgccagcatttcccagagattagttacagaaatggcaataggttgttcatgacgaaagcattccatagtccaataaattgagtacgcatgaaattctcatcttagagattcataatactcattagcatattaaaggtcccagatattttacactgaagaaacctgcctacctctttttcatatagatttcccatactcatttgaccacagcaccctttatctcagagcacccttcaacatctcctggaaatagtgttttcatagagcttagttgagaaatgttggcatacattattctctgtaagaaattccctcctttgctcatctgtgtgtgtgaaatgtatcctttaaggagaagctcattaagacatcttttggaaagcttcaccaaaaactccattagcgaatttctccgaactttcatatcacttttctagaccactcatgggatatttgtgtgcctgctctatttcttctgctagagcatagacaccttgaggacagtgtgtttcttattaaaggccccactgtacctagcacaggcctttaccgcacagtgagtagttgcttacttatggttaaattaactgtaaaaagtgcagaatcacgaagcattctcaactcctggcctcaagcattcctcctaccttagcctcccaaggagtagctgggattacaggtgcaggcacagggctgtatactttctagtgtgcccaaaataatgtcaaatactaaattattcatttaccatattcaatttgcaatacgatgtggtagcctaatttaattattcaattcctaattgttcatgggagggaaaggaaaggctgatatgatttgatttttaaaggctggtagcatttaatataaatatttgagattccttattaaatctgtaaaatatatatttaacttgagtaaaattttatttaaataatagcattttgtggttgtataaaattcccaaaataaatgtgatctaatagaggtgaaaaattgactgatgtttacaaatgtatattactttgaattatgttgtccattaattaaaaaatgggaaacgacacacattttgcctttcgaagtatgaaaaatatcatgtcatacacaaaatttgtaggataaattactaattttctgaacctttaattttgccacaattacttttatctcagttaagactataaaatgagactgttttccatagttttgctactttcaaagtaaaattaaaataattttacatattttaatcttgtctttctttctaacctcagagagaaaattgcattccaggagaggatggttatttgctaagtatagaaacactttagttgtatgtatgtatatacatacattaacattcatctatgtgaaaaaactagtgtgagtgaatattatgggtaacctttccatgatcttgtctacctatgagtgttagttttaatatttttgtaaataggtcagtcctttcaactggttgttccaaacatttgcttcagcttactttctaaagatatttatggctgtgcacagtggctcacgcctgtaatcccagcactttgggaggccgaggcgggcagatcacgaggtcaggagttctagaccagcctggccaacatggtgaatccccatctctactaaaaatacaaaaaattagccgggagtggtggcaggcgcctgtaatcccagctactcgggaggctggggcaggagaatagcttgaaaccggaaagcagaggttgcagtgagctgagattgtgccactgcactccagcctgggcaacaagagcaaaactctgtctcaaaaataaaataaaataaaataaaataaatgaaaaaggtatttataaattcagttagaagaactaaataatccaagtagaacatttatattaataatggtgagagggctaggcacagtggctcttgcctttaataccagcaatttaggagaccaaggtgggaggattccttgagcccaggaatttgagactgttctgggccacatagtgagaccccatcttaaaaaaaaaaaaattagcctggggtagtggtgcatgcctgtagtcccagttagtcaggagactgagatgggaggatcacttgagtcctagaggtcaaggctgcaatgcactatgattttgccactgtactccagcctgtgcaagagcgagactgtctctgaatgaatgaatgaatgggtgaggacaaaaaggacactatcccaagaaatttaattagctttttttgttgttcactgaaaatttgtttattaagttgttaatgttttacagagttcgttcaatattttatggaacttaaaatcctgagtttcccctcaataatacagatgtctgtaatacagacatttgtacaaactactacaattactgatgccttatataattagacttctataacttccatttgtcaggtaaataaaacacctttcaaagttaccacaactttaggagttcacaaattcctatttctgcagtttttcattagtatattttaaactttcataaaagaggaaaccaaaacctccaaatcaaaagccttaatatgaaccaacattgagaaacagagtaatgtaagaagctcttttattcatcacggagaacaaaaatacagaatatttttactaatttattttccactaaagagaatacactttgtatttagataaataaatgtttatttactgggagttgcttttggagaatgatccataattgccctatcaatggtcacatattgataccagggtccatctcttctcttccacattaatcttcgtacttccagctcctttatctgcagttcagccttttcagtttcagtgtgaaggatagccattgttctttcgtaattattttcaggatcatcatagaaagtatggacaatccatctcaatataggatgcttataatatgcccattgttctgggatatagccttctggaattcctactagttcagtttcaccaatgaatacattcactagagtttctccaattgccactggaatccctataaacaaaatatagaatttcagtaaattaaaaaaacacccattgtagaatccagaaggtttcatgataaatagtctttttcctatgatctccactgtgttaaacaggagtgacagctttaacaaagccacgggtgaggaagcccctgaatcccagtcgagcgtcaaggcactggccagacagctgtcactgcagtgactgaggcctgttgcaaaaaactcatggctgccttggctgccttaattagttttaaacgtttcattctgttaatctaatgtcgtatcttgattaaaacagatgtgtgttcattggtagtggtttcataagaatgtttataatgaacagctctacttttcatatatatttatctagcaaagtgagccattgtgatcagtactggtttaaggaaatggatatagattaatcatctctaaaaagaacatgatatggattgcagtgttccctttcatctgttatccattgtcattagagaatgagcttgaagttactttctgatagaaatgttatatcctcctcataatcctatctatttgaattaattgtcctcattgtaaatggcacccattcatgaaaagacagtcttttatattgggatgaggatggtattagatgtaagaagaaccacattgaaattctaatcatgttcagactctgaaacttttggttagtcatttaactttttctgcagctaacagtttcctcatctttaagcagtgaaataaaggtgagataataatgccctatctgtattacagggttataataaggatcaaaagaaataataaatgtaaaaatgttgataagcatatattactatggaaatggatgctatttagtatttattattggtgttagaagccagctaagttactagagccatgaaacagactctttgtatgaagctaattagcccccaagggaatttaatccataaccttgtatttattatcccatattcaaaccaactaatctaactggcccaagccatacactgtacttcttttgtacatatatttataaagaaagttaatttttcattattttagaggagtatttcacaaaatctttgaggatactgtattagtccgttctcacactgctatgaagaaatacctgagactgggtaatttataaagggaagaggtttaattgacttgcagttttgcagagctggcgaggcctcaggaaacttacaatcatggtggaaggggaagcaaacacatccttcttcacatggcagcagcaaggagaagtgccaagcaaaaggggaaaagcctcttaaaaaaccatcagatcttcggagaactcagaattatcaattattcattattcattattcaattatctccccctggtcccgcccttgacacgtggggattattacaattcaaggtgagatttagatggcgatgcagagctaaaccatatcattccacccttagcccttcccaaatctcatgtcctcacatttcaaaacacaatcatgcccttccaacagttccccaaagtcttaactcattccagcattaacccaaaagtccaagtccaaagtctcatctgagacaagttatgttccttctgcctatgagcctgtaaaatcaaaagctagtcacttcctagatacaatggggatacaggcattgggtaaatacacccatttcaaatgggaaaaattggccaaaacaaagggactgcaggccccatgcaagtctaaaatccaatagggcagtcattaaacctcagagttccgaaatgatctcctttgactccatgtctcatatccaagacatgctgatgcaagaggtgggtttccacaaccttgggcagctttgcccctgtggctttgcagggtgcagcctccctgctgattgctttcacaagttggtgttgcgtgtttgtggcttttccaggtgcatggtgcaagccatcagtagatctgtcattctggggtctggaggatggtggccctcttctcacagctccctaggcaatgccccagtggggactctgtgtgggggctccaaccccacatttcccttctgcactgccctagcagagattctccataagggctccacccctgcagcaaacttctgcctggacatccaggcgttttcatacatcctctaaaatccaggcagaggttcccaaacctcagttcttcacttctgtgtacctgcaggctcaacaccgcttggaagttgccaaagcttggggcttgcaccctctaaggctatgtcttgaaatgtaccatgactccttttatccatggctgaagtggctaggatgcagggcaccaaagagactgcacacagcgggagggccctggacctggcacaggaaactatttttctctcctaggcctccaggcctgtgataggaggggctgccatgaaagtctctgacatgccctggagacattttcctcattgtcttggtgattagcatttggctcctcatcacctatgcaaatttctgcagagggcttgaatttctccccagaaaacggatttttctttactactgcattgtcagtctgcaaatgtttttaaacttttatgctctcttcctcttgaacgctttgccacttagaaattttttctgccagataccctaaatcatctctctcaagttcacagttccacagatctttagggcagacaaaatgccaccagtctctttgcattgcaagagtgacctttattccagttcccaacaagtttcacatctccatctgagaccacctcatcctggactttattgtttatatcattatcagcattttggttaaagccattcaacaagtctctaggaagttccaaactttcccacattttcctgtctacttctgagccctccaaactattccaacctctgcctgttacccagttctaaagttgcttccacatttttgggttgcttccacatttttgcatatctttacagaagcacccaactatccggtgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcatgatcacgatttgggtgggaacacagagccaaaccctatcagataccaactttcctagcatttgtgtgttaacagaagtagtcactgtccagaatttataatgcttataaaaaatctacacaggcctttttcatatactgttaaacccttagatcttgctaaatatttagatattttagtaatatctaaaaaagtatatatgatcttaaaacataagataaataaactacaaatatctattgatatatatttcttcagttttttcaattatattttataagcatttaaacttggattatttatatttcaggcacaagtactctcaagttcatcaggaattccaggtcctcctgcagcacctccattgccaggtgtagggccgcctccaccaccacccgcgccacctctacccggaggagctcctcttcctcctccaccacctcctttacctggaatgatggggataccaccaccacccccaccaccacttttatttgggggacctcctccaccaccaccccttggaggagttcctcctcccccaggaatatcacttaatctaccttatggaatgaagcagaaaaaaatgtataaacctgaagtgtccatgaagagaatcaattggtcaaaggtaatactaaaactagagtttttttactttgtctagcttttgttgatcattgctatgtgtacacattgtataatgtttgagagtatgactgctgactctttccgttcctttgtgggttcatcattttatgtccatctttcaatttaggttgtagataattggaaactctccagatagtttgacattgtgaagcaggcaaaaggaaaatcgaagtgatgtagagaataatatttgaaatataccaacaaatgacaagcaattttgattcttttaacatagcttttctttaaaaattttttattgatatgtaatatttgtacgtatttatggggtacatatgatttttgctacatgcatagaatgtgtaatgatcaagtcagggtatttaggatacccatcacctttaacatttgtcatttgtttgtgttgagaacattcagatcttctcttctagttattttgaaatatacaacatattgttaactatggtcactttactgtgctatcaaatggtagaacttattccttttatctaactatatgttcatacccattaacctatctctcttcaccctcccacctcccacacacacccttcccagtctctggtaactatcattctattctctaccttcatgatactcactttttaagctcctatatatgagtgagaatatatgatatttgtttttctgtgtccagcttttttcacttaacatagtgatctccaattccatacatattgctgcaaatgacaggatttcagtcttttttatagttgaatggtattccattatgtctcaatactatattttctttatccattcatccgttgatggacacttagcttgatttcatatcttgatttcatatctttgccattgtgcctagtgctgcaataaacatgagggtgcaggtatctctttgatatactgatttcctttcctttgtataaatactcagtggtcagattacagcattattgtatggtaatcctgttatttaggagcattattgtatggtaatcctattatttatatttttgagaaatctttatagtgttttccataatggctgtactatttacattcctaataacagtatatgaaagttcccttttctccacatctttgccagcattttgtctttttgataatagctattctaactggcataagatgccagtaagatacctcactgtggtcttgatttgtatttccctggtgattaatgatgttgagcacattttcatatatcttggccatttgtttgtcttcttttgagaaatgtctacttaaattatttgtctactctttaatgtgattatttgttttgttgctattgtttgggtttcttgtattttttggatattagtccattgttggatagtttgcagatattttttcccattcaacagattgtctctttactctgttaattgttcccttttctatgcggaagcgttttagtttaatataatctcacttacccatttttgtttttgtttcctgtgcttttcaggtcttagccacaaaatctttgcctatattagtgtcctggagcatttgtcttgttttcttctagtagttttatagtctcaggtcttatgcttaagtctttaatcaatgttgagtccatttttatatattgtgggagatataggtcaggtttaattcttttgcaaatggatgtccagttttcctatcatcatttattgaagagggtgtcctttccccattgcatgttcttggtacatttgtgccaaatctgttagctgtaaatatatggatttacttctgggttctctattctattccattggtgtatatatctctttttacattagtaccatgctgttttgactactatagccttgtagtatattttgaagtcaatgtcctgctttgatctttttgctcaggattgctttggctattcaggctcttgtgtggttccatatgaattttaggattatttttcctattttttgtgaaaaaatgttaatggtattttgatagggattgcattgaatctgtagattgctttgagttgtatggtcgttttaacagtgtaaattcctttattctatgagcattgtctctttccatttgtttgtgtcctctttaatttctttcatcagtgttttgtagtttttcttataaaggtcttttacttctttggttaaatttattcctaggttttttatttttttgtagctattgtaaatgagattgcctttttatttttttttccagcaagtttattgttcagctatagaaacattaataaattttgtgtgttgattttgtatcctccaacttactgaatttattaattatatgagttttttgtggggtgtttaggtatctccaaatgtcagatcatgttgtctgcaaagagggacaatttgatgttgtcttttccaatttggatgtcctttatttctttgcttgactgatggctctggctaggacttccagtactatgttgaataggaatggtgaaagtgagcatcctagtcttgttccaattcttagaggaaaggctttcatgttttgtccattcagtatgatgttagcaatggctttgtcatatatggcatttattatatggaagtatgttccctctctgcctaattgttgagagtttttattgtgaagggatgttacattttatcaaatgctttttctacatctgttgagataattatatagttttcatttttcattcttttgctgtgatgtatcacgtttattgaatggcatatgttaaacaatcctggcattcatggggtatatcccattgattatgatgtattatcttttggatgtgctgttggattcagttccctagtattttgttgaggatgtttatgcctgtgttcatctgggatattctttaattgttgtgtccttgtttggttttcgtattggggtaatgctggcctcgtaggatgagttaggaagaatttcctgctctttagttttttggaatagtttgacaagaattggtgttagttcttttttacaagtttggaagaattcattagtaaagtcattagtcctggggcttttctttactggggggactttcttggtagattgtatgtgtccagtaatttatccatttcctctggcttttcagcttgttaatgtatagttgtccatagtagtctctgatatcttttgtatttctgtgctatcagttgtaaggtctcctcttccatttctgattctgtttatttaggtctttctttttttttttttcttttcttggataatccagctagtggtttatcagttttatcttttcaaaaaaaaaaaacctaactttttgttttgttgctcttttgtattatatttttaatctctgtctggctcagttctgctctgatctttattatttttttccttctactgatttggggtttggtttgttcttgcttttttagttccttcaggtgcaaaattaaactgtttatttgacatctttccattttttcgaagtagttgtttattgctatgaacatccctcttagcattgctttccacaggttttgatatattgtttttttaattttcacttacattaatacattttttaatttttttcttaattttttaattgacccagtggtcattcaggagcatgttctttaagtctatgtacttgcatagtttctgaaatctctcttattattgatgtctaattttatcccattgtggtctgagaagatactcgatatgattttgatttttaaaaatttgttgagacttggtttttatagtagcatatgatctatccttgagaatgtttcttatgctgatgggaagagtgtttattctgcagctgttggataaaatgttctgtaaatgtcttttaggcctgtttgttctaaagtgcagtttaaatccaatgtttatttgttgattttctgcctagatgatctgtctaatgctgggagtagggtgttgaagtccccaactattactatgttagagtgtacctttccctttagatctaataatattttctttgtatatctgggtgctccagtgttgggtacatatatattttgacatgttacatcctcttgctaaagtgatgcctttctatatatatatacatatatatatacatatatatatatacatatatatatacatatatatatacacatatatatatacatatatatatatacacatatatatatacacatatatatatacgcatatatatacacatatatatacacatatatatatacacatatatatacatatatatatacatatatacacacacatatatatatacatatatatatacacacacacacacacacatatatatatatatatatatatatatacctactttgtctctttttactatttttgacttaacatctgtttgatctgatatacgtatatttactcctcacttttggttaccatttgcaatttaatatcttctattttcagcctatgtgtgtcttgcaggtgaaatatgtttcttgttggaagcatatagttgggtcatgttttttagtacattcagccagtctatatcttctaagtgggcaatttaattggtttacattcaagtttattattgataggtgaggagttattcctgtcattttgttaattgttttctgttcattttgtgtatccgttgtttttttctttctttgttattgtttatccatgtggtttagtagttttctgtagtgttaacatttgagtcctttctctttctcatttgtgtatctgctctacatgtgagttttatactttcatgtgctttcatgatatattctctttcagacacgtaggacttccttaagcatttcttgtagggcttgtctagtggtgatgaattccctcagtttttgcgtgtttgggaaagacattatgtatttctccttcatttttgagggatagatttgttgggtatatacaactggcttctttttttctttttttcttttggcactttaaatatagtgtcccattctctcttggcctgtagcctctccaatatgctgcaccacgtgttcctgggatgtaggacaccttgtgggctagagtgctgggacctggtctcattgctggatctagccagtatcacaccactgcagtcatctgggtggatgtggggagatttcagtgggctccaaggatgtggagatagagtatcattcatccccagggcaggatgtagtctggttgggtttgggctctcaatctgttaccatactgcacctgctttggtcttggtggcatgtgtgggatccagtgtgaatgctcattctagagcaatgccattgcacacactgcagctcgctttgtatactaaagactagtttcagggcctgtggaggctgagtggctctcctatggctagaatcttcagagttcacagtgggaatctggaccactggggatatgttatttacccttttcccacattgggggagcgtctctgggctcccagctaatcacagccaggcttgctgcctggattcccgctccttccgtgcctcaggtgttttctgtaacttccctgccaaattccagtgtttttacatgttgtgattatctactctcttttttggccttttatggaggatatgagtgccacctgcctccagtcagctgaagcctattccccatttttcttgaataaaatcctttttattattgagcctttttatcttacttgtttttcttagtgaatgactttttttttaattttacactttcaaatagtgtggaataagtgacaatattcaatattgatataccttaattttttttgatgtatgaaaatactttcttctgaatgttgtttggctttattattattagaaaataatatgtctgttttaaaaggttattatgtagattgacacagtcctcattcactgggaactaattttctaatgaaaatccatttacccagacaaccatctggggaaatgtgtcatccaataacatatttacagtattagacagcatctatgtagtaagttggtttaaacagaatgatggttaaatcatttttcaatcttatgcatatatttatgctttgctcataagagtaaacttggagtaaatggttttagaatgtagttttctttttaaaaaattaagtacaattcatcaaaattcaagattacaaagctgttgcctagttatcttcctgtgttaatgtagtcgtatgcttcctaattttacaatttagtatacggtgtaatggtagttatacatcacaaaacttcatggtgtattggaagataaagttctaatcttgggtagtagttaagaccacagtcctctggagcacttatctaggtttaaaatcccagctctgccatttactaatttgggcagccacttaaactttcttgggctgtgtttcctcatcttttaatgtagagataataacaggtgaaaaaattattacgaggattaaattagttaatatatgcaaataacttaagacagtacctgacacaacgtaggaggcgtgtgtcagctatcattatggttgctaccttaaacctaatgagtgaacaaggggaattcacttttctaagtctgagtttccctgttttaaaaaacccaggaacaagaagattttatgtgagttggggttaggatttcctaagttatttttaagactccttccagtagaatagtttttaaggtgcaatttgctttgtggtctatttctattgttcaccatttcgtcacataattctgaatttcccaatgaatatttactttataagtattatttagatacatcctgaaattgacttagaggatagaggaataaaggaactgtcattcaaccttgctgaaagttagttccttgaaaatttaaatatgaggttataatttagaatctattctttgttatttttgtttcagattgaacccacagaattatctgagaactgtttctggttaagagtcaaagaagacaagtttgagaatccagatctctttgccaaattggcattgaattttgctactcagataaaaggtacatttttaaaaataaaatataagttcccgattcaggtacaatttaatttagtgctttgctaaaaatttctagtaatgggtatatgtatacttttcccacactggacagggtgaaacataaatagattgacatttaactatattttacctagtaaataaagaaggaaatttattttacctttgaattttattatacataaatgttattattcttctgaaaatacaggttttatttttattgttaaatatgtgtgttgcactgctccattataaaatagtcgtttttactgagaagcagggaagatgaatccgttgattcatcatgtaagagaaaataatgtaagagaacactaaagtctcagaatttttcatgaaattgaaataagattggtcccatagtcttaaatagtctttcctgtcatgcttgtattacttatcaatttggattcctaggaaatgttatagtttttgctataattagatattttctattaatatcaaaatccagtaccttataagtattgtttactgatttgataatagagtgctttgtttatgattagatcctttatttatttgcttgtgaatttcacagatgattttgttactatacaggtagcttctcaatctcataatagatcgttatggttcattaatttttggtattttatttcaacatgattatttcactaattattgtagaagtgatagtttagttgaggatattactttttgtctgaatgagtccttgcagttgaaaaatggaaataatccatactctcatgcccttggaattagcacctttatcattcatttgtctgatttgtcacattatgccttagaatatgagaatataaattttggaagatagagaggtgtgaaaattagtttcttttttttagattatgtacactggagattgttgtgctgtatttgttgttctttgtaaattgaagttcatatgcacacacaaatctggggtgattagactattctgaagaattttgacatttaaaaaaagttactactattaggcctacctttcttttttctcatttgatatcgcagacctcacatttaaagaatttttcaatgattcaagtgattgccatttattataatcactgtttaacgttaaaaaattgcttgtagcaaagtgttcatgcttatagcaaattattcatatagtaaaataaggtagtttaacaaatgtaaatctcccttcaatctcagacttacagcattttgcccagataaaatcattaattctaatttttcacattttctcctagaaatagtctatgcctctcaacacatatgtgcatttatcattttttgttttttattccttgctgttttcaccaactgtgcctaaagattattctgtaggtgcttgtgtttatctactgtgttctttttacatactgcatagaattttgtgtatgggcctatcttaatttaattaatcccatatcaatggctatttagattagttctagtcttttgcttgtttaagaaatgctgtggtgaacatgactccatatatgctgtttttcacaaattctacaagtaaaattcctggataaaatgctgtgtacatttacaaattttaaagatagtatgaaattacattctgatgagtttgtatcagtttataatgtcacaaagaatatatatgaatatctgttttcccaaaatctttgcccacctcagaggtgaaaatggtaaatcattgttgttataatttttgctttttgaatatggagtgagattgagcacattttcttatattcacaggcaattttattttactttcattttaaaaaataattttaactcttattctgtattcagggggtacatgtgcaggattgttacatgggtatgttgcatgattctgaggtttgggacgcaaatgatcccatcatccaggtagcaatgagcatagtacttgaccattagttttttaatccttgccctcttccctccctctgttctctattagcccccagtgtctattcccatctttgtgtccaagaatacccagtatttagctcccacttataagtgagaacatgcagtatttaattttctgttcctgcattaatttgcttaggataatggcctccagctgcatccatgttactgcaaaggatatcattttttatttttatatttatttatttattcattcattcattcattcattcattcatttattcattttgagacagagtttcggtcttgttgcccaggctggagtgcaatggcgcgatcttggctcactgcaacctccgcctcccgagttcaagcaattctcctacctcagcttcccgagtatctgggattacaggcgcccaccacccttagctaatttttgtatttttagtagagactgggtttcaccttgttggccaggctagtctcaaactcctggcctcaggtaatccacccgcctcgacctcccaaagtgctaggattacaggcgtgacccaccatgcctggccaggatatgatttttttttaattacggctgcatagtattccatggtgtatatgtaccacattttctttatccagtccattgttgatgggcacctaggttgattccttgtcttcgctattgtaaacagtgctgtgatgcacataaaagtgcatgtgtcttttgggggaaatgatttcttttcttttggatttgaacctagtaatgtgattgctgagtagaatggtagttctgttttaagttatttgagaagtctccgaactgctttctatagtggctgaactaatttacattcttaccaacagtatataagtgttctgttttctccacagccttgccagcatctgtttgggttttttttttggctttttagtaatagccatgctgattcgtgtgagatggtatcttgttgtggtttcaatttttcatttccctgatgattagtgttatgagcattttttcatgtttgtcagcctcttgtatgtctttttatttttattttatttatttatttatttattttgtgacagagtttcgctcttgctgcccaggctggaatgcgatggtgcaatctcagctcactgcaatctccgcctcctgggttcaagtgattctcctgcctcagactccccagtagctgggattacaggtgcccgccaccatgcccagctaatttttgtatttttagtagagacgagttttcaccatgttggccaggctggtctcgaactcccgacctcaggtgatccacctgcctcagccttccaaagtgctgggattacaggcatgagccaccatgcctggcccatatgtcttcttttgagaagtgtctgttcatgttctttgcccactttttaatggggttatttgtttttttggttgttgatttctttaagttccttatagattctgggtattagacctttgtcagatgcatagtttgtgaatattttcttccattgtgcaggttgtctgtttatcctgttaatagtttattttgttgtgcagaagctctttagtttaattaagttcgattcatcaatttttgttacagttgcttttgagaacttagtcatgagttatttcccaaggcagatgtccagaatggtgtttcctaggttttcttataggattttcatagtttgaggtcttacatttaattctttaatccattttgactttttgtgtatggtaaaagagaggctttcggttttgttcttctgcatatggctagccagctatcacagtgccatttattgaataggtagtcctttctccattgtttatttttgtttgactttgtcaaaattcagatggctgtaggtgtgcagctttatttcttggttctcttagtctgttccattggtctatgtgtctatttttgtaccagtaccatgctgttttggttacggtagccttgtaatatagtttgaaggcaggtaatgtgatgcctctggctttctgcttttcgcttaggattgctttggctatttgggctcttttctgattccatgtgaattttagaatagttttttttttctaagcctgtgaaaaatgacattggtagtttggtaggaatagtattgaatctgtaaattgctttgggcagtatgacctttttaatgatattgactcatccaatttatgagcatgagatgttcttccatttgtttgtgtcattcattatttcttttagtagttttttgtggctctccttgtagagatctttcaccttcttgattagatgtgtatgcctaggtatttcatttttttttttttggcctattgtaaatgatattgtgttcttgttttggctctcagcttgagagttattagtatgtagaaatgacactagcttttgtaagttgagtttgtattttgaaactttactgaaattttttatgtgttccaggaaccttttggcagagtctttagtgctttctaggtataggatcatatcgtctgtgaggagaaatagtttgacatcttttcctatttggatatcttttatttctttctcttgcctgattactcatccaagggcttccagtactatgtttaataggaacgatgagagagggcatccttgtcttattccagttctcaaggggagtgcttccagctttcctccattcagtatgatgttggctgtgggcttgtcatagatagctcttattattttgaggtgtacctagtttcttgtggatttttatcgtgaagggatgctggatcttattgatggctttttccatgtctatggagatgatcatatggtttttgtttttaattctgtttatgtgatgaatcacacttatttatagatgttgataaacattgaatcccagaaataaagcctacttgatcttgccagagtaactttctgatgttgtgcttgatttggtttgctggtattttgttgagaatttttgtgtctatgttcattagagatagtggcctgcagttttcatgttctgttgtttctttgccaggttttgctatcagggtgatgctggcttcatagacttatggaggagtccctactcttcaatgttttgaaacagtttcagtagaattggtaccagctcttctttctatgtctggtagacttcagctgtgaaactgtctgttctgggtgttgttgtttgtttgtttgtttgtttgtttttgtcatttttttttaatttaaattactgatttaattgtggaactcaatatttgtctgttccgggtttcagcttcttcccgattcaatcttgggaggttgtgtgtttccaggaatttatctatctcctctatattttgtagttggtttgcacagaagtatacataacagtctctgaggatcttttgtttttctgcaggatcatttgtaatgtcacctttgttgtttcttattgtgcttatttggatggcctctttttttcttttttaatctaggtagcggtccatttatcttgtttatgcattcaaagaatcaacttttggtttagttaattctttgtgtggatttttgggtatcaatgtcattccgttcttctctggttttattcatttcctatgctagcttttgcattgatttgctcttgtttttctgcttcctctaggtgtgaagctagatctttaatttgagatttttctaactttttcaggtaggcctatagtgctattaacttcccttttaatactgcttttgctgcatcctcaagattttggtatgttgtgtctcttttcatttattccaaaaaaatttttattttctgtaaaggcataaaatttctttttctgtaaacttccccctccatttctttgcatattttctattgagcatttacgcttttgattatggacttatttgaattgaatgctacaagaatcatagattttataaaattttagagttagtctggatcttagaagttattaaacacagactctttgttttaccaatgaagaaactgaagtaagagacaatgaggtaagtgtaaaacccattaaagatagcgtggtatagtaggaaaagccagaggaaataaattcacacatacttgcattccagctgtgatacttgtaacctcggagactgaattttctcatacataaaatgaataggctaatgtttacctggtagtattgtgagaattaaacaaggttatatatttaaagcactcagcacattggtatccctttcatttaacttgatgctctgtgtgtgtgtgtatgtgtgtgtgtgtgggtgtgggtgtatgtgtgtgtgtgtcttagttattgatgcttcagtacaactgttaattcagcaaaatttactgctcttcttttcagcacttggtagagctaatcagtcagaattgaagcaattcttactgcagctgccaaaacctaatcaaaccaaatcaaaaccaaacaaaattcatacaaaacctctcatgtatgtattgctgagaatgctttattttcattcctcttaacgttgattctttgaattttctctttcacgctactatgacttccctaattgtggatatttaagtagaaatctggacagtatcacctttcagaaccattacttttactaaaatttacttctgaaaggacatatacaggatcaattatgcatcatagcctatttcagacatgcacaccatagctaaaacaaattttaatgatactaaactgccattcttttgtaacacacagtaactattgattgatgttactgtaactgctgaagttccttgtcattcgcagtgccttgattcatactgtggtcaataggtggcaggtttagtaagaaatcagcaggagggtctgctttcatgaaacttaaacttcaccgcctgggttttcttttctctagggcacctttttcccccggtttgctgttcgttgcagctcactcagctgcattctggaaggagcatcattcctgtttttgctaatagctgtttcaaaacctcttagaccagtgttctaaaacctctgattatttttcactactgcaagaacataggagagctcatgcctctgtcctcactacgtgtactgtaaagcactacaagtctatttttcaggaacttgtttaagagctaaataggagctttaaaacacactagttctcatatctataatatttaaatgtttaaatatttaatatgtgaaagtagcataaaattatacttcctatttaaattagttttagagaaaattatttttaatgttttatttaaaaacagattatttctgttgtaggaaagaatggatgtcttgtttcatttaggttaagtttgtagagtatctattatgtgtgaggttctatactaaatgggagggaaagaaatgaataagatcttgtccaggcaccagggaactcacaatctactgagagaggtaggaggatgcccagtatacttagtcaagttgtagtaaatgttagagtagatactttttaaaaagctactggggtacaaaaacaaataattaattttgagtagggtcaatggagatcctagaggtagtataattagagttgggacttgaaattttaatagaatttctatagggaaagaaggaaggaaagacggcattctagctagagaataccatcagtaaaatgttaaaagaaaaacttgagacaaatcaaattttacagaattcatttgagcaaggaatcattcattaattggtcagcattcagaaccagcaggatttcagtgtgagcatcaacctttcatagtatgaacatgggaacaaagtagaaaagtcatctaattgtctacggatagtcatttatctcatttgggcgtggtgtgatgagacatttgccttgtctgggaataggctcatccattggctgcctacagttggctgaagtttcgctatttgtgattggctgaagctcagctgtttaaaatatacagttggcgtctcatctctgtgtaggcctctgcacccatggattcaaccagccatggacagaaaatatttgaaaaaaattaaaaatataatacgctgagcgtcgtgactcatgcctataatctcagcactttgggaggccaaggtgggaggatcatttggactcaggactttgagaccagcctgggcaacatagtgagaccccatctctgcaaaaagtacaaaaattaactgggtgtggtgatatgcacctggagtcccagttacttgagagactgaagtgggagggtcacgtgaacctgggaagttgaggctgcagtgagccgtgatcgtgctcctgcactccagccaggatggcagagtctcaaaagaaagaaatgtaaaaaatacagtataacaactatttacatagtatttacattaatagcagaaactgcaattccttttgcatcaacataatatttaggtattataactaatctagagatgatttaaagtatatagggggatgtgcatagcttctatatgaatactatgccattttatagcaggcatttgaatatttgcttttttttttttttttttttttttgagatagagtttcgctcttgttgcccaggctggagtgcaatggcgtgatctcagctcacctcaacctccacctcacgggttcaagtgattctcctgcctcagcctcctgagtagctgggattacaggcatgtgccatcacgcccgactaattttgtatttttagtagagacggggtttctccatgttggtcaggctggtctcgaactcccgacctcaggtgatccgccctcctcatcctcccaaagtgctgggattacaggcgtgtgccaccgcacccagccaaatatttgtatattttggtatctgcaagggctcctggaaccaatcctcagttgatactaagggatgactatactctttctttaggtttccatttgttaagttggaatgtaaagtttggagacagtcttgggccaatgatctgctgttcatttaatttattaataaggaggggtgaaatgcatactgccttgaaggcacgggcagtcagccttgggtcaggactctggaatgaagagactttgtggcgtaggtggcaaggaaacttcacgctgaagaattagggttttattctttaagcattagtgatttagtaatttggtgattagcccttgaataggctttttgtggacagataggtgatgggaatatatggataggtgatgggaatatatggataggtgatagatcattgattgtgagtaaatatcagtagactaggtaagatatgatgatatcctgactagtatgaattcttaatctgcatctctaaggtctattctagttcccaaatcttgtaccttcatgcttatgacatttacgttctactcacaagccataataatgtcatattacaaaatatgtttcaaaatactctctgaattcatgaaatatatatgttagaaacagctggagaatatcctgttagtagctttgaatatgtatcatatatgtaagtgttggaatttgtatatatgttctagttttgtttattattcaatttgatgatatttgggggcatagaatcatcaaggctagaatggtagtgtcactctcctttaaaaactatagtaattatagacaataatgatattatataagatttaaagtaatgatggttgatattaactaaatttgaaataataataaaatatgtagcttataactgctaattctaattagaatttctagggttctctagaggcttcaggaagaacaaagatagtgtgggtagaagttgtaagcaatttctttgcttttaatgttgcttggaggaaatacaagaaataaacataagagcttaataaaatttagcttctttaataatatatttctatagtgaaatttagctttaataataacagaaaattgaggtgttataaatatttgaaatgcatataaatgtcattttgcagtgcttgaaatattggacatagcttcaaccttatggtgtaactgagattgaagttgtgtgtatgtaaaagcactttttctttaggatcatattttaatgtgtgtttcttagtctaagaatcaactggctgcttctgaagacacccacccttgcttggttgctcaatacagtcttctatatttagtgaactaatgaaaagacaaaagagtggtaaagtgtaattcatctttgccttcataatatagaaattcttgcaattgacttgaaattaatgagatgtcagtctcagagtgcacagcccttgtaagatggtgctaacgtgtccagagagagttcgtgtcctaacaaataatttgtcatcttaatggcacaacatgcatccttctgtagtataagctttaatgtatatggtaacaaaccaggaaggcttaattctttcaggcagcaaactaaaaaccatacttaactatcttagtgtgtttgggctgctatcacaaaataccataaattgggtagcttataaacaacagaaatttatttctcacgcttctggagactaagaatccaagatcaaaatactggtatatttggtgtcttttgagggcctactttctggattatggagggtagcttctttctgtaacttcacatggtggaagtggtgagctgtctttctgaagtctttgttttaagggcactaatacaatcatgaaggctctgccctcgtgacataatcacttctcataggccccacctcctgataccatcaccttgtgtgtaggttggaacatatgaatttaagggggacataaaccttcagtccattgcaatacctgtacataatttcttttctttccctccctccctccttccctctctccctccctccctccctcccttccttccttcttttccactctgtaacccaggctggagtgcactggcatgattacaactcactgcggcctcgacctcccagggtcatgtgatcctccaacctcagcctccctggtagctgggactataagtgtgcaccacgatacctggctaattttttgtattttttgtagaaatagggtttcaccaggaggcggagcttgcagtgagccaagatcacgccgctgcactccagcctgggcgacagagcgagactccatctcaaagaaaaaaaaaaacaagaaataggatttcaccatgttgcccagggtgatctcaaacttctgggctcaagcaatccacctgcctcggcctcccaaagtgctaggaatacaggtgtaagccactgtgtccagcccataatttcatcattttaattatatctaaagttttttggatttctaaatataaataattgtttttgtatatcactttaccaaagtgttttttttttcattatggacattttaagtgtttcaacttatgatgacacacattaatttccagttgtcattttctagcattaatcacctattttatgtaaaagaaggaacaagggatgtttcagccagagatacatgacgttgtttaagtataagtcaccaattgtagagagaaagagagtatcttctgccttctaagcaaatagacttcaaaatagctccgtctttacatattgacaatatgtggtgagtgtactacttctattaatataataccatctctacaacatctagtaacagcaataatagtaataattataattaaaacaataataaatttattaaacattatatcccaagagcgattataattattttaaattcatatcataccaacctcataccaaccctaggtacttgtattgttgttttgtcggttaagaaactgagactctgggagattaagcaatattttgtttacatatctagtaagtggcaaaatggtgatttgagcccaagtttgttcttaatcttaatcacttctgtatgctgtaacaatgacttttaatggcttctatgcccttagtaatttgtgcattttgttgcactgttaactgatccctttttcatatggttaatcatatagttccacatatattgtattatcttgtgaaatatgtaatcctattatcctggcactaaagatagttcttcagagctcaaaccaaaactaggaagctgtacgttatccatggaaagaaataaggttctttctataatttagatttttttaggcattttctatgtagaatctgtcagtggtaaaacgttgccgtgacttgaagtctgtcttttctaataatgagggaaggaatgtggtcttcatgtcattaggcatttggtaatgatatattaatatagttgagatgcataaagtaatgaaatcaatttttcactttgactcttttgaaggtagcttcataacattacagacaccttgtgttattttaatatgacacttttagctatgagttaatgagactgcctttccccatttcagtgatttttgctgataaatatatagattaagcacaataacaagtgttctgttaatagcatttctaagtcatatagcttctcattcatatttggaatcattattctaagttaattagttttttttcttttttttttttaaacaaagtgttgctctgttgcccaggctggagtgcagtggcataatcttggctcagtgcaacctctgcctcccgggttcaagcagttctcctgcctcacccacccaagtagctgggattataggtgcacaccaccatgcctggctaatttttgtatttttagtagagacggcatttcgccatgttggccaggctggtctcaaattcctgacctcaggtaatccacccaccttagcctcccaaggtgctgggattacaggcgtgagccaccgcgcctggccagtagattagttttatattggcaaatagaaattatttacattgaaatccagtgggaaattgtaacattgctgtataaaactacaaagaggtgtgctttgttcttactggatattaatggcagttaaactagttccagagtatatcttgcatgatataagaagaataagagatttgtctgatttaagaaattaatttagagaggttcaaatctggtagcttttctgaagcattctatacaggtaatcttccatttagtcaattaatccttgttggtgagaaaaatttaatgcattcttttcaaaccgtatttcagtaatttgtgttcattactcagttttgcctaatttaaggatagccccatttatattattattattattatcattattacagtaatcactaatgttctttttagaacaatgcttatcatcttgtaaagtaggtgtgctgattgagcaagctaaattttgttattaggtgtctggcaaacacctaatgggagatgtcccaggaaattcaaaattataacagaaaaatatctcgtctattttaatgcatgcttctaggaatacagctgcacttgaaaacagattcacattttgtgtatgactattatgttgaaagaactttaactttttattttattgttgtgaataatattaattattaattattaataaatattaatattaattatggctgcataacccaatatccccaaatttagcaattaatagaacactcatttattttctcacagattcaggaatcttggcagatctcagctcagtcctctgtttcaaagttcctcacaaggctgcatagaagatgttgtcagggttgtggtcctgtgtgaaggcttgactggtgaatgatttgttcctaagctcattcatatgattggcaggattcagttcctccagagtgattggactgagggccttcattcttggatgtttgttgtccagaacccacccttggttccttgatcatggacctctcagtagggcagctcataaaagtccatttgcttcatcagagtgaaagccaaggagtgaagacaaagaatgaaagcaagtcattcataaggaagtcacagtcttttatagcctaatttcgtcattaataacatgtaactaggttcaacccttacacactgataggggaattactcaagggcatgactaccaggatgcaggaaacatttgggagtcatttaagaagctgcatactcacatggatatatacaatttgattttaacaaatgttatgatatctctttctttgatgacttcaacagaatcctaattggtctttctgccttctctcctgttttgtgataatcatggcattcccatgtttggaacatttcactgactacctcttcaggaggagattgaaactccttgtcatgtgtttcaaggttatttaccttttcactcccactaaaatgtacttagactgaactcctttgttcctggaacagagacacttaaaagacttggagacttctccctgaacacagtttaatttaaccaattcttcatttggcttgtatttagatgacacttccatcagaatgcagccttcacaatttactatcgtcttgactcattcacctccctcattagacactgagcttgcaggaaggaggaagcatttctgtttactattgttttctcgcatgtaccacagcttctggcaaatataagtatgtaacatacaaatgagttacagttatatatacttagtttcattgcactaagacaagtacaataaggtatgagtactaacccataattatttagtcacatagtaatgaaacaggaaatttttccagactccttcactggcggaaactggaatgagggcactggagctagccagctgttttggctggctgcaattgcttggatctgctgcactccacaccttgcaggagggggagcacagctgagttggtgcaggagccagggtgagtgcttctgagtgtcagcagaagcaaaactctggtgcgggccctgcagcagcatctagaggggagtacccacaacccccgaagccccagaaggagtgttacaggcaaagcgcttatagccatctgcagatggcttaagtgtttaacagctcagtggaccctgttccttttcacgagggcagagagtcagtgtaacagtcttctgtaacctgaactcttgtctggcatccaggaaaaatcagttcacacaattgaatttaaggatagtaaatgtaggggatgttattgccaatggaagtggctcttagccggaaggaaagctgggaaagggatggagcaggaaggtatttgtcccctgaagtccagctgtttccagctggactcttttctaaagtcctgccaatcaagccgtccctctgaagtcaagctgcttctctccaacgttcagctgcttcttctcatctccctttctctgctctcagccagtggaacctagggtttttatgggtacaggatggggggcagggtgggtcagagttggttttgggaaaagcaacactcaagtgggaaaacggggatgaaaagttttcactgtgggccatggttccaggcttgaaggtggagccctcgccagggaccctgcccttttctgcctagagcttatctgtctcctatccctatcagtaggaactcaccatctttagtaattcattcagtgtgtgtgtgtatatatctatgtatatgtatagaatatgaacctgtttcttgaaaaatccttctcattactcattaaataccagagatctatataattgagtctggctgtggcagtttgctaatgttaatttgtacacttatgttcccgtgatttagtaattcactccatttgggtgtttttaaaaaaatgtgtacatcaggccaggtgcagtggttcatgcctgtaatcccagcactttgggaggccagggtgggtggatcgcatgagaccatgagttcaagaccagcctgggcaacatggtgaaaccccatctctaccaaaaaaaaaaaaaaaaaaaaaaaaattggccaggcatggtggcatgcacctgtggtcccaactacttggtagactgaggtggaaaaatcacctgaacccagggaggttgaggctgcagtgagctgtgatcatgccactgcaatgtagccttgatgacagagtgaaccctatctcgggaaaaaaaaaaattgtatacataatcacatattttctttaaagttttcaaatgtgaaacttagatttttttttgtttcaaaagtggttgtggttgatttagtcaataaagttttaaaatgtatggttggcccacttaaataaacaactttagtgggctgacatatatgtccatttcttgatttgttgtttcattctaagtaaaatttttaatttctttttgtctgtttaaaaaataactgaaatacaataataatcaatagaataactatcaaaaggttttatgagaatgaagataaatatatatcacagattcaaaacaaactgacaatttctgtaattatatgttaatatttgttgtgccttcactatatgccaggtactttgtgaagttttgacatggattattacattcaattttgttttctaccctatacagtaggtactgttattgaaatcattttgcagatgagcaaagtggagcttgaaatcaagctcaagcagggtgattccgtagcctacatgctacattactttgctgtgtttacgacataaacaaagacttggaaattgaatgtattagcacaatcctgaatccacagcttgtgcttttaaacactactggatcactctgtagtataactgtgcctatggctctactatcaaaaatctcacttcaagatccctttatctgccccacaggacaagggtaagggtattaatacatgaatttgtaacctctgaagtaccttattcttgcctacccgattctacctagtttatgtagagtattaatacatttctattaattggacccagtaaaaatgtacccacaaaagacagaactgaatgactccatttgcccactaaatggtttacaacatattgaaacatgtctctcaatataacaccaatctagaaagagtgaaaatatattgaggttactaaccaccctagattaagttttccattgtgtgcctggtctgcctttgttttatccatggccacatattaatactattctgatttccccctgcttcctggcactgtttcctcttgttctttgtcatctgttgatactggcttaaggatcattggatggctgttaattaaattaattttgtaggagtctaagcaaaatatgtgatgcattcaaatggcaagtacaactactgtgaattaacaatagttcctccgttagaatggcttactgagagctgactgtgcctggcttcatgtgataagaataaactgataacttgcttctggcaatgtgttaggaatgtgttgtttcctagcatgtaattgcttttaatagtaggtaacaaaaagtaactactctgtgacatgtgatgctattaggatatttgtaattttctttgaaaagagaagctggtgtgattaggtaccttttgttctgctaacagcagtgataaagatgctatcactcctctcataggttttacttactatttgctcttgcagaatcagatcacatccctattaattattggcattttggttctattttacatgcttttgttttctgaatgctgacaatttaagcattttaatgattgactgcattagcaaatattaatatagctgcatgatagatcagcatatggttctgaaatctttgtaatatagtgtatagacattcatttttaacattttcgtaatccatttccgggcataaactgaacacatacacagactcatcagaaatttcttagatttgaggcagggttttgggacacaagcgatttttaaatacttcagactgcggcaaaatttagctaagggattccttgttttttagcagttcctgagaagacttgcaatcagccatattttggggggagtgcgggttcacttatattctatgaaagcaatgggattttttttctttagtgttttctacttgaaggttttttggtctgctaatgttgtctattatctttatgtaatgatgatgccaccccctctaattagtagagcataatactgttttgatttttagtaataatgtttttttaactgatcatatcatccatatttgcttaatatttcctgtaactagtgacactttttttatgatgacaaggggctgggatagagtttgtggccatggtgcaaaacaaagctgactgactcagtaagcattgaattcatgaccttagtgttatcagcatagtgctctaaccaacttaaacaattggccacaggtaaataatatgtgatgacaaaaatagctaaagttttcagccattttaagctgataatatttgctttctgcagtagcagtgcctgaggcagcttcatattatagctctcttaaattgtttaataatgaagacttttgaacatgctttttaaatttagtgcctacctatatcacaatataacaatatataattgatcttatatttttttcaaaaggcaagtcaataagttgttgattttgttatttttagggacacaactaaatatattttaactaaggtttattgagagagagagagaattacttgtacaaagtcttttctgcattgtatcaatattatggtgtcatttgcattttgttccagtgatagtctccatttcctccaaccctcagagacattaaggcaattatttattgtaatcaactctttccaatttaataacgtttttgaaaataccattatcactttccttggtgggcagtttatatttgtgcctcagtgtttatatattgcataatatttccctgaaaattattaccaagaactaagtttaattaattaggatggaccctagttagaatctaataaagtagtggtcttaagagtttgttctggtttttatgaattttgcaaatggttataaatgggtaatctctttttataatttagtatttatgtggtatatgtagcttctttcagttatctgttttaatagaggggaacaaatgtacagaactttgaaggtatatgtggaagggaaaggtaattaaatgtttttatggtaatattatttttgtattttagtatctttagctcagatctatttatgttcccctagactaggagtaagaagcaaaaggagtagtgagaacaatcaacctctggtcagatatttagggattgtttagagatcttttcaaagatcatctgtaccttttggcagcaaagcaaaaaatgggctctaggcctttgggaaatttgctatgtaggtccattcttaggccgtaagtttcctctgggccatatgttaaagaaaacccagttatctcgtattgaattcctttatggtcaaaagaattactagggacttatgctattgggggtgtaattttaagttgtgaaactctttttgttgattgtctgaattcattatctccattatttgtctcttgcagcaacagtgatattgctggtcagggtccaatgtctcaggattaatatggttagaattgcaacaaatatatataaaatgaattaattcataagctgtgctagatttgttttggtctgtggtcattctgttgactggttgttgagggttctgcacgttccttagccgctgggcaatggccaaccagaaatatacatgtgagctggaaattcagctgtttatttaaacaggagcacagatagcatagacagaaaggagttgattcatatggtatttgttatatactgtacattcttctgaacattttatatatattaacccatttaattaattctcatggaagaaaacctgtacgacaatgttgttatcttcaattatataggggagataactgggtcatggggagattaagtgacttagctaaaggttacaagcgtaacagataagaaagctgagttcccactcagtgctcttaattagtatacaaactgccagcttccaaattcatttacacgatgtcagttgtataactggcagtctagattccttttatatatttatgaagtatataccatattgtagaactgtagtcttatttcactggccttatacatgccctgacgggtctaaagcttatctgagtaccaggatgggtgtgacagcagggaagagaatttgtctggatcagtgatataagctccagtagagtttctagattatccacatttctgtctctctgagttgcttctgagtctgagtagtattactcattcttggcatctaagggttctttttgtagaatcaagtcttgaagatgacatttgcaattttggaaggacatgagaaaccctaacagaagttgctgctgctgttttaacccctccaattttgtgtttgtaccaaacacaaacattttttcagtctttcctattgatacggctatataaacagatatattccttatatactgttatataaggaatgattcagaattcctttataagcaattgctatgttttgcaagtttatttcactatcatgtaaaaggccgaggattctaaaccaatattactgtctttcttttgatatgtgtattgatcattattccctaccatctacccttactgaaaggaggggccatatgggattagattgtcagtaatgtttttatatcttccttgaggcctctagttcatatgactcttagaaatgctgtaacctaagtacctaaattatattatcatgcctgttatgtaaatattaatgctttcctaatagtctttgaagtgtggggttttgagttccaaggtcattttcaaacatctcctaagaggtgactgttagcaggggcaggcatgacagcatgcttctttgactgaaaggaatcgatatgtcaacttatcaaaatatgttttttttaatgctgtttcaaacagattgcttttaaaaggtcttgaaaaaatataaaccaattaaaagttgtggaaagcttaattttataataatttttgtcaaattcgttattaaattgaaatcatactgtgtcacttttattttttgcatgaaaaacacctacttatttataagaatcattttatttaatgcctatcatactggctcactaaacgtttggtgttcataggctttcttttctaattttttgcactttccagttttgaattagagtcagggattatatgaaatattttaaatttgagtaatcaaaaaggaggttatataaaaggactttgatgcatggaaatattaacaatgtgcatgtatattaattgttgaacattatgagtaattaaacctatcaatagttacttaaaatttgtttgattttaatatttctgaacaaactttagcctgaccactgccattgaggaagttgactttaggaccaaccaactttccatgtaggaagtaacagagttaccaggacattagagtttgtgacatgactgtttatagaatgtcaatattttacttatcacattgaaattcatcattgatatctttgtagaggaaatgaaaatatgccctgctttattattcatatttacataacagaaatacaagatttaaggcataaatgtgttaataatgccttgactcttaaggacatgtaccctgaaattaataggactaaagcaacctctttcccttaccatgtagagattgacaattggggcacatgaaatattagacatctctttgccagtcaaaatacacaatactttgatgtactgataacttttaatgaaggcaccagctatgcgttaaataaaccattcaatagacttaatactaaccaatgttcagaatttgctggttgtggaaaatacatttttctagaggtatttaatgctaatctcctttactaagcagtgattaaagattttttgagaccaaattttaatcaaagataaaattttttttacaaccctttcaggtaatatcataagcctaaattcagtgtaactgaactttagaaaatagtccttttgcctatttctttcagaaatacacacctcccttctctcaccagacccagacacctgcataatcaacatagggataaatttactttgtttcacaaatcttatatcaattgatgtttgggtattaggagctacatttctgtgtataggtgttaataagaaatgatggcctacatagagactaatttgctgtagaaatgagataacagcattattctagcaattcttccaagcggccattgaggctgtcctcctcatcttatttgctcattcaacaaatatgtattgaatttctatcatatgccatacactactagtttttacagaatggttattactccattagacctatgacccatggaatgagtaactctgaattctctgtggtagaaatggattttgtttatcttgttttgccatgctagtatctctttctttctgtattttaggccctgcttgcttacttagactcaagataactatttcttcctcctcctttcaggaatctcctaggatccaaattttgttttgttgttatttagagatgcttaaactgatgtgtattaactgaatcattgtgtactatgatacacagtgttttccaaagcccttctgcttattgtcttatttctagcctgtttttatctgagtcctctcattgctttgtaaactcaaatatcaatatgatcaaaaagatccagtcaactttggggtcactgtatcttgaagtttagaaatgggaatagagaagacaacagttgagtatccaataagagaaaaaccaagatagtgataaaaagtattcagagtagtggaatatgcttgccacctcagtaggcatttggtttatagaattactaattaattttttgttggagaaaactgcttatattttcttggaaatgtattttttattttcaagaagtatgtagcaaacagtctttccagaaagtatgggttccttaataatgttcagtaaattcattattctatacattcttatatttagaaatatatatatatattgaggatctgctctgtgccagatgctagtctaggccttgggggatatagctgtgattaaggcgatgtgatcttgactgttttagaacttaaagtctaacagtaaaaatataataataaacatgtaattatattactgtgagtttcagatagtattggtgctctaaagaagataaaatacagtaatatgatgggaaagtacttaggtgggggcttaagtgtgatggttatggaaaataactttaaaagcatatgagttgggaaatttgaaaaacataccctcagaagcagaatccagcaggacttgttgacggattggatgcagtactttttttttttaaagcaaagaatcaagatctcttttagatttggggcttgagctgaacatagtactgtccaataagtatcttattgtagccactgaatcagaaaaggctgaagaggatagtgttgacagaaaaagtggtcagaggattaaaacaatgtgatcatctagaaaaaccatctgtggatgtactataccaacattttcaaaggtaagaaatacagtgaagctcgaattagtttagtgttggtacatggaaataaattgtatggctttatcattaacctttgcttcaactctagggatttgtgctttgtttgattggactgtagagacaatctttacttttctgtctatgtttaactatttagtcaaatgaatattgcacctctaagtgtttcttttgatttactgtaggctgaggtcatactgtgtactaggcgtgaattaattacaaattgaacaactttgctctagtgaagagagaattttattctcattccaactaaatctatgatccaagaaagatctttatattctttgtgtgtccgagggggactgaaagtatactcataaaaacctgttctgattttaaaaaaagaagaaatgaccttcatttcttttggatcttctactaaatggctttaaagcatcacatcacaaagtcctcttccccatagaaataatattctctatccaggaaattttaaaaggtttgcattatcttgttcttgtggttgatagtaaatttagcatttattaattattgacaaactgccaaaatggatcatacatatgttacaaaaaatcttttgtataaatttcaaagtattcttaatgtggctttattgttatttatgatagatcactaaggtctctctcacttatttcttcgtgctccattcttaagcagccatttctctaggaacttagtcctacagaatgagtggaattggtaaagtaattgtgatcgttgatgatttcctcatctttttaatccagaaaagttagcaacaaacctgaattcttagtgggttgtctgagctttgcaactttatccaggaccatggaagaatattccaactgtactattttactgtatttcagtttggcagagaggtattttagcaccattataataacctcatttatgaaagtgttggagaattgcattctataagataatgtagcttctctgtatgataatgttttcacacagtgtattagtgcatgtggaagtatattggaattgagatttgctaacctgcatctaagatagcttagtttatttgattagtgaactccaaataaattattttggagggcccctgggaagtatataagaaatttaaaaaccaactccttcagaccactagtttcccttctgtttatgatgtttatcacttcacatttttaattagtaaagtataaaatgaatcatacacttatagtagtggagttttttgtcttctagaagtgacatcgtaatagttattttaaaacatgtagagagtcatgcatatgtatgtggaagggtaatcaacattgttttaatgtcttatgctaagttgcacatacaaacacatcttttaatttatggaagttacttacatttctacataaaatctcagctgtttgtacatgtcccagactatactggattctggtttgctcagttattccttccttattctgagagtttagcaaagggaaaatgtcaacctcaccctagagaaagtagagagctaagcagtagaaaaagctatttgtgccaggcttggaagaccccagtctttccatttctgcctttcaaagaagctctttctaggggcatagtactaaagattgagccagggcttttgttctggttattcattgcacaagggtgccttgctgatggtttgattaggggctgaaatttgacacgggttctacttgtcaagctgtgtagccacaggcctatttccaactagagtgcgcatttccgattttcacaacagtatcatatagtctggagacagcccaggcaggccatagtatagacagccactgcacctggctcttattcttcatagctccctcaaagtgttttctgcaatacttcctgctctgtgctcctctaccctgttttttaaatttttttttcgaaaaagttttgtttgttttttattgatacgtaatagttacgcatattttgggggctacatctgatactttgatacctgtatacagtatatagtgatcaaataaaggtaattgggatctttctttttcttctgagccttttctttgctgagaggaagctaataccactaagggtgcttaattatttatctttgttggaataaggtaaatgttaccttgaagagttatatttgctatcattatcaatatcactggagtctggaatatatcttagtactttctctcttttctcagtaaccccttccttcaaaatgcagcatcttaaatggtagtttgtgtactttctgacttctcagtgaatgatgtaattttgttcattaaaaaaaaattcaatttaaataaacttgcaggtggaaggtggaaaataaatcatgataatggctcacacatagcatttactctgtgctaagcattgttgtaattgtcttacatgcatcaactcattttatcttctcaataatcctttgaggttacttattattagtccctctttttttttttttgagatgaagtttcgctcttgttacccaggctggagtgcaatggcacgatctcagctcactgcaacctctgcctcccaggttcaagtgattctcctgcctcagcctcccaagtagctgggattacagatgcacgccaacatgtctcgctaaatttttttgtattttttgtagagaaggggtttctctatgttggccaggctggtctcaaactcctgacctcaggtgatccacctgcctcgccctcccaaagtgctgggattacaggcatgagccaccgtgcctggcctattagtcccattttatacctgaggaaaataaggcaaagagaaattacataacttgcccaagataacacagataataaatggggacatagtgattgaaaccaaggtatcctgttttatggtgtttttttttttttttttttactatgttataatttatgaatttgctaattgcttcaatattattttctctttaacttttcatcaagctttacagtaaatcattgcttatttgttttcctgctattcattgaggataaagtagcatcacatcagtagctttaagaggtttgccgtttaatctgtattgcttttagaggttagcacgttataaaagccccatttccataatggatgactggaaaaaccaggttgctgtatatatgtgaacacatatataactaacagtttgttttctctgtctctaagcttgtggggtggtataaacaaacttcagtgtactttaagtgcagttactgtgcttcaactcataagcatttctttagaaagaacatatactctgaaatatctagcatgcattgatgaagtaatcaaaatcttgatctctaatatcttttcaaagggtttccttcactgtctctttcccctggaatatattatgcatctctaggtggtcaaacacattgagacccataccctgactaaattttcataatccctggggttcacaattgttatttaaagttcatagatgtatacttcacaagtataggggaatatccttgatatgcatactgctagaccactctctagcctgaaatgttaatatgatgattatagaggagttggatccatttagaactattaggaagattattgacagtaatattttgactggttagttggcattaaacctcaatagaactgtgaaaaggtgattgggcaaagggcagtgataaaaccaagataatgaaagcacataacaaaagaagatttaccctttgtctttttaacacaagccatgttatttgtcatagtccctttaatactttagtacttgctcctaattaaaagtatttctggaaagagatctggaacagagctttcctgacaaaaatcagataatggatgatgttttgtaatactgagcatattatatctcataccaacatatttctttctcttttaagccacaggcatgatatggaatgacctgcccattctctccctgctacttccccaaatagttttcctattccttttatttaaggtattattccgatgtttgtgttagcaggcaatgtgcctttgctttgcattttgtatatccaattaatccatgtgtgatgatcacaactgattacagctcagggaataagatggggtgatgatatgactaatgcatacaggtagaattaacaagagacttttctagaaggtgttcaaagggcagaataaagagactatctttaagtggggaatcagtaaagaagtctacaaacttgcttctagctgaaaagatggtgtaagtgtcaattctgttgtgttctctctctcccaaaagacctggtgggatacaaacaagttacaatgacttcattctagagaaaacatggaatccactttgttttgttaaaaagttcttgaatcaaaaatttcaacaaagtatttacaaaaataatattctgtgtcttactttaaaactgatgatatcaatatcacaccagtgtgacaagacactctgattgtggtccactggagaatgttccatgttaatccagaggaagaattacttcttgtcataggattattggtgaagaaggccagtagaccaatatcttgactttttgggagagagttttataccttaggccctcttggcagctagagatactaagatgaataagatatggtttgcatcctcgaagaggtccttattttcaaaagagaggatgtgtattagttcgttctcacactgctataaagacatatgtgagactgtcatttataaagaaaagaggtttaatcggcttatggttctgtgggctgtacaggcttctgctttggggaaggcctcaggaaacttataatcatggcagaaggcacagtggaagcaagcatatcttgacatggctggcaggaaagagtgaagggggaagtgctacacactttcaaacaaccagatctcgtgagaactcactatcatgagaatagcaagggagaaatctgcccccatgatgcagtcacctcccaccagctccctcccccaacactggggattacaatttaaaatgagatttgggtggggactcagaacgtaactatatcaggcagatatataaagtaattgctatactacaatgtggtaacttctataaagaggcatggaggaataatattattaaagaataattaaagatgaattgagatgtttgcagagaaaaataatatttgaactgggatttcagggctatgtagatttttatttccaaaaaacagaagggtcttcagggcagaagaaactacatggacaagggtatgataaagtgtcacatcatggggagtaaggcatggaatgtttggttggagaatgtggtatgaaggacaggagggaggtacattggagacaactggtaaaggatctttttactgtaacctatgggtaaccttaaatgtatttttaatcagggttttgtgatggtatgatcaaattgcattttagaatgattgcttttggtaggaaagtttaggattgatgggagaaaattaggagttttttaaacaagtctcaattggacactgtaatgacttgaactaaagcagtagaagtgaggatgtaaagggggagctaaatatttagaaagtgaacttaacagttaattagtgacatattaaacttggggaagtgagagacaaaggggaagcagaagtctaatatgattcccacgtgtcttgctcatgcagcaagttggatgacagtgctacttactgcgatgaggatgaatgggaaaaacaaaagttaagcttcagacataatacatttgagaaataagatagttaagtggctataggctactgtcttgtaggcagtcatgtgtagaaagtttgtagctcagaagaatatatggctttgagggagaggttgggagtccatccacgtatgtatggaatttaaaaccatgagaatgtataaaattactgtattagtccattctcacattggtataaggaaatacatgagacagggtaatttataaaggaaagaggtttaattgactcacagttcagcatggctggggaggcctcaggaaacttacaatcatggcagaaggtgaaggggaagcaaggcaccttcttcacaaggcagcaggaaggagaagtgccaaaagaagcaggaagagccccttataaaactattcagatgtcatgagaactcactcactgtcatgagaacagcatgggtgaaactgcccccatgattcaattacctctacttggtctctccgttgacacgtggggattatggggattacaattcaagatgagattttggtgaggatacaaagcctaaccatatcaattacctgaagaagaactgtagaaagagaaaaataaagagggcccaggattaattgctgaatgctaacatttgaagggccaatgggaggaagagcagccagcaaagaaaatgccaacaaagaagtggcaaaatgaagaacaatatgatataataaatgccgggagaagaaactgtttcaggaagaaaggagggactagtttcgtcgtgtagattattgcttaaagtcagataaaggcagcaaatatattttaggtttggcagtatcaagaatgttattgatcttaatgcattattttctaacacttagtgtagatggaagccagattggaattctttggagtttaggaccattggaggtatctgttgatgtcagtcattgagataatacaggaggaatgtaacgtttgttaagagaaagaaagaatgaattgttaaatcctattgaatatgataagcagctggagatgttcagcaactagcaaagcatatgatctggaactcacagaccagtctgggctgaggctaaggattttgaaggtattcagtagttgaagcctcactgggtattctcagccacatttcaaaataaaattgggtccaatttattatggaaaattggcaaattttattaatatataataccttacagcagtacacacatcacagtttacaaaggagacagttgacaaatgaatgaaatgtgttagtttagccctctctaaagattaattatttgaatacactctaatattggttaaggcagttaatacctgaagagtatattttctttttttttttctcagttaagtggctgtaggctactgtcttataggcagtaatgtgtagaagattgtagctcagaagaatatatgaagagtatattttctgagtctgggatcctagttaatattaaaaaaatgtgacatcaggcattcatataaaatccaaacctaatcaaagcagatagtcctatttaaataactaggcttgaaaaaaagaaagggttaacaactcaaatcttgaatttgtttccattgtatttacaccctagatttctatgaagtgccacattacattatatgcttatttatctctactcttcacctagagataaaatacagtcagacaaatagctgagaatctgaaattcaaagcagttcttttgaaagttaattctccagtaagtttctccagtaagtttcatcctcagattgcttcattcacaatggagtataatggttggttggaaatgtggaaatgaccatttttgatttaaattacttttgtcacacagtttttgatactagcaaagaaaacattgaatatgattgacctagttaattttaatttcatacaattcataaaagttatgttagtaattttacagagtaaaacctttatccatttatgcttctgaaaaatgaccttgtaaaatgtcagaattgccatggtatgcttttgaaaaatacttaatgatttgtgcttgatgcatttaaactctttattgaaggtcaaggattctattagggcatttttgtcagtaaaatgttgacagaaatgaactaggtagttgaattctcactgacaatactgtcacaattgttaagaaattgtctaatgataaggccagattttgctcattatttttcttagtaactaccactagttcattaaatattgccttaattagagtgtgtgttaagtgtcaaaacttaatggtcacagtcacaatccttatttaatagatacttagtttgaattgctatagttatattattctcaatgactgtgtatatatgccatgcatttggatgagatggaattgtgtgggtattccaaaagcactgatgattatgttgatttcagtgtatttttgatattcgatattgagcttagatacccacagtttgatctgtgaaatcacattccaaactagtaaagccacaaaataaaagcaatgaagtaaagctgggatatattcttattttcttatttataactctttcctatcacctaatcagtgcagtatattttgcgaacagtcagatttgttgccacctaaaataagagttgcagttgtttcatggtgatagtttttctcacctctgacctcgttaaggagatggttataaacacaattgttttaaaggcctaataagacatgtgaatatagtgtaaaaaaaatcttgggattatctcttttatttatgtcagtgattacttgaatggaaaattcctaggttagtctgtacaaagatcacattcctctgtgtatttttgttatctatacttagaggtgcacatatttatgttctgttgatatagcatattgagaaatgtttttaaatgtatgcatcctagagatgctatcgttgtagtatctaggagttgtataagtatggtgaaattagccctcagaatttttttgcctcagtgtgtaagataagcttggatggtatgtacagcatcattcccccatacatcgtgctccgtggtaaaaatgaccttttaacttaggtttttgaatcacatttagcaaattgatgcatatcctatgactccttgggtttttgccaagatttttcattgtagtattcaattctgttaaactttgtatggcatacaagagtcatgcgacttctggttactaatgattatagatatgtctcagtctcaaagctctgaatacaactgttcttcatcttatgagattttgtgagtttcataggtcttatggaagaccttaagtcgtcattgccctttctctaggcaggactgtattcatacctccatctcagtaatcatcttcattttgttaagaatcttcaatgtcttgtgtactttgttggattttctcatttcatcagatgattgtgatcacgatcattttgattatattaaatgtcacacttttaatattccttatttgaaaagatatttcagtggatagcataaacattaaaggtgaggtggtgaatttagtgcaaaatgtgtaaggtaggcaaccagctatcatttgtataattcatgcttttgttacaaatgccattgtccactaatgctgactttttatcagcttaaattgtgggaggctatattcgtagttaattgacagaattttatagaggcagcaaatgctttttatttaaaggacatccttagcttctatatcctgtgatataactcgtgtattttgccagtcagtagaagtagtaatgcactgaagaaatgtatatattgtacctcaataaaaatagtaattaatatttacctttaacttctgtggcattttttaggatatattaataaactccatgtcacttatcacaaaataaggagaaaaaatacctaaaatctatttcatattttctgtcatagtttactgagcagatttttgaattggggggagaaatgacagttgtattagaacaaactcaatttaatgatccctctatttttctttctataagaaaaaaaatgataatgctcagtttatggaggacacattaatcatttttagtttgaaaaactggattcttttcatattattaaaactttttgatgttgattgaagccaaatacgttttttaattgtctttgatgatcaaaatgagggattcatgtacctgcatttctctgccaaacgtagccctttactatagaatatatattagtgaacttcacttgctttatttgttctttatgctgatctgcaggaggtcattataaaatgtgaaccaaagacccactagcaaatagcgctgggttagagaagcaggattagagatgcaggctctggagccagactcgttgggttcaaaactcacttaaaccacttcgtaactggtctgatcttgggtatgatgtcatatctcagtctcttcatctataaaatggggataataatagtatgtaccctttaggattattgacaattgagttaataattgtaaaatgtttaaaatggtacctgctgcatattacagatggtattcgttgtaatcgtttttatcactgtcaataatgtccacttattatagcagcagatatttttgaatccagggatgtagtcaattctttgtcatctgtcttcagggactgtgacctacacctttgacaattttgacagtattactacctgctcagcttccctatagtgtctgtgagctggctagcaatttagtacactgatcttatttggtagatgaggaaactgtgggccagtaataaatttacttatggttataaagctggtaattaagagtctaatttcgattggctgggcacggtggctcacacctgtaatcccagcactttgggaggccgaggtgggcatatcatgaggtcaggagatcgagaccacggtgaaaccccatctctactaaaaatacaaaaaattagcctggcgtggtggcgggcgctggtagtccagctactcgggaggctgaggcaggagaatggcgtgatcccgggaggcggagcttgcagtgagctgaatttgcaccactgcactccagcctgggtgaaagagtgagactgtctcaaaaaaaaaaaaaaaaaaaaaagagtctaatttcgaatatagctcttctgatgacttgtgtggtagtacttgtacttcatggcttaagtgtgtctatgtatttttctttcatttttgaataatgagttccttcagggtaagaaccatgaagtaaatgtacaaaatgttggtacatgtatccattgtttttggttttccagggggctaaaattaacactgaaatgcaattgatatagtttggctgtgttcccacccaaatctcatcttgaaatgtagctcccataatctccatgtgttgtgggagggacctggtgggaggtaattgaatcatagaggtggtttttttcccatgctgttctcatgatagtgaataagtctcacaagaactgacgcttttataaagagcagttcccatgcacatgcactcttgcttgctgccgtgtaagacatgcctttgctcctcttttgccttccaccatgattgtgaggcctccccagccatgtggaactgtgagtccattaaatttctttttctttataaattagccagtcttgggtatttcttcatagcagcatgaaaatggactgatacaacaatttatggaattatctttctattgatatctgttatgaaactatgtatttatacacctaaaatgtgataaaagtcacactcgagaatggaagagaatagggttaatgacaaacaaaagaaaaagacgcaggcattggctttaaccactgtgagtacaagacataggctaaaaaagaaatcagtgataggaatacattatttcccaattgtccactttcaaagtaaaggcctggcaattgtggaattgaaatttcttttatcttcagtaaacagagatggctaaaattttcacgactcatttaatcccgtagcttttagctaaatagtgttcattcatctctcttgattcttaatttagtgattcagatttccataaacatgagtttctgtaaaacatttataatatttgcccatgtgccagtagtcctagctactcaagaggttgagatgggttgatcgcttgagccctggagttcaaaaccagcctgagcaacatagcaagatgccacccccacatacaaatgaatacacacacacacacacacacacacacacacacgtatgtctactttgagttttgtaaaattatatttcctttaaatgaaaaatgtagcactagtgattatgaaaacaaaaattagtattttcccaaagattaatctgccattgttatccatcagttcaccatctaagccccattgctctcaaattcaatgttcagtgtgtttgaactgtacccttgcttcaaccaggccaatttgttttttctcacttatccacactgtcacactgtcagcccatgtgcctgtcacataccacttccccaaataaaatttctgatacatttgactcaactaatcactgaacttactcctttacagtctcctttatttcttctaattattcctgataccagctttgagaatactgaagagagttaactatgcctgagtggagcctttcattttcttaatatgcattccattaacatgagcattttgttcctaaatgcccttgagttacttttaaatgttccctttggtgtcctcaacctgtttctagctttttgaaggtaagaaacaggtcatctgtttgttttgttcccttcacaacaccagtgggtgttttgttcaagctatttcctgactaacttcctcagtggggaaatgttcagggtatgcaaatttattttcaattaacttacataatacaaaactgggtaaatacaggagttgaggtgatttatgattgctttaaaacacaaagccagtcgaggtgcggtggctcacgcctgtaatcccagcactttgggaggccaaggcgggtagatcacgaggtcaggagttcaagaccagcctgaccaacatagtgaaaccctgtctctactaaaaatgcaaaaaaaattagccaggcgtggtagcaagtgcctgtaatcccagctactcgggtggctgaggcaggagaatcgattgaacctgggaggcggaggttgcagcgagcctagatcacgccactgcactccagcccgggcaacaatgtgagactccacctcaaaaacaaaacaaaacaaaacaaaacaataaaacacaaagccaagtgtatttattattagtatggagtgtatcagtgttgaattctctctgtatctttttttatttttttatttttaactctaatggaagaagatcctagaaactttaaggattgtagattatatctgtagccttgattttttttccactttgcttgacaaaggtaatcctatttagcaatgtatttaagtgcctctgcatttgaaagaatgttgatttttccaaatagggtacgatattttatgaaagttttttttcttgaaaacagaatgagcatcccaagatcagacagagaagtaatatatagatataattagcttttctgtttaaaaaaaaaggtgatggacaaatactgtcttgataattcaagtcaataatccacaaatgtatattagtctcagtggctgagagtctgtgagtctgttgtcactcagtaggtcaaatctaatccgtgtatctatagtctcttaaatactcatttgcacattggattaactgtgtgtatttaagcattacatgtttttatatagctaagcttgagtatattattaaaagttttatccctttactttgcaatgaaaagaagtgataatttgtaatgaatatatatatatatacatatatatgtttgcatcagtgtcatgtggcccatccctatatagagtggaacacgtatgatcaaactatctgagtgcaaagcctcaatttcatttactgttgtgacaactaatgtttaatgttagcaaagcaacagataaaattcacattttactaaagcaagaccatattgattcatagaagactttagttgttaattcttaggtcaagatctaagtatgtttcccttttccttattatttttacttgctgtatcagactgaccacttctcagtatattattagttatgagatagaaaaatgaattatgttctaagttttcttaacatttctaattctttttaatttttattttcgtgggtccatagtaggtataagtatttataaagtacattaaatattttgatacaggcataccatgtgtaataatgacatcagggtaaatgtgatatgcaacacctcaagtatgtattcttttctttttgttatacacaatctaattataatcttttagttattttaaagtgtaaaataaattattgttgactatactcaccctcttgtgctatcaaatactagatcttacttatttcatctaactatacttttgtacccattaactatgccttctcactagacacctacctttcctagcctctgctaaccatcgttctactatctatctccatgacttcaattgtttgaatttttggctctcatgaataagtgagaatatgtgaagtttctctttctgtgcctggcttatttcgctccacataatgatcaccagttccattcatgttgttgcaactgacaggatcacattcttttttttttttactggctgaatagtactccatcatgtatatttaccacattttctttatttattcttctgttgatggacagtttgttttgttccaaatcttagctattgtaaacagtgctgcaacaaacataggagtgcagatatctctttgatatactgatttcttttcttttgggcatatacccagcagtgagattgctggatcatatggtagctcaatttttagttttttaggaaccttcaaactgttctccatagaggttgtactaatttactttcccaccaacaacaatatacaaggcttccttttaatccacatcctctccagcatttgttattgcctgtctttcagatgaaagccattttggctggggtatgataatatctgattatagttttgattggcatttctccgatgatcaatgatattgagcaccttttcatatccctgtttgctatttgtatgtcttcttttgagaaacgtctatccagattttttgcccattgtttgattggattattagattttttcctattgaaatgtttgagttccttatatattctggttattaatctcttgtcaggtgggcatttcacagatatttcctgccatcctgtgggatgctctttactttgctgattgtttcatttgccttgcagaaggtttttaacttgatgtgatccttttcgtccatttttgccttagttgcctgtgcttttaggatattactcaagaaatctttgcctagtccagtgtcctagacagttttcccaattttttcttgtagtagtttcatagtttgaggtcttataatctattttgatttttatatatagtgagagataggggctagtttcattcttccacatatagatatccagttttccaaataccatttattgaagacattgtcctttcccccaatgtatgttcttggcatctttgtcaaaaatgagttcactgtagatgcatggatttctttccaggttctctattctgttccatttttctgtgtgcctgtttttatgccagtaccatggtgttttggttactatagatctgtagtataatttgaagtcaggtaatatgattcttccagttttgttctttttactcaggatggttttggctattctcagtcttttgtggttccataaaagttgtaggatttttttcttggtaggttgtatgtgtctatatttgtgaagaatgtcactggaattttgatagggatcacattgaatttgtagattgctttgggtagcataggcattttaacaatattgaatcttccaatccatcaacatggaatatattttaaattttttttggtgtcctcttcagtttccttcatcgatcttttagagttttcatggtagagatctttcagttcattggttaattcctagatattttattttatttgtagctgttgtaaatgggactactttcttgacttatttttcagattttttgccattggcatatagaaatgcctctgatttttgtctgttgattttgtgtcctgcaactttactgaacttgtcagctcttatagttttttgattgagtcattaggtttttccaaatataaaattatattaactgcaaatgaggctaatttgacttcttcctttccaatttggaggtcctttatttctttctgttatttaattgctctagctagggcttccagtattatgttgaataacagtggtgaaagcgggcatcctagttgtgttacagatcttagaggagaagctcttagtttttccccattttcagtatgatgctagctgttggtctgtcatataatagctcttattgtgttgaagtatgttccttctgtctctagttttttgtgggtttttatcatgaagggatgttgaattttatcaaatgcctattcagcatcaattgaaataataaggcttttatcctttattctgttgatatgttacatcacattgatttgcacatgttgaaccatccttgcatccccaggatgaatcccacttggtcgtggtgaatgatttttctaatgtattgttgaattcggtttgctgttattttgctgaggatttttgcatcaatattcatcagacatattgcctgtagttttcttttttaatgtgtcctagtctagttttggtaatattggccttatagaatgaatttggaagtattccctcctcctctattttttttttttttgaatattttgagtatgattggtatgaattcttctttaaatgtttggtagaatttagcagtgaaaccgtctctcggatttctttactaggagacgttttattttggcttcagtctcattacttgtttattggtctgttcaggttttggatttcttcatgattcaatcttggtaggttgtatgtgtctaggaattttattttatttttttggggacggagtctcacttctgttgcccaggctggagtgcagtggcgtgatctcggctcactgcaagctccgcctcccgggttcacgccattctcctgcctcagcctcctgagtagctgggactacaggcacctgccaccttgcccggctaattttttgtatttttggtagagatggggtttcaccgtgttagcaaggatggtctcgatctcctgaccttgtgatccacctacctcagcctcccaaagtgctgggattacaggcgtgagccaccacacccaatcactgattttagtggtttgatcttgctttcctagttcattaaaatgccttgttatttatttgaagtttttctttttttttttttttttttgatgtaggaggttatagctctaaacttctttgtagtactgcttttgttgtatcccatcagttttggtatgatgtgttttcattttcatttgtttcagcaaatttttaaattttcttcttaatctctgtattaaccaactggtcattcaggagcatattgttcaatttccatgtttttgtatagtttccaaaattccctttgttattgatttctagttttattccattatggtcaaacattcaagtttttttaacgttttaagacgtgttttgtggtatgtccttgagaatgatccatatgctgaggaagaaaatgtgtattctgtggtccttgcatgaaatgctctgtaaatatctattagatccatttggtctatggtgcagattaaatctgatgtttctttgttggttttctgtctggaagatctgtccagtgctgaaagtggagtgttgaagtctctagctattattgcatagggttctatctttgtctttagctctaataatgtctgtttcacaaatctgggtgctccagtgttggctgcatatatattttgaatcgttatatgctcttgctgaaatgactcctttaacattttataatgaccttgtctctctcttcttacagttttgaaatctattttgtctactcctgctctttttccattggcatggaatatctttttccatccctttattttctatgtgtgtctttataggtgaagcgtgtttcttgaaagcaacaatgcattttaatgaactataaaagcaagagctttttttaaaaaacatttaacccctctatgtcttttgattggagaatttagtgcacttacattcaatgttattattgataagtaaggacttactcctaccattttgttatatttttctggttgttttgtggtcttctctttcttctttcctttcttcctgtcttccttttagagaagatgattgtctctggtggtgtgttttcatttcttgttttttattgtctgtgtatcctttgtatgttgtttatttgaggttgtcatgaggcatgcaaataatatcttataactcattattttgaactgatgctaactaaacactggttgcataaacaaacaagcaaagagaaaactaataaaaactctacactttagcctcatccccttgctttttaactttttgttttttctctttatatcttattgtactatgtcttgaaaaattgttgtagttattatttttgatctgttcatcttttagtgtttctactcaagatatgagtagtttacacaccacaattacagcgttacaatatcctgtgttttttctgtgtacttactattaccggtgaattttgcaccttcaaatgatttcttcttgctcattaatgtccttttctttctgattgaagaactttctttagcatttcttgttgatgaaatcccttaacttttgtttatctgggaaagtgtttatttgtccttcatgtttgaaggatattttctctggatatactatctcggataatagttctttttcttcagcactgtatatatgtcatgccactctctcctgcctgtaaggtttccactgagaagtgtgctgcccgatttatgggagctccattgcatgttatttgtctcctttcttttgatgattttaggatctattctttatctgttacttttgggaatttggttgttaaatgtcttgaggtaatcttatttgggttaaatctatatttatattctatatttcttgtatattggtatctttctctaggtttggaaagttttctgatattatctatttgaccttttaaggctgttttctttttttctttttttttttttttttttgagatggagtcttgctctgtcacccacgctggagtgcagtggcatgatcttggcttgctgcaagctccgcctcccaggttcacgccattctcctgcctcagcctcctgagtagctgggactacaggcgcctgccaccacgcccggctaattttttgtatttttagtagagatggagtttcaccgtgttagccaggatggtctcaatttcctgacctcatgatccgcctgccttggcctcccaaagtgctgggattacagatgtgagccaccgtgcctggccttaaggctgttttctatatctagtaggcatgcgtcattctattttattcttttttcttttgtctcctttgtgtatttttaaatagcctgtttttaagcttactaattgtttcttcagctttatcatttctgctcttaagagactgatgcattcttcagtatgacattgcattttctaacttcagaatttctgctcgattatttgtaattatttatgtctctttgttaaatttttctgctgggattccaaattccttctctgtgttatcttgaatttcattggatttcctcaaaacaggtattttgaattctccatctgaaaggtcacatacatattttcctctccaggtttggtccccgatgccttaattcatttattgaggatatgttttccttaatggtcttgattcttatggatattccttggtgtccgggtgttgattaattaaatatttattgtagtcttggcactcggggcttgtttgtacccatccttcttgggaagacttttcaggtatttgaagggacctgactattgtgatctaagtttttggtcactgcagtcgtatcttcactaggggcatcccaagcccactaatgctgtggcttttgcagacttgtaggggaactgccttggtggtattggataatatctggaagaattctctgtattgtcaggcagagactcttgttcttcttccttactgtctcctaaacagtctctattctgtgtgctgagctacctggagctggggaaggggtgatgtaaatgctcctgtggcgaccaccactgggactgcgctgggtcagacctgaaggcagcagaacactggttctcatacaaggcgtatggtaaacactgccaggctattgcctgtgtttgctcaaggccctagggttctacggttagcatgtgccaaagccagccagggttgtcttcttcccttcagggcagtgagtaccctttggccttgggctgatccaaagatgccatctgggacccagggcctggagttggtaaccttagaaatctgcctagtgcttttttctgagagccgagctgggtcccaagccacaagacaaagtctgtcccacacttccctccccttttcacaagcagaggaggttctccgtgtggccatcaccaccccaggcctgcagcaaatactgcttgactactttgatgttcattgaaggccgaagggctcttcaggcagcttgcggtgaatgcctcctggcctgggactcacccttcaggtgaatgtgctcccctctggcacagggcaggtccagaaatgtcatccaggagccaaggcctggaatcagggaccacaagagcctgcttggtgttctaccctgctgtagcagagctgatacctaagctatgaggaaattcacccttactcttccctctgctttcctcaagtaaaactagtgtctccctgtaggcatcaaagctgtgaatgtattgggtcacacctgaagccagcatatccctgactgtcattcaaggcccacagctagtatttcctggctaccactgctaactacttagtcagtgcccaagggctctttagtaagcaggtgatgaatcctgccaggagtctgtctttcccttcaaagcaatgtgttcccttctggaccaggatatgtctagaaatgtcatctggtagttagggtctgcagtgggggctttaggactcttcatggtgccctgtccttctgtggctgagctggtatccaagtggcaaaacaaagtcctctttactcttccctttcctctcctcaagtggaaggaaggggtctctacctaagctgtgggctgcactgcctgggtggtggtggggggctgacacaagcactcccttggctgaccctaatggtatctcactaagttatatgcccccaaccaagtccactgactccgtgcccaccacaccaggaggagttgcccaggaatggcagttcttgtggccgagactgtgttataagttgatttaggactgcagaacactttagcctgtggtggtgaggtttgcagtgaatcaggtacaaattgctggcatatgccctacctctcttggttagggcttatctaaatgttccctctgtgggcactggctgagttctaccccatattgctttctgctatgacatgtcagcattgggttacaatgcaaagtcccacaatcattgtgctctctcttcccaaagtgcatagaatctgtctccatgccatgtggccactgccaggaggtgtatgttgggggtggggagtggtgggatagggatgggggggatggtgttggtgattcaaaatggtctttcctaccttcttcactgcttcttttcagtggtatgaatttaaaaccaggtactatgatagcttacctgatttttggttctcatgaaggtgatttttgtgtggatggttgttcaatttggtgttcttgtggggaggatgatcacagtagacttctatttggccaccttgttatgcttgcctcctgtaattcctgtttcagtttattcatcctgaaattaagaagtagaagagaagaatggcagatagtggctttcctagaggaaaattttatatgacgtttcagaacattatttttattgttatgaaggaaatttagtacttgtaaaaattatcatactgaacagttttagatcaaacctaggtacaactacggtatgatctaagatgacatatagatctttcccattgtacttttccaatgcaaaccacacctctttcctgtctttatttttgtttctacattttcctttcccttttatttcccgtttccaggcttctccctatcttctctttttcctttagtctgttctacacaaatgtgtgcttagcagaaaattacaacctatactggagaaggaaacaatctaaatctttatatctttcaaaaatttaccccacataatattattcatgatcatgatgaaattttcaaatggttttgttttacttcaaaaaggaaactcaagaaaagaagcaaactcttaattaattgctgtaattcccatatttgcctacgtgtatatgttcctgttatccttttaaattaaacacatgaatatgtgaattacactcaaagtattcttctctgtaaaaattacagtagtcataactatttataaatgataacctgaagcccagttacttcatagtcctttaaattccatttgataagcatgttgtgtattgtttagtccttgctcgcttcatttgttcatcagccattcatccaaaaaaattttgaggatctgccatacgttatgttctgtttgggctgggctaagacaatgaataaaatgagattcctgaagtggaattcacagtccaattagagaaactggtgtgcagatgaaccgataagttatactgtagtgtggtaagtattacagttgaggtgcaagaaaactgccctgggaatcttaaatttgcctgttaagatcaacatttgagaatgttttacattggaagcaattttgtttttcaagaatgaagagggatttgtggcctgttgcagtggcacatgcctgtaatcccaacactttgagattccaaggcgggtggatcacttgaggtcaggagtttgagaccagcatggccaacatggtggtgaaaccccatctctactaaacacaaaaaaaattagccgggtgtgctggcacatgcctgtgataccagctacttgggaggctgaggcacgagaatcgctggaccctgggaggtggaggttgcagtgagccgagatcgcatcactgcactccagcctggttgacagagcaagacactgtctcaaaaaaaaaaaaaaaaaaaaaaaaaaaaaaaaaggagggatttgctagttagagaaaatagtaaagggtttttccagcagagggatttatatatgcatgtaaggcactgttagagaatgatgttacaaagttgagtaagatggttcctgtttggaaggaaccctttttgccacttgggagatggacatgaaaacaattagccaccactcattttggatagtgatattgtaggttaagattctacaggaacatagggagatagtatttctcaatttgtctcaactggaaaagctttataggacatacaatcgtagtgctgaacaaaatagttcctgaggtgaatgacctcaatgatcacaagataatagccactaacatttattggaaggttactctgtgctagccactgttctaaacacattacatgcattctctgatttaatgttcacaaccatctgaagtagatactattattgaagcctagttaagggaaaaaatgttgaagctccagatggttaaataactcctctactctctcatggaaatgacagaactgggtgttgagctgggacagtttgactctagattctttgtccacatgtatatcccatgaaaatggaacttattaaatggcatattgtcattttatataaaatttgaacagttttatcctcacttccatttgtcacctctttaagtacatttctcactattcttcagtgtacattttctaatccaaactgactaaattgtacactcttttccaacgttatctttgtaaacttactacctctgtgcatttaatagtaaacaacctaaaatatcaagttcttcagtattttgaatagttaactgtacacatttctttatatgggtgtgggattatagaaaatttaacatttattgactgtctctcctagcaaaggaaccatagtgggtggttcttcatcacaacattggaaaatacatattattaaagaatgttatagctaagaacagtgcaaataaaccatttgtccaagttcacacagcagaatctacatctacagtttcttcacaccactttttatattcttttcctttgcatatcccacctctcaaactaactggaagccacaggcaatcttgctgcctctctcaacttagctaagtctctcccttgctgttgctcttgtttgcctgctgatgctggaaggttcaggcatccacactaattcagtaatttagaaatgtatttaattcagtaattaggatttctttaatgccagcacttaggcctcaactactgaggtatggcgtgttcactgacaaccacatgaagtgacagctgacagcaagggagaagacaaaatacctataaaaagcagacagaaaaactattaaatgacagcagactgggaccatgagcctttcctggtattctctctgtgcatttctctccaactgaaaactgacaagcaagagcagagcagctgtccacccccttttctccatgactattttctgctcattgaacacagaaagaaaaagtgggggagggagagttatttctccaggcctttcagtttgctctgtgtttagtccatgactgcttctttttccttataaagatggctgtacaacagaccaaggcaatgctcagctctcagcaactttgttaaccaattcaaggtggtttcccaaggaggcttccttacggcatcattctgttcttgcagactgcttttctgcagtgaactcttattcattctgccaggttcaaaggctactttttccctgttgctttccctggtcaaatgggtcttcaaaaacaaattctggagatgagatctctgactaacattaggaaatcttggtgcacttgcagggtgatgtttgagataacaaatctggcacctggacatggcactggagtgggagaagtttggggcaggggcatgagctatatgactgttttagcaaccaagaagtaagataactaaaacttagaaactattaatagctatggacatacaagggaaggaaggcggaatcagtgagcattgatgttggagtcaaaggattgactggctgataagcctaggaaagtagagaatggctctgatgatagaaaaataggaaagagcctctttgtgatgcagtgtattatttctatctttcccatgtttattttcatgacacagtgggatgtataagtagtgatgagttttaagcaacagaaatataaatatggaaagatgagctttctaagattgtcagtgaggagagaggaaccagaaatacattattgcactatggggttaatgacaaaagaaggaagaggtagaaaagaagggatggtgatcattgtttaagtaatagttcaggaagatggataatggaaaggaattcgggggaaatttacaggcaaagtgggaatatctgcgaaccaggttgttgggtcctaaggagggaatgtgatttgtttcttggctttgtttcttagattttattttcgtaaaatttgcctttttgttttggatttctggagttaatacttctgttgcgtacttttctttgcctctatttctcctcatacttgttttccactcttcctcatgaaacataatgtttttatctgtttttcctaatcccagtataaatcttggcatccacctttacaacaccttgaaccagataaattctacagcttctactgctctgagaactatagacatttgtcagaaactgcctgtgagagaccatcagcttttttcagagtgggtaggagaatctgaagctctagtgtggtgcttaatggcaatgaaaacgcgtcagtgtgcttgatttggaaacaggcactgccacttactagctaagtgaccttaggaaagttatctaacctcttacatctcaggttccttatctgttaaataggaaggacaataatattacctcatagggttttcatgatggtaaaaataaagaaaatatttagtggtctagtccatggtaaatgttatatgagtgtttggtgccattattattgttattgtgttcttgttattctgatgtatcagtatatagagttaaaacatgtgtatcgcttaggaatatatccaacttttagacctaattttattttttagtatatttgagaaagttatccttaaagcagttgcttttattttaaaaataaaatgtttaattctgtctctgtaaagaatggataatgattacatgaaaacatatttcagaaagaatggggataagtagcattgtttaaatctaaaaattatataaataacatgaaagatacatggggaaaaaattaggctacatatagtgttacagtcatcaaaatgtaccatatttagcttaaaatattctgcaatactaactgttatatgggaaccaattaaaaaggcattcttgaggatatttcatttcttatcaggtaaataaatgctctgccctccataaatctaccactatttcattttggggaaggtcttgttttgattttcattgatgcacaataaaaagtgactcaagtcaattgtttccattgtctttcctatgtgtattcatttgtcatttattctttaagtgacctgccttctgacaatccttccaagcttcttatagtagcaagtatccaatatgctgaccttacatcaaagttactttttctattgtttgatgttattatctgtgcttaaaaaatgactcgtgtaaatatgtgtcggtgtacatgttaacatggcattttctaaattgggtggctttgtaacacatcttcctcaatttaagcaaatactgcctcaaaatatcttttaaaaaagcctcatgtatggaggttgcagtgagctgacattgagccactgcactccagcctgggcgacagagcgagacgccatctgaaaaaaaaaaaaaaaaaaagcctcatctagcagtttacagcagatgatctgtgtaagacaaaattaatagctgtatctggagtactctaaatgtggatttatacactaacctatatattgatcaattcctctatgcttgctttggttttgagcaaattatatttaaataagtttgttgctaggaatgtcttaaaaagctactcaccctttttgttagaagtaagtaaaatgattatgtcaggacctgccattaacttggtatagtacgaatatatcctcagaatactgataaaatggtatgtcttgaaacaaatcacaaactgtcaatatgttggtgatgaatttcttctgttttcatttggatcagtaggtggggcagttcaccaagtgtgagatcgacatttaatgttttcatgaaatgcaaacccatcagtggctaatttgtgaaaaatagatgttgggcttttcttaaggctaaattgttcccatttgttttagagaacaactcacttagcctatgagtttatgcaatttggcagaaagtgaaaacatatttggaagtattgaaagtcactcattgttgatcttttatattggaatgccaaggttgcatcatcagagtgtcgttatgaaaaaaatcaaataaaattagaagaaagaatcagccttctttataaacagagagatactatatattttaggctactgatctttactgtgtctgtataaaacgttggtcatgttgatggagtttatgctttctctcttcaggttcattctgacatgtcaggatatggaaagtccttttttccccccttaatagtttgagactgtagccactgtttccagaatggagtgctattgatacctttgacaagttgcttgccacaaagaaaattgctcaaaaggagctgcccaattcttagctgctatgtatttaactgttgtcacggcttctgttgtttccaagctgtcccaccataatgtaatttgttttaatctcttaaagtatatcattgcttacatcattatgcccatctactttgtttatagctgcctcagctcatgctgcaagtcttcatggttgtgtgataagaaagagaatatatcagtttcacggagaaacgtggtggtggtctagtcttgctggttaatgttgaatgtgactattttttaaatccttggcacgactggcagtctgtgaggtgtgtcacgggcctccatcatggtggtgggtatgaagctgtgcactacttctgtttttaacaccttccttggagctgcctgaagaaaattgcaggaattttttaggcacatctactggaaagtgcttattttaatatttgtcaacataattaccagaaaacattaaccctgaagtgtgtctctcaatacaaacttgataatcactaaatatttttaatataggcctttgaggaaaacatcgtaaatatcattagtcttatttttctctatgaattttatttactatacattagttgtttagaattatcttttttctcctttgtttgatggtagtgagagaagaacactactttttggaagattataaatagtacattaagtgaaaggtcataaatactgtaaaacttcaataaagcactgggcaacaacatgaattcacatatgcattgaatggggaggaagagttaggaagtgaccctcaagaatttgggaccttctttgttcattttacagtcatatatgttcaatgtaagttccactgtccttgttttaatgctttcatgagatgatatagataaattgaaatatatggtttttaactaaattcaagataacacaagtctccattttatgtaatttaattttttagactccacctgtgatcttatggcgcagctcgatggcagttggaggtgcaagtgattcccaataatgaatcacctttcaaatgtttcaatgatgatgtgatagaaaagacagctgcagtagtgtgacttaaaaagaaattacctgactgcccttttttcccaattactggcacaatcttcatgaaatccaaataaacttaatagaaggaggaaaagccatgtgagtggagctgacctgccacaaattaattatacttagtactttgtgccagcatggcatggtggagagccaggactcgagagaaacacataaatatagcaggatcttagttgcctaggtgagcaaggaaattgctgcttgcaaaacatgttggaagttattagttagcataagatgttttagcatttgcatttattaatctgacttatgcatttaaaatatgtttctgtattttacaagaccagatctggaggaggctaaatgccccaagtttcctttcacaccaacatcatatgctcatatatattcagttgattaattattttaaataaagtgcagctgtcttgtcatgttaacaggcctctaattttatttgcctattcatatgtgaaacaggagaggctagcatcttaaaaattcagtgtaaaagtttatatgtacatgtttattttataacattttggggtgatttttaaaaattatttttcagacattgtcaaataaggtagtaaaacaagattcaggtattattggttcttcatttttatttttatgagaagtactgcatttgctttgctgctattgcgacagcattgccagtagaccaacatataccacatatacttttgcttttaaatcctgcttaagatacattgattttaatagaggaaattagtgatatattaaaaacccatgagcttaattagccattcacgaatgactagtgctatattctatttgttattgttttaattaacagactactttttaaagagcattttaggtttactggaaaattgcatggaaagtcctatgtatatgctcatctcctccctgctctccagtttcccctattattatcttgtattagtgtggtacattttttacacaataatcaatattggtacattactaaagtccatagttcagagtttactctctgtgttatatagttctatgtgttttgacacatcatgtatctaccattttagtatcttacagatgggtttcactgccctaaaaatcttccgtgccctacctattcatgccttcattcctccctccaaacccctgacaaccactggtcatttttctgtcttcatggttttgcctaaatctttccggattctttcactgagcttctgcttctttcactgagcatttaaggttgttccatgtcttccaatggcttgaaatctcatttcttttatcgttgaataacattccactgtgtggatgtaccagcacctaccaaaggacatcttggttgcttctaagttttagtaattatgaataaagctgccataaccgtttgtgctcaggtttttcctgtgtgtgtggatataagttttaaactcatttggataaatactaaggagtatgactgctcaatcatggtaagagtatgtttatttttatatggctggtgctactttatccctatccctccagttttattttgttttgttttttgatatcggattaatagaattgaactaatcacaatccctttgttcttaacccactcttatcattgatttgagggtgactttttatttaattagttatttatgataatatagtaagtacttctgacctcaccacccaatacaaaatctagatccttgacaatcacatatttcttaagtgtgtgtactcctttgcatattccttgcctcccctaacctgaggccagtgctattttagttttaaatttaataatgtttccatatatatattctacatatatggatggaattctaatatatatacggaatatatatattctaagagttcaatgattatttaagacatacttctctagaataatcatccaaataatttaaaacaagattttgcctctgaatatgtaataggcattaatagattttcacttggattttctaacattagtttttatccattttgatgccattcctagtattaatgataaatttttcattggcaatataaaaagaaagtcttctgctaaaaaaactaaggctgttagtgaagttataaaaatcacaaaagactaggattgtcgcatcattatgtgaaacagatccttgggggaatacatcagattgtaatgccacgactcctgtattttaaatctacctgcaccctaaagctaatggcaataatgccatttcaactgaaacatcaactggattaaaaaaaatcctaaaggacaaggaaaattcaagctcttggctatgcagtgctgcagttgacccattcacttctctgttcaggtaatctagttaacacaggcttcagtatcaattcattttaacaaaggatggttaatgtcattgtttgtaacattttctagtgagaataaacctgaagcatactatataaataagcccttgcttgcgctgactcaggaacacaattcttaatttacttagtgctctctgcagctacttgtgtatgtgtgtgcatgtgtgtgtgcatgtaggtatatcttatggaacttgcttctaattaacaatacattagtcctcgctacttctaattagcaatgcggtagccctgccttatccacagggggatataaaacccacaatgaaactgcggatagtaccgaactctgtaaatactatgtttttttcaaatacgtatgtatttacaacaaagtttaatttgtaaattagccatagtaagaaactaacagctataataataaagtagaacaataaaaacagtatgccagcatcactactcttgtgcattagggccgttataaaatagggttacttgaacactagcatgttacctctacagttgatttgataaccaagacaactactaagcgactaatggatgagtagcatacacattgtggatatgctggatgaaggaatgatttatgttccaggcgggatggagcaggacactgagagattgtatcatgttactcagagtggtacacaatttaaaacttatgaattgtttatttctggatttttccatttaatatctttggactgcagttgaccatgggtgactgaaactgtagaaaatgaaaccatggataaggagggactattatagttaacttttggacatgtggtgtttgtagtagcaaggtgattttgcagttgtactcattatcacctactgacaaatattattatatataaggaagattatttaagccatccaagaggaagttgcaagtaagatggacattactcttggtttcttcagatgttcttaactctttgagaagtaaaaagtctgtctttactccagaaggtaagatcttgctggatggggaccatctttcattcctcttagtgtccttagggacttatgcaaagaaagacttttttttttcctttttgagaggggatcacactctgtcacccaggctggggtgcagtggcacgattacagctcactgcaagccttgacctcctgggctcaggtgatcctcgcacctcagtctcccgagtagctgggactacaggtgcatgctaccacgccctgctccttttggtaatttttatagatttgggtttcaccatgtcacacaggctggtgtcgaactcctggcctcaagaaatccacccgccttggcttcccaaagtgctgagattataggcgtgagccaccagcaagaaagtcttaagtattattgctgtatgaatggatgttgagagcttcgagtaatgtgtttagacttaatattacaaaagactctcctaaagagcaaagaatataatgtgaatgacgtaaaggtgtataaatgaaattaataattaataaattaatgaaaagtataataattttgaaatataaggaatagttaataagtagaatagtaatagaaatgattagggaaaataagtcattggttattaatatgtgagtacatttgataaagaaacacgctctgaggcttggtgagtggaatgtactgtatgaatttacactatagttcccattcaggaaacagtgactaagcacttcctttgtgcggagtactttcccttgttctggggttacaaagaggaaattatatgattattgtcatcaggaatcttatagtataatagatcatcgtgcctataaagaaacagtctaataaaacagttgttataatggaagcatttgctaagtgtcaaagcaatgggaataacagggaaagaaaacctaagtctgcattactggaggtgaagctgtgaactactgatagagagtaggatctattactggactgggaatcagaagaccaatttataatcccagctctgtactttctagccctgacatcaagcaagtcaatttacttctctgaacctttttccttcaatgtaaagtaaggataataatattaggtctatctagttttaggattatattcaggataatgagtaactgtgaaaatggttagcctataaaatgctatgtgcatttgcatataagctgctttcactgttgacagtgtgtggtgttgtccaacctgaccacctttgtttggaagatggcgtggtactatttttcttctggtaggtggaatagtaaaagttcagctgtgaaggttaatttttggggaagaagacctgcattaattctccaggtagatgtctatacacaaatgtaagctttttatttacaatgtaagttatttacattgttagctttttctctgaaaatgtttcaaaactattgatgagcattttatttttagtaaagttatttcattataaaattaatacttagttgtggaaaatctggaaatatcattggcaaatttggaaaaaaaaattgtatacatcaaaaaattattgtcatctggaattctgacatcccaagataattatttttaacttttaaataatattctcaaaattcatctcatcagagagatttatgttccttaaaatgttagtatgttgctgggcatggtggttcacacctgtaattccagtgctttgggaggctgaggtaggaggattgtttcagcttaggaattcaaaaccagcctgggcaacatagggagaccccatctctacaaaaactttaaaaattagccaggtgatgcacgtctgtagtcctagctacttgggaggctgtggcgggaggattgcttgaggccagtagttcaaggcttcagtgagctatgatcacaccactgcactccagcctgggtaaaagagtgaaaccctgtttctttatgtactatagggatatgttaagtatttggcaattacaaattttattcacatctagacatttatttgataatttgggtttctaactcttattagtagtttgaaattatttattataatgttttgtcattggaaataatgcagattttattttcagactttaattactttatcttggatattagacttgctattcttattctttctttgtttctaatattttctttctgtttaactttattcaaaatttcatggtttgggtatcattctgtacacctatgaattgatttagattattttaaagagtataccaataatacttacaaacacatatctagtgcttgctatgtaccagacactgctctaagtgtttaatgcacctggactaattctaacagtaacccaatgaaaactaatattttcctcattttataaatgagaaaatcgaagcgtaaagagcttaagtaaattaaccaaggtcacacagctagtaagtgggagagctagagttcatacccacactgtctggattcatagctcagactcaactctttcatcataatgcacctcttgacttacaggacatttcgttagtgacaagaatttccaaatgtggcatttcattttctgttctaagtattttttaggacagtatattggaagcagatttgcattcatacctatagaagtaagaatgtagtcattaagggaaaagattataccatgttgctataagagatattttagattccgtgttttctttgcaatttaccttttacctatataaatagttcaaataccttatcttagcagtgatgctacacataaaacatgttttattaaaacatagctaaagatgacaaacctgcttcaatattaccaaagaaaatcagattacatttggaataaataatcaacaggcattcaaaaatatgtaagtacatagttcagtcttgcaagttatagtctatctaaaaatatataggtaagtagtagtctgggaagaaattatagccatctgcaatacagtgagatggatactaggggttttcttacatatcaactcatgcaagaagatactgatattgtttctttagattatatgggctaatcaaagcaaattagaaaactttacacttttaatttacatttaaggtattttacctggaaaaatatttcgattttatgtgtagattttgctaaaaatatgatattgcatttaatgttatcagttaatgttaccaaactcttctaaatggagaaattctgtgagatccctggtgtctctaaaacatttggtaataccttcaaatgaacatccagcgtattcatatctacacatattccagagccagtgtctctaaaacagatagggattcagatcattcccacatcagagaaagacatgctttagtctgtgtaggttagggaggcaagagtcaccctctttgtgtgtgtcagtgatttatcactcttccacccaaaagaaggcttgtcctctttccctcaaccctgttagtgcttgggggtttgtgttcaaacataaattttgttatagctatactatagtagcagacatgaatagattcacttatatttccatttatttctcctgagtatgatctgattagaagaggtaaagaaacaaagcaactagccaatatgaaaggcatatcattaaagccagaataaaatctgactgttcttgatttccatctcaaaataactgatgtctttcctaagttgagaatgacctgatctgttaaaaacagattaactcatcaattctgaccaaatcttcttaagaaggctaataggcttctgttgactagacaccattccctgtttcatttttctgatatcctggatgggggtcggagtgttgttattcctgagaaaatcgatatatcactgtattggaaacgtttgcttgtggtagcaacagtcttgatgtttgatcatgttaggttttatgaagtgttgatagatttagctccagacttaagagttacctacccaggctgggtgcggtggctcacgcctgtaatcccagcactttgggaggccgaggtgggcggatcacttgaggtcagaagtttgagaccagccttgccaacgtggtgaaacctgtctctactaaaaatacaaatattagctgggtatggtggcatgcacctgtagtcccagctactcctgaggttgagacaggagaatcgtttgaactcgggaggcagaggttgcagtgagccgcgattgagccactgcactccagcctgggtgacaaagcaagactctgtctcacacacaaaaaaagagttacagccgggcgtggtggctcaagcctgtaatcccagcacttcgggaggctgaggcgggcggatcacgaggtcaggaaattgagaccatcctggctaacacggtgaaaccccgtatctactaaaaatacaaaaaaaatagctgggcgtggtggcgggcccctgtagtcccagctactcgggaggctgaggcaggagaatggcgtgaacccgggaggcggagcttgcaatgggccgagatcgcgccactgcactccagcctgggcgacagagcaagactccgtctcaaaaacaaaacaaacaaacaaacaaacaaaaaaacaaaaaaaaagttacatacccagagatcaattgagaatgcaataatctctaaaataaatcattactttttagtagtctagaaatcatgtggtaatattaatttttataagtggtagaacagagtaataaacagtttcagccatctttctcctaagtctcagttaagagtttctcctccattgtgaaagctgaaaatgggaaagaacctattcttcctgtctaaatgttgatatccttggactctaggatccagtagagacttaggtatcaacaccaagtatggcattaccttacaacactccaaacagaccctgattcataatagtctgtgctcttgcctgaaaactttatatatgaacatggatatgtttatttgaaggtatgtttaatatgggccatgaggacattatggttacctaactgaggatagagataataaaagcattttagaatcattgtaatccaaacttgaaagtagaaacttcactttaaaaagcaagatagtttatattttgatagtgctcccaaaagttgaagattgttcttatggggactcatattgttgcatagttgttagtaaaataccatttataatacaagttctgttgccatttggttaggaaataaaaagtaaccaatgtagtaaatgctcaataaatatattttgattatttgttgaatgcattaacatataattgtaaaaaaagtagaaagcacaaatcttagatggaaaggatcatagaactgaaaacataatataattattttgcagtacatctgagttatattgtgatgtactttcctaaccaagtccaaattaatcaggagctctgggagaatcatccctagaaacaatgcctttaaatagagggtcagaggaattttcgtatttctggatttcaaactgcaggtggctctcttgatctttcagttctgaatttaggttaaagactgctgttctgccttcttcctgtccttgttacatccagactatcagacttcctgttgaaacactgataattgtcttattattggattgtaagcaacatcgctttttctcacatgtagaagatagagttttttttgtttgtttgtttaacaaaatatattgcttggccttcctttaaaatggctctgatttgcctttgcatgtcttgtgtgaggagttgctaagtatcaatggcattgttgataatgcttgtaaaatagcatatcagtattctagcattattttaaaagaacaaaaaacaggtgattctaatcattttccttcctctcattttctgggtagcattgctgttttatctcataatttattttgtacacatctggtactacaggaattttaggagtcccaaaatgaatatgaaaacctgttgatacaactttaggtggaaacctaagccttatctgtccttttattcattctgatggttattttaaagaaattgctggataccattgaagtatagagatacaaatatttttataaattatgtgccgaagtaaattataaatcacatggcttatagtgtggattcttaaattatcaatcatatcacttcatatttttataagctgaatatctaattcttttgcaaagtaagttacgtgcaactgctaccttttaaaataatagataaatctaaaatatggtgggtgataaagtgctaaaaagatacttcttagcaatacttaattgtgttacaactgtaagcaccaacagccaaaagattgtttgcaataaagaccttatactaagacattcatcaagtaataaaatataacctcaaatgtctaattctaagtgatatgtgccttataaatatacttgtagtagtgctacaaaaaaggcacagataccaaactgaccttaaaagtggcacatgtggcgttactgcagctgggctattgtcttggagattcacagaggaggcctcccaggaattatttgtatgttccttttgtgtaaagtttttgtctggaaagtcgctgtgcaaacagtagctgttccatagcacctgcttctgttgagggagagtgagtcttttatttagagagcatcggtagccatttcattcattactgcacaatggacttacataaagagcagcattccaatgacgccaaaagaaaccagagcttccaacacgctgaggcgcttgtaaacattgagtctccctatgtttctttctaaacttttcttgcaattacatccaggtctttattttgaggaaaaaaataattgattcagagcaataataggaaaagttataaactgcaatttttaatttaaaaagctgtattatgtaaaatgctgtggcaatgtcatatataagcttggtcatttacataattattgctttaatcttcttaaggtattagaaaattaattgcattatagaaataaggatgccaaaatatttcatagaattttttttaatggtcatggaattgttttcagtgtgcctatcttcctaacatttaaatgattttattattttcgtggccaatcatcttcaatatgatgtcaatatccagtgcatctgctactttccagccctttcattgacccctggcagtgtggtacccatgtttgttactctactgaaactactctctctattgcctctagttcctaccttctaaccttttctctcagctattatcattcttcatctttatgtttgataagaccttcctgatacatcttctcttggttttgtttttgtttttcaagaaacctgtacccattagcagtcactcctcatcttccatcctcaaacccctgcccctgtcaatcactaacctattttctgtttctatgtatttgtctattctggacatttcatataaatggaattacataatctgtgttctttttgtctggttcctttcacttagcttatgcttccaaggttcatccgtgttgtagcatatatcaatacttcattcctttttatggctgagtagtattcggttgtatgatataccacagattgtttatccgttcatcagttgatggacatctgggttgtttccaccttttggctattgcaaatagtgctgctattagtgttcctgtacaagtacttgtttgaatgtgtcttttgaattctactgggcatgtatcggtatatatctaggagtggaattgctgggtcatatagtgattctgtgtttaacattctgaggaactgtcaaacagttttccaaagtagctgtaccatttcacattcccactagcaatgtaaaagggttccagtttctccatatcctttgcaacacttggtattgtctgcttttaatgttagccatcctaatgagtatgagaatattatggttttatttgcatttccccagtggctaatgatttcgagcagcatttcatttatttattgcctatttgtatatctactttgcagaaatagctattgagatcctttacttttttctttttcttttttttttttttttagtgagacaggatcttgctctgccacccaggctggagtgcagtggcacaaccttggctcactgcaacctccacctcccaggctcaagtgatcctcccatttcagcctcctgagtagctggaactacaggcacatgtcaccacacctggctaatttttgtattttttgtagagatagggttttaccatgttgcccaggctggtctccaattcctgggctcaagctatccacctgcctcagcttccccctttactcatttttaatggggtcatcattttatcattgaattgttgcagatatctcccattctctgggttgtgttttcattttcatgttagtgtcttttgaaacacaaaagttttaacttttattaagctaaattgatctgtttttttaattgtgcttttaatgtcatatttaaaaaactgttgcctaatctaaggtcacaaaaatttatacctctgttttcctctaataatttcattgttttacctaacttcattttttttccatgtggctatccagcatccctgcaccatttgttgagtctattctatttcataattgtcacccttatccaaaattcattgactgtaagagattatttctggatttttatttttattccatcaaactgtatgtctatctttatggcagtacctcaatgtcttgattactatagctttatagtaagttttgaaattggcaggtgtgtgtcctctacttttttcttcttttgatacatactgacctacttagtcttctgctttcttatgatgatcagcttttcttcccactagtttgtgactcaggttcctttttaacattcttcaatggtttccatcacaccaagcaccgaccaccattaccttctctgatggtttcatatgatcccattttcttcacttagaaaaatattcacagagtcacaaatcctgtctaattaattcatatttattagatgaggaataagaaatggaggaaaaagtcaaaaatcttaacacagtttttaaccacccctgggttgcccacttaacatcattcaaatctgcagcaaaaccatagaggagactaaggtagtagggatggagaagagaaatttttgagaaatcctcaaaaggtataattaacgagactattattgatagagaaataattgggtactggagagaacagtaaaacaagtccattttgctatattttggcaaaaattataatcacagctattttcttttttttctactaataattggatggttatgtttaagaacagtatgacaaaatatcattttagttgaaagtgctaaaggatgatacaaatatttttgatggttttgttatacttactagtaatctaatatgacagtattatgcgtacatgtaccatgccttctcgtgggatacaagctatatttggcagcagggggaaataacaaatcacaagaataaagagctcatatttttacattcatattttcagaatgactttagtgtttccccttgtgtttcccatgtgtgtttcaaatcaccttattcaattttgctatctctgactcagatatagtgtactatacatatataatctgtcatcagtttcatttttaagtggaaaattacattaacctctggattttcagtgaaatgtttttcatggcactatgaaaacacaatagtgtaaattgtaccatgttgacatagctaattattcaaaactgggtcatggcttaaattgtagtgagtagaaacatacgcttaaaataattgtaagccaataactatactttagagactttgtgcctttacttgtcatatttttgagactcgatttgatttcctgtttagtttaacaaattattttactcagggctttacaatatctgtccagctcattagttgttacttcttttaccctttttatacttgttctggcttttcaaggctcactgattaaccaccctttgcagcatttctcagccctggtgtgttagctgaagtcatactacttagggagattttaggtattttctgtaagtgatgtccatgggtgactttaggggagccatttatgtatggaggccactggctattggagcctgacaagaggtctccataactagttttcatcagaatgcaaaatgataaaattttgaggaataaccttaggcattcattggaacctatggggcgggagggggggggacatcctaaactgtgataataaaatacagaaagttggaaaaataatggaaaaatctataattctataaactttacagcctacctcaatgcacaaaaggtgtttattatagtataatgtattcccatcttttgttcaagcatcattccatcaagggaatgcccactgtatttaatcttgttaacagtatgttaattgcaagtgctagttgtttttctgctttcttttgtcaattcacatttattaaatgcatacttattttctaggcactgtgctgaatgctaggggtacataaataagactctgtgtcctcggggaatgcaaggatagtggggaagatagataggtaatcaattattatcataacatgtgtaaatgccagaaaagagaagagtaggatattgcaggaccacagaggggagaaggccaccgaactccgatgaagggaagtaagcaagaattcccagtagatgttgatgccagatctgaatttcaaagtcagaatgggaattagccaattgaaaaaggattgcaatagcaaaaaattctagacacaatgagagtacacattgaggcatgtgttaaggtttgagaaactgtggtgttttcaagaaactctaagttgtttggtgtaagtgataggtagtgtacttttagggaaagtggtaagaaatcagggcataaagggatgaagttacctactcactaatggcctagcttgcagtatttaggagtttagattttattctaaaactaacatggaatgagaatatgttaagcagagaagtaacactctcagattaaataattataaagatcactctgattatggtctgagagatgtttgggacctggttggggatggagaaggggccatttggtcttgaggcagagactagtctggagcttcttgcaatataaattgaggcaagacattgcacatgtcataaagtagtgagaataagagctttgtacatattctatatagagaaaaagtacaaaatttggttttagaacttgataagggctattattttacattactcaaattactaaattacggttctatttcctgaatttatccttgtcattttgattggaattttgagtgttggttaggcaatttagtgccagatctttgaactgatcagtttaatgccactagatagctattaataataatagccattatctgtaggcttttttctattctaatttccctaatttttaagctcttggggggccagtgtgttacctcattcttgtctctttttacatctattactgctatgctccgcttaaaaaagcactcaagtccacaaatcttagtgtaaaggaagtatttcaaagagattatctcaattacaaaagaacttgcataagtttcctggaatatttttaagagagtatattatgaaaacttaattttatttgcaccctttgcctaaaggatgtactgctttgtttcagagagtctgacttatgtgactaactactttggctcttttaagttttcagttttcctcgaataattcagtatctctattgggatcattaactgtttacttcacacaaccatttactaaagacctggtctactcaaaggactataattctaagtaagacagtatgatgcccttaaggaacatgtgtaaaccattgtatggtatccttcccaagggttctggattctgtattttgaaagtctcaaattcactgccagccatctacaaagaggttgcttctttttctggtagaaaaacaattcctaatatgctataaaaattttgttgagaatatttgatcttcagatatagttaggtttccatagatacatctagactagatatccattccgtgtcaagaaatgaaaatgtgagatttttatgagcaagattagcaaacaattaaaaccagtttccaactttaaatatttgaaatcctcacattcacagtgtactttttttcctaagtaagataatagcgtcagagatcagaaagatgccagatctaataaactaagtcagctgcattagaatgctagtaaatgtccttttgaaaggtcatctccattagtccttttgttgctctccttatagggtttttccccctctttctctctcttcttttgaaaatggtcatagcttactttagctaaatagagaattttatgaattatttaaagtctctgtatttaaacaaaacaaagcaatagagaatgtctaaatagtataacaacataagtaaacactttctttaaagatgtttgaaagaaaagagctggaaaaccaaagttactgtcacaaggattggtaaattccctcaggataagttactttgtggtacatatcagtaatttctttttaaagagttgctggatcagtgtaaattttcaaactctaaataaaactatatatgttccatctatgtcttgatgatgataaagttatgagtagatattaattacaagcatcctcaaaagaaaatatacactggtataaagggccaacatgattttaacttgctcttttgatgatgacttctaatacttcatgtctatgttgttccagtaattagcatgaaggaactgccctgccagctgggaatgtcttaaagccatcttcttattatcttttaagttattgataatgtaacagagattttgaatttaaaatatataaattctgaaatcatttttttttgtagagcagacattgttagtgtgtgcattttttttttttactgtgacactgttttatgaattaaacttaataaaggcaagtacttgtattactgctaaaaatgaaaaccaaaaggatccagatattgccagataggatttggtcagaattatttgtttatagaaattaggattttaaaaagtcaatgaaaaatataagtgttccaacaagcattgtagtccacttttattattatgtatgtagataattaacagtttcaatcatattgtgagtagaaacgtatgtatgatatagagtgatctttaaaataatctacatggtatatacagaacagattttttttaatgttgttagcctaaggttccaaaaaataggaaagtggaaatcaatgtggaattgtcaagtctgcaaaatatctttccttgggattgtacagaactcattctaaaaaaaaaaaaagtcaaaaacttcatcctgcagcaatgttctttcatgacttaggactagaagaaagagagaaatcagactaccatcatgtaacgatttaaaaattaatccatacttgagacccctgtaccactgagttttttttaacataacctcctcttttctcgtataaaaaaactagattcagaacattacagttgaggaggaatatattaccattgtaactactgaacactctctattacttaatttttttaaaagtgtgtatgtgtggattggatacagtaatctaggaaagtctctgtgtaacagtgagcatggtatttttctagacattgttggtctcagaggtccccattaaaaagaataagagttgctacttctcaaaccttgtcagatactgggcatattacctgcatgcacaatggagggtttgaggataccagtctacctttgtgataaccttgtttatacacttacaaaacatatcggctagtgtatgcattatttctacaacactaccacagctttgcttgtaagattttgtaagaaatacacaagaggaaggaatcataggccttggattctgaaatgtctaattcagtcacagtgatgcagtgctcaaatgaactatagcagatttaatgagcaatccaggacagagacacatgtactggacacactagggaaagagattacgtgtacaggggctaattagcatgaaatatgaatacattcatataagtagtcttgatctatgggacgccttcattattgggaatgatttttgcatgaagttaatgaagagaaattcaggagttatgctgtataaagaattttaaaatagtattttaactttttgattctgcaaagtctcaatttctggagcaaaaaagaaattgcatatcatgaaatagtatgagcaaatgaatgtggatctattttctacagtgtctaaaatataacaaggtggggaacagtagctatccttcatttaactgattaatcaacaaatagacttcaatctcttgaattagatatgtacaagatattgagtgtcagtttgatattttaaataagggaatgtggtcatagtgtattccagaatatatacctctagccagatagttgaaaggcttggattcagtttgttgggtattctaagcatctttaccaaagaaatcagtcttgaagcaggatttagagaaagaatggatttcgactggacatggtgcctcatgcctgtaatcccagcactttgggaggctgagatgggcggattgcttgagcccaggagtttgaggccagcctgggttacatggtgagaccctgtctctacaagaaataaaaaaattagctgagcatggtggcatgcgcctgttgtcccagctacttgagaggtagaggtgggaggatcccctgagaccctgtctccaaaaaaaaaaaaagatttcatttgttttaagtttggttaaggcttataggaaaaggagccagagaagtgagaagaataatatttgaaaatagaccaggattgtaatattaatttgaatatcagatactttattccatttaaacaacagttttattctaatttgaggtttgaaatttaacatatgaaaacttggaatttaaaagaatttttgataaatgttaaatattggaagtttgagaaattaagctgatttttgccactgcccttcaaaaaagttcaacattgtattgcttaaatatgtggctatatttatgtaaaatacacaattaatattaatattttattatttcgtatctgacttcaatacatttttatgtgcttcctgtttgtggatatcttagaaactgctacagaagtcaatattcttagaaaattcagtaattcagagatgtgaaattagaacaataacagcttaagtggtttataaacaaagattatttgcaagaaatagaatatttctgtgtaagttcattgggttatgtgccatctagcagaaaaataggctgtgtatggtgtttatgttcagtgttctcatggttgcccatggtactgaactcacacctttatatgtgcaaaatgtgtgtaagtgaagcaaggagttagtggagctggtaatcagaatagaataggaatgggaataaatttagaagtgaccatcattctctctgtcccagctttgaacaagtcaaaatgcacatgattttgtacatttcattatcagggcaccttttgagagagagagtcgattgacaaaagatgggtcgtaaatcagactaattctttgtgtgactgctctttgctttatgggaacatgtttgactttagggacataaacttcagggaggtgcaataggtagatgacaatcattaaaatagcagaagacacttgctgagtgttgagcatttaaattgtgctaaataatgtgctggatgagtttacctaagtctcctcatttaatgctagcagattccttgtaagatataggtactatttttttttaatctcagatttatagttgaagaaacaaaggtttaaggagataagtattttgcttgaagttacacaacttttaagtggtagatccagtattcaaatctgaatcattcatacaattgaatgtatacctcatttaatttagtaatatattattcttaaacattgagagtaacaaaagttccttttgaatccgtttttctatttagctaggcaataagatggcctcatttcatcttttgtgtactttactgtagtacagctgtgagaaaatcatactaggctttctgctggttagatctcagacatatatgtatatttatctcctgctgcctgtcgaagcactttttgctcttgcaaatgcctgtaatctggcctgtatgtcctctgtcactgtaggttccacaaaatagggtctctttccttcctgcaagcattgccttgggggatattttcatgtttccttttgtgttcattcatggcatgtatgttcattttataccatttaggaagcatgagagattttaaaaaggtctcttgaatttatatgacgcaattgcaatttagaagtaaccatcattctctctgtcccagctttgaacaagtcaaaatgcaccttaacgttttattcattttgctattctttcagtgatggtttccctatgtctgcggtttttcgttttttactgtgtgtgtatccttatatttttataagtactttattctggtatgtagtatatactataacctgctttttgaatctaatatttattcttggaacataaactaatattctgcaaatacatgattttattggctctataaaactcccttgtaagaatatactatgatttattatcattattttttaaatttcaatagctttagggtaaaattggttttggattacacggatgaattacatagtagtaaagcctgggctgttagtatatacatcacacagatagtgtatattgtacacaatagatactttttcagccctcatccttctcccaacctacccccttctgagtctccagtgtcgattatcccaatctgcatgcccctgtgtacccatagcttagctcctacttataagtgacaacatgcagtatttggttttcctttcctgaattacttcacttaggatagtggcctccggttccatccaaattgctacaagaaatgttatcttgttcttctttgtggctgagtcgtattccatatacacacacacacacaccacattttctttatctgctcatcagttgatgggcacttaggttggttacatatctttgcaattgtgaattgtgctgtgataatcatacaagtgcaggtatcttttcgatatgacttattttcctttgagtagatatccagtagtaggattgttggatcaaatcatagatcttttagttctttatgaaatctccatactgttttccatagtcattttactaatttacattcccatcagcagtgtaaaagtattccctttgtaccacatccatgccagcatctattgttttttgactttttttttttttttttcttgagacggagtctctctcagtcacccaggctggagtgcagtggtgtgatctcgtctcactgcaacgtctgtgttttttgactttttaataatggccattctgactgggataaggtggttatctcattgtcgctttaattttcattttcctaatgattagtgatgctgagcatttcttcatgtttgttggccatttgtgtatcttattttaaaaaatgcctgttcatgtgatttgcccacttttcaataggttcattcatttttttcttgctgatttatttactaagatttatttatttccctgttgttcaatatttagattgtttcaaattatttgatattattatgccacatagaatagtcttgtatataaatccttttgtaaatttcttattgaaattactggtggaaggatatgagttgttttgaactcttgttatgtattgcaaatttgtttctgaaaggctttcaaatttagattcctaccagccatatgtgagtagcaatcatttagaacactcacaaatactgagtgtcatgattttaaaaaatattatatttgttaaattgatgggtgaaaaactgtatcttattgtttttatttatatttatttgcttactcatgatgtttaaatagctttattacatattgaccattcgttttcgtctaatttttgttcatatagttttactcatttttgttttacaagtatagtatgtttcttatttctttaattatatttatatgtttatattaacccattatcaccatttttgcagtttgcaattttttcctgaagttttcatttgcattttaattttgttttaaagtattttaagataacctgtagtttttttgtggttgtggttgttgttaaaattagtgggaccgttgaaactagaatttcccttttagataaaaattttgcattagttacttcagggaaacagaagagtataataattgtgatagggactcaagagaaattatacaagtggtgctattcattatcattggcttccattcaaatggagctggatttgttattttcctatttctcttcctgagtctccatttgtgacagtctcttggcaggatttcagtctacttctaacttttatacttgtggttggagcccagccagcttctcctgctttctgggaggagctcactctcatcgtacatctattgacttgcatgtcttgtaatggtaaagcaatacgtggaaggtattcaagtttcctgagactaaagtgggtcatatctctgtcccaaaactgaatcatttgaaatctgaaagtgactttaaagatcatcgtttaaaaatctcaccatgtagatgagtcaaatccagagacactgcttttgcttgctttctcaggcacacagacttcactgaagagtagtaagcttgattgattctctgacagctacattatattgtagagaactttgttgttattgatctcatttacacatttaattcctactctgtatgtgggaatataatattttactgatttaataaaccaggcatgatttcttattgtgtgatttattgtgtggttcttttttgtcacaaactttgtaggttgagacttggcaagtaacctacccttgagggtttttttttttttttctcccagatgatggtatgtgtggtagtctctctaaggcattattatgaagacatttattaaatctcggtctatttgagtgccacctaacgtctagatctctcaacagttttgcctagccatcatttctcagcttgggatggtgtagagaaacatattattcccacctgagcttatagaactgtagctaacatcatcagatatcagggctttgagcaagcctgcttgtgggtggtttatcttttccagtgatttgagacttgtgttgcattgaatatactttgaatttcacgtgtatctctgctctattagtctgtatttgggttgttttgaaggatttttattttaatatgtagactgatacatttttgtatatgttgctggaggcgcttttgcactgctatgttttagaaatcaaaataataaataatgcatatggtgttcattgtttttctcctctgtcttttgatgactattaagtttcattggaagtgttagtaacatttctttatttttatttttactattttaaaaataatagtaataataataataaacgtttagctttttagccaggtgtagcatttcctaatttgaaaatgtgctattcattttttaaatagactattttgtagagcagttttaggcttacagaaaaaattatgcagaaatctcagagttcccatataattttcctctccttcagaatttctcacattattaatatcttgcattagggtagtacattttttactgttgatgaaacaatattaataaattattatccttaaagtccatagtttatatcatgattcagcctttgtgttatacagttttatgggttttaacaaatgtcttgtctactatatactgatatttgacttatcctttgatgacagtgtaatcattccttacatggttcattcattcatttcctcatttcatatattttttcctgtaactatttattgagtacttcttgtggtaggcattctgacagatgctaaaggaaattgccaacctacgcacacccgatgatgatgttgaggtcatttgtgagaaaaggctttaaaagggaataacctttgctgacagaatggtatgataatcagaatggtactgattactggcttaaaatttctacttgtgaagtgtttcaattaaaataggagtagcatgttccaattatgcttcagacatttatttgcagagaagtgcagtgtgggagctatgttaactggtggctgtactgggtatttctttatctcttccctattttttgtttgtgatgaatatttctttatatcttccctgttagaagctgtcagcggtattcaaaaaaagcagtatttttccttggaactaactattctgggacagtgtaagccaatgggaaattttgacttaatgaatttcccattgtaaactttcggcattaaatctgttgataggtgcaaaaaaattgtaatatttacatatctttgatggggaaaacagggttgatttctttttacctaaaccaagcattccaaataaataaataccagtagaaatgaagagtataaatagaaaacaataggaagacttaataagacttaattgagttaattcatctttctttctggttctgtcattccttttctctttagttgtaagattatacattgactagctagcagtgatgccttcaggctagacattagtatacgtttttggtaggttcttatataatctgccaactattactcttgcagaggttatttattattattttttgtaacagtttaattgagagtatattatttgaagctagactatcggagtttaaatcctggctgccatgccaccaggggcaggtgtcttaacctctctaaatctcagtttcatctgtcattataataatacttttttaacatggatgttagtatgattaaattgatgtacatgcaaaccagttccattaatcactgcttagaatttgttgtgatgattatattgtaagagaccaagttgaagttcttcttgatctataaatgtatttctaatgtttcttagatgaatttgttgaacattaaagagatttcctttcatggctaatggctgtgctttgaaaattttcatattaaatgtagaactataatcctctttctgtgtagattgtgaagctagtactttattttctttctctcaggcttctgatttatgttttcattgagtgaatatcagaccattgctaatgtcataaaataaaatccagaaaatagatgagtcactcattgaaaataaaatctgatcagaaatcctttgactgtgttacattttaagataatgaatgcttggtttttgagttttactatcataccaacttttcccatgtgtgcatgtgtgtatacatgtgtatgcatatcagaaaaactgaaatactatttctgctcaattctattttgtgaagtcaatccaacttttatagtcccataaatatcaaataaatgaaataattattgtcactaaagtggagaaactattgcttcttcttatcttgtttattttgtttgctacttaaattgacattgaggcaaattttaagtgagtttatgttgtgaaaccctgctaaaatttagaactcactgtagtttgttaaaatatgtaaaaatccattttaagtaagtatgaaatccattgaagatacttttattttttaagcaaccttggagtgtagattttaaagaatacttgtctggcaatatccatagcttaaaatatgtagacatgaataccgatagttgaaaattaacttatttaaccatttgaaaatgagatttattttgttttatccagtgaaaaatacaaaaccaagtagacattgttttttggttaaaaaggtcacaaatttatgactgtatatgttactgggattagaagtgttttccctattggtagtttatcaagtgagtgaatacctttctgtgaatgtgaacaagcttcaccaattttagcagttcaattttagagaagctgtgatgagttattttgcacaaaaggctttatctttcaaactgctttgctatctttgcttgacagagagaggatttgatgactttttcaaaactcccctttactgcttcacctgagtaatgttttagttgccgtgtaataaaaatggagctgagaattgaaaggccaaagcagagggagttttatagcttgggatcttttaagtttcatggatttattttgtatttatatcctgggggggatgtacattctgatattgctcagtttttgtctgttggggaagtcagttgtccaaaatagcactgtattttctaatataaaaagagtaatgatttgccttttgtgagggataattttaatggtacattgcagagatttagttggggagaaattataggcattattttaatatttataaagtattttgagggccatgcaagaaggctgcatgtaagtacactaccaataaagtaacaccactaatacaattgagatactaaaaaaagaaaaaatatatacttaccatctagtgagcagagactttctttccctaatttgcatttagaaagctctaaattaaaatgctaaaaggaagacaaacaatttcagcacatgctgctggttttgtaaatacaacttgctgacttgatataattttaaatgaatactcttgacattaagacatcatgctttctgatcatgtattggtaagccacagaacaacagaaataagcttgaaatgggcatagtttttaccatagtgtaactttaattgcatgcttttatatcttcaaattaatttttgacatcgctatacagaaatagacttgtacaaagaaaaatgaataacttgcttatctacaagagtgtcattttacttgtgaaccattgtaacaggttttttgtttgagcatacaacaaacaaaatatgtaatgttgttttatcttccaaaaatacattgctgtataataagaaattgtcattttgcaataaaagaaaaatccaccaaactggtatatatgtgatttattttttttttggtcaaaccctgtaagtgacaaatttgacatttaatgctatattgtaaactatcaggtatctttttttcttgcttgttaacatagctatttctcacgttttctcttcttcaacttctttcatgcctcacctctaaatccccaaagtacacaccacacaaacacttagagaaacataaacatgcacatgtttgatgacctacctcataattcattaacaaatctagaagcactccatcaagagccccttcatattcccttgcaaaatctatcaaattgtcctgtatctttattgatattatttcctgttaccatggacagaaagagtccctgtacctatggaagagcaatctgtccacttgtgccctggttcccattcctcagtgatttagctcctttctccatgccatatttattttctccttctcaactggggatcattttcagcagcatactaacatgctctagtgtctcttctcttgatagaaagaaccactctcgacctcatagctcactccaactattccctatctctctgcttctcagagagcaaagccccttgaaaaatttctctattattctattagtcactgtcttacattgtcatctcactctcagtcccttccgattgaactttcatgttcatcattccacagagtctactcttcttaagaactccagtgaccttccatgtttgtggctcaattattattttaacctctcagcagcattttatatatttgaccattccctctttcttaaaggaaactatgatattggttctcatgacttcatactctcctgggtttcctccctcactagcccactctttctcaatttgctttgttcactgctttaattggttttcacatatgttttggagatggaaccaataatacttgctgatgaattggatttgtgcgataaaagacaaaaaggaagcaagaaagactcctaattatttggcctaagcaactagttgatggtaccatttattgagaaaggaaaaacttgggtggtgtcagggtcaggggtcaagaatagagagttatgccttggccatcttacatttgagattttttttctagactgaaatcatgttggaaatgttgtttggtaagtagtaactagttagagttggagtctagaattccagggattagttatagctagaggtatcaatttgagatcattagcacatcgatggtattcacataatacatcgggttgaaattactttgtgaaagagtatacatggagaagagaaaaaattacaggatagaagccctgatgcattctatcatttacaggcctaagaaaggaggaagatccagcaaagcaaattgaggaaagtatgaccaaagaaagtagaacactgtgagtcatagaaccaaaataagaaaatgttctcagaaggagagtacgatcaaatgaatcaaatgctactaagagtttgaactagatgccatgttggtgtgagttgaagaatacagttggaggtgagagagtataagcagtttggctagacaattcttgaaaagcttggctctggaggagcatggagaaggtggtatgtgggaagggtatggtattagggtattttaggatttttttttttttttttttttttgagacagagtctctataggccaggctggatggagtgcagtggtgcaatcttggcttactgcaacctccacctcccgggttcaagcgattctcgtgcctcagcctcctaagtagctgggactactacaggtgcacacccccattcctggctaaattttgtattttttggaagagacagggttttgtcatgttagccaagcggtctcgaactcctgacctcagttgatctgcctgcctcggcctcccaaagtattgggattacaggcatgagccaccgtgcccagcctattttatgtggttttttttttttaatgggaaatatggaagcatctttgaatgctaatgagaataatagtgttggaaagaaaaagttgaagttgtaggagagagagaaaataaaaagtgaaagaaataaaagggaggagtcctagatctacaagtggaagaacttacctttgataggaggatccttttctcctttgtaatgggaaagatgaagatggtgtaaatgcaagtttatttgctggtggcatgattatgggtggggaggtgccatttgatagtttctattttctcattagttaggcagcagtgtcatcacctaacagtttagcaacagtgtagtatggattgatgtgaagtgaatcatttgaaaaaatgtgaagtaattatcggtatagtgttgctgtcattgctggataatagaaagtgttcccttgaaattgattattattactttagagtgatattactcttcccaattatgctattttctaagaatgccatacaaatgcaggcctgcaaaaacatatagaagcattaaggggaaagtgcattagataatgattactaatgtcaaggaatacatcttggaccatggaatttaaactagacagggaggcaagtgaggacaggagaggaatgatggatggtgggtcaaagagctggtggcttcattgacatttaataattggttcagcagggttacttgatcaactaaactggacctatagaaaaaaagatcatcagttatggtgattgaattgagatttgggaggttgtgttactttcggtggtcggggtgtgatgatcacaggattgaatggcagaggctgaattcaggaaaagatggagaagttaaactgagagactagaataggtctgatgcagatgatgaagtcactgaaaacaacagaagttagagtgaacaaaaagactgagtcagttgctacagtctttagtaaatgacaggggagtgactaggagatctgaagattaaatggaaaagatggagtagctgaattatgctacctaatacttatttctgtcaacaggatcatatgaaaatgaaatattggcaaaccaattactttatagaacgatgactgaatgaaaatcacttcatgcattgttagagatagcccaatgaaaatggattccgttgtgtttatctagttcagatagtacatttaatgagaacagtttaagtggaatgacatttatggtggttagccatgattataatgaatttttgaagcgtagtcagttaggcatatatagtaccctttatctataaattcatgttttaaaataaatatatatatatataattataatctgtgttaaacacttcagatatacaagttaaaacagcttaagggataaaataggcttttttttttttttttttttttttttgctgtgttcatagtaacactatataaaggatttacttgaaacatttcagtttgctcaagttagccaagtatatactttggcaggtgacaaggctcaataggagtccttgtgttttaagtcttggttctctgtgaccgtgtgacctcagttccataaaccaaaaaatcaaatggttgtattaggtacttttaagggatcctctgactttgttctatgattctaacaaaaagaaatttgaaatatttgtgtggaaattgtatcttagcttttatcattgacatcataatattatgtggtatatatctctgtaccccctttatataagattctaagctattggtgatggtgtgatttaatacttccggttttccttttattctgtaatataatttaaataggtattaaataggtattcaaatgatttcctttcaagcaagaccaggaaaacagcataatatagtacactgagaaacaccaagaaagaccagttatacattaccttgtatttgtaaatcatttcaaacctacagaaattgcaagattaagaatactacaaagaacacttgtatatatcctttaccctactcaactactgttaagctcctttttctccttctctctttccctcttccttaaccctcttccctctcttttcctgccttctttccttccaatctccatctccatctctatttcttcttcagcctcatttaatgtggaacatttccacagccattctttgtcttttatgacatcaacaatttgagaaatataaatctcctttttagaaacatagcattccttatgattagattcaggatatatgttcttagccagaattcagcataggtgatactatatgaggtatacacctggaggtactcactatctgtccacctctcattggagaagtcagttttcgattaaggtattatgtaatttctctagtgtctaattaactctttttttccttggaattaataagcagtctgtaggaagacactttaagaccatgcacatatcttgctcctcatcaaaatgttcccctaggttatctaacatttatcataatggttgtaaaatgatacgtggccaattacagtactccttccacaaatagcggttggcactcagcattctactgtaagcaagacctctcctttctcatctattatttttacttattgatagatttattattagtatgaacttataaattcccatttttcaatggtttatagttcgttactgcaatgcattacttggtgctaaatttttgccagatttagccagtgagagctccctcaagctgttcctgtgaaatgcctacattttttttttttagcactaccttactttttgacatacaaagacattttagtttcatcttgtagctactctcgcacaatcttcttttttagtgggaaattgtacctggatgctaggtgtgtgctcattgctactggaatgcaaggaaaggcaagttacttttaagttaacagacaacaaacattaaaaatgtaattagggcatgactttttagccatatcataggattgtacttttatatatgtctcatcggtttgatgcaggtgagaggtaattttgagcccatatatagtagcctaattataattaataattttaattttttaaagtaataatgtgtgaggtgaaggagtagcaaatacttactttccctaacataagaaaaataccattaattgatctaacggccatatattcatactctagttgagttgcctcagtgactcacttaataaaataagaaattaaaatgtcaaatagaattcgacaagagattttaaggagaaaacagagtctgtttctacctcagaaagttagttaaacagtagcttcaatcatctgctatggagtactacaggtgaagaaaacaattcttgatatttgtttatattttcaactttaaaaatcagattatggggtttcatagagtttactcaaggtgtggtagttctttgatgtttttaaaaatatatctttattgtagttgggacataatattgaagaaactaatttctacatgttcaatgaattgaataattcaaaattcaattcagaactcatacactcagtgttctcctttattttgatatcactcatgtttattttaaatccttttctcttcctaagcatctaattttttcccttcattcttgtattactttataagtgatcttattacaaataagcatacactgagtcattgcaacagaaaagtgcttcatatactgagttgctttctgttgcacttgatatattaattgtgcacttactatatatgcaagcactgtgcaggcagctctatttctttaaaagttacttaaattactggtgcttccaatgaagctggtggtagggtctgttccctatctccaaactattagaccagcttgtcagatgtattactcattaggttgctaaggcgtaaagtcagaatttcagatttataacatggtgacatttgatgtttttcttttgtttattatcagtgctgtatctgatggtggaaacaactatacttttaaatcttctgtctcaaaatgtattcttcctaaaatttcatatttttaaccattaaattttctctaaaatatatcttagaattgatggtatacctttcccccctttatcatgacagtgatgatcaaatccttgctttgtgaaatattttcttgacatatttgaactgggtagtttttttaaataagtgctgttttttgagtcatcttttccttttgttgccttttgctttatgaataatcatgtattctcacttggttcattaagtagtagtagcataatgatgagagtatattaaaagaatttattttagattgacccaatctatgtgagacatcaacaacacacaaataatagaaccacgtttttttgtttttttttttttttcctcttctggaaagaaactactcttactactaacattgaaactagagtcatccttggactttattcaaatgtgtcagttttggaaaccatacaaagatgttcgctttagcttaagggaacagaagaactttgttatgctctttgagtgttacattaaactagatcattgcctgaggagcctatttaatatgtccatctgatttatgattttttttgtagtcctttttcctttgatttgtcttatctttggaaaagttggcatttatttctcttttattttttacatgctctcaatgaatatctatacattcattactttcagaaatattgcttgctgaacttaaattatttggaatattgtgttttgagtttgcaatcacggagtgaaggtggtaacattgtttctaggtttacagaatgattttgttaaaagtatcactttctgtaaataccttagataccatatagaatttagcttttggtcttatataatagttagaacactataaatgtaagtaagtttttattctcattgttattattgattcaaagagactttaaatttctacagcaaatcacattttatccctttctggacatctactatcattaaggtgatatcaaagactgaataaaatatttaagtcattaagattttaattcttaattatgcaatctcccttgccagggctattaacttttataatacagggagggtagaaattcagcagagacattcatttattttcttttatgaacaaggctgtatagtttgcattttttccaggtggtttggggaatatttaaatagatcacacagctgctggcttggtgggtttggggggtgtgtttagcagatgcttccagaatctggaatttgaagtattcttaattttatctagagatgcagatatctattctctggtttaatttgtcaggggatgactacttctttgatgtcttagtgatatataactgtcttgctttgtttttttttcttttttttttttaattggccactcacctcaagcaattttaacagctcagaggatatatttactatagcctttaataattagatggctattcctattaaatagctgaatgtatttttaaggataatgtggggttctttaattagcttgatagtttacctataagaaggaaaatgaaaactgcagccagctgcatttccacagctcatttctgtgtaagaagcacgtatctgggctaaagaagtatcactttcttcatttaatctgagatgagacaacatgtgaagaacttggagcaatctgattttttgaaaatcttttctctcattagctgttttgctcaaaaataaaagctgtcaaacagcaggaatttgagatgctcatgattgtgtttataggccttcaatatagtatttactgaatataagtgcttgttaaagccaatttatctgttaattcaaacaatttattgaacacctattatacaaaagatactttgctaagtatttttgaggactatagatgactaagctagacttggacccttacatgtaggagcttaatgttcaagaataagacgtgttcaactataccaaacatgaaagtcctaaaagtgaaatagagatgaagtgatactgatttacaaggaatgagagcagggaagacaaggagagacatgggcgtcatcatggaagcagaggtaattgagctgtgcctttacagctgagtagatttagacatttaatactatgtttgagggtgggggaaagatattttcagcagaataaattgtatattgaaaaccctggtgcttctaatgtcatattcccaggcaatagtaggtatataacatgtgggtagactacaaggttcgtgttggagatgggggaagcaggggtacctttaggggaaatggcagaaaatggtgttaaaaaggcaagattgagctggattatgaggtcccttaaatgctagtctaagaaattcagactttaattgttaagaaatttggaagcattgagggatcttagaagccagacaggagcagagctgtatttaaggaagtcaaatggaagagtataagatgagagggcctgagagtctgaataggcataatgcctttgggaatgaagatgagaagaataagagcacaaatgctgagttagaatctctaggagtagggaatttattattgttgtgcaatagggtatagggaagagttaaatatgattttatattaaacatgcttattatttcttgtacatttatctgtgggactattttagggcctagcatgagggttgatatccttcagaggagatttatgtttgcttttgctgggttgcaaaaccaacctaggctgatgttaatatttttggcttaaggttttcttttttttaaagactcttgaggagctatgaattcaggctgcatgaaggctggctttggactaggaaattatcagagaagatttttactttctccatccagcaccaaggtttgttatgggcaattttcttttcaggccccatgagagatgagcaagtttatttctaatttactgttaaactgaggtgtgatcctctggggtttgtaggaccattacctattactctttccactttgattaggccctaggcttggtttctattgccccatacttgaggccttgaaaactgatgctcaagttcatctgggttcagaatattcactcaaggtcaaagctgactccactgatatttatctctctaagtttatctttcacttagtttttggcctccaggtattccttactttcttgccaggttatctgtacgttttaaattatttttttaaatattcatcatgttcagttctcttcacaggtagttgatatcagggtacatattctatcatactttcaggaacagaaattaaggtgaccccttcttacatggacatgtgacatctcagaatgactttattcttgttatagtttcctaaacatgagatattggtactagaatacagaaattatggtacctggccttttctgatgtaacttagttttttattaatactcatttttagaatagggaaacacgctattataactacctattgaagaatcagagtgattcaggaggtgatttcatgggcaagaactatgttctgtcgatagttcaagtttccagtccctctttcacacaattcttcccttctccattcacaaaagaaataccttaaaagagaaaagtctaagaaaaaaatcaatacagtctacacagatcattatcttattaatggacctttagtaatgaatgtacatgtgctttgtgtggatatatgtgatttttgatttttcagttcaggactagagggcattgaatgaaagctgcctgcatgcagtcacttcaggctctaggatcacccacagtggctctgcttatcatatagagtgacttgacattgtaggattttgccataggaaaatctgtcttagttttatctgccaccagtaatgggttttaccagggaaacacatatgtcagctgttaagtttcatagtagtgatggaaattgaaaacataatcatagattagccatttttaagtgtaatatgcaccaatgaatgactgtgacatcttaaatgcattttgtttatagatatagaggttgaaggtcaataactggaaaggctggcctttaatttgttagattaggatacaatttagtttctaacatgtataatttaagaatttttacagtttggcaatatagttctttcactgaattcaataagctttattttcattgtctactatgtgtcaaattggtactactttctagtgatataacgatgatcaagatattgctgatggctttgagtgactcacacttaatggaggagccagatatctaaactaatgatagtgcagtatattaagtgctacatccaagatagggagaaaactctgtagaggcccagaggagggaataattaattctgcttggaagagttcaggaaggcatctcaaaggagatggcattttagcctagccaaatgtgttcaggttgagaaggaatggaatataaaaaacattcaacaaaggtattccgcaaaggtatacagccttgggatgtcctgattttgtctaatagtgagtaatctggtttgggtagagcattgggacaccagggtgctattaagttaatttggagccagattttaaaaggtactaaattccctacttattacttaagctttatcatctacatagggagaaaaaataaggataagtaataatatcttaacattttaaaaagataaccccagtaatgaatgtgtagaagaaattggagtaaaggggaggaaaaaaatgcaaaacaaaacaaaaatcggagtgactactgtaatttcatagctcttctatacaccctaatacattgttatagctgttcatttgtccatctgaaagcaaagactgtgctttaatcttttctttctttttaattttatttatttatttatttatttatttgtttattttagcgacagggtcttattccgtcacccaggccgccatacctggctagtttaatttttttttttttcacttttgtaaacatgaggtcttattctgttgtctgggctcaaaggatcctcccgcctcggcctcccaaagcgctgggattacaggtgtgagccaccacacctggcatttaatcatttttgcatttacattgcttgtatatgatcatgcgtgttataactgtagaataagtgaattaatgaatgaaagatctaagcaataattattgagggctctaaacagggcagtagaaatttaggcagaattttgcaggtagagggcaggcttagggagagaagattcaaaaatggcttgaacatttcttatttctatgctatatattttgttatgatgcctttcactggagtagggaacagacacaacacttctcaggtaactgagaatgagttcatgttggagcatatttatttggaggtcctgtggaagagataagagttggatttatgggtctgcaacccagagggaaaaacctgggctgaagatacagatgcaagaaacataagcacatagattaatgattgaagtcagggtagtggattgcacagggcaaaaaatataaagtaaaaaggctagagcatggggactttggggtcactaatatataaggagtaggtagaagtagagaatacaatatggaaaacagactagtcagaagcataggattgtttatcagagaagtctggtctttgaagtcattgagaagaaagtttcaagaaaaaaactattagtaatttaataaattcagtagcttcctatatcgatgtatatacatataggtaaatatgtaacatacttatattaatacagagttgaatgatagcaaggtcactcctatctgttgttatcaaatttcagatcttaaaccagtaggacaatttctaggaagaacacttcatgattcatttctcaactaagagaatagtgctcttatttttctagtgatcagcttgaagtagtttttttcattatgtgtgtttatgccttgcagtttcattgattacatactttaaaaggttttaatgtggccaagtattgaggatgtagctgtaaaagcctttatgtggtggtaaactccagcatttaataactgctagaaatgcaacatcttctctcttattgtatttgacagtttttttgttattattttgatactctttattttgccaagagttaactcattcctaaaggtattttatgccagggaaatttcattccactttgtatagtaggctaggttttatattaacctttgagtgtgcatttttactgtggattatacattactggaattacttaagcaaaattcatactgagattctttattttaaaactgataatgaccatacgtattaaagggctagctcagaaaactgccagcaaataatcatctttgcctttgggaaataatgaagtcattgcatcgtgcttgaattaccatagactatatcagcagatacactcattgattcatttctgttctttttgttaaaccaaatttttctttcatcgtttttagtaatgtaattttctatgtctggtatgcttacctgtaatttgacagaaccccatttctttgtatatctcactctattagactacatgtagtgcagtgtttgtagagggggccattaactaggaattgatatttacaaaggtgcctattaagtgccagtcactctgctttgttttaaacatagttcacttaatgaaatgataggcaaatatactaagggagggaatttgttgtagtggaatgaatatgcattgaaagcataggtttgatctaggtttgaatcccagatctaatagtcatttggtggacgaagtcacttcacgggtctgagccgaagcttttgtatggtaaaaatgggatcctatcttgaagagttattatgataattaaattgttgagagatacaatctaagatattcattaaatagaagatatataataacatcattgataattactattagaaaggaaattagacgtttgctttgctttgagtgctattactaaatgatgagtcgtatgtggcaaaaggagatgtggaacgtacaggcaatcgccttttaaataaaacctgaaacaaaaattatttgaaatgttagtttggcagttatgttggattatatacgtttcttaaggctagtgacttgtttcctggaattctttcacttcatagggtaacaccttgccccctactaggaacttaactatttctttaattttattacattgaagctgcttgaggaagcatgcttttttcactaaaaggacccagcaaatttcattctttcattggaatattttctcttaatatgactgcaaatgcagttagtaagttgaaaaagccacctgttgtcgtattggcaggccacctaactggtctgtctgtacttggtgtgcagggaagcttgaataactaccattaggcctgcacagtgtcagatttcacatactcatgacaccgtaggtaattgggtgacagccagtttatttcaatcagctaatgttatagataaatacttcatattttaggttagccctgatatcacagaatggaataatgttctaatcctcattagcagtttgttatgcagcaactttttgtatgccaataaaaatggcataggctgctgcttcggtggcatttccccttgaacatgccattttattcatttgttgactcagatagatggagttgtcatgtttctttgttggaaatgttgacagaaccttgtgggctgtgcttgtataaacgtttggttctctaaacaataattttcagtttagctctgttgctactgctacatgctatttttctctttctgtcacattgggaaattctattttgttgtcagtaaaaaaaaaaaaggtgtggtacttgcttactgtctatgtagactttattttgctagttgatttcattaaagagtgattccaggaagctttgggtcattgtatcaccttgtctcattccattatatgtattgatgcaacatggatcgttgaacagtataatctcttttgcacagttcctattgattttatccagtaaatcattgtctgctgggtttgttctgaaatcattttgtgcataaaaactattcgtgaatttgacaatcaggtgccttcttgtaatagataaacttacacaaaactggaatccagtcactttttgtctccttcacactatatagttatctttcctactaaactgatcaagtgagtgatctctattcagcaaatgtttctattccctttctcatttcttgtaatatggcttctcttatcattgctcttttgaaattgctctgtatgatctgaaatggcctattttcttctggtctttttttttttttttttaagtatttagactatgcttgaccttcctgctacttttgacactgttgattactttctcttattgaaacattttcctttctcacttctgggacaatgaactcccctgtttctcatacctttttattgttctttttgtcctcttaattggctgttctgtcttctctgggctcaacacttcaggcatcctcactacttaggctttagttacaccttgaagacagaagatcatcactttcacatttatattcctgtaccctcatttttccactctaaaatttcacatattttattctcataatatttcctgagcatcattttctacataccatgagaggagggattgatgtgggagataaagttgtaccgtgaatgttctcttccctacaagtttataacttagataagtcaataagatgcatacatgaaaattaattaagtagggcagcatgtggaaaataccttttcagtgctaaaggtagatgaagaatgtagtggtaattagagaagatttcatagagaaagtgacatttgacttcggtcttaatggatagataaaggtttgacagcaaaaatgtgaagggagatgaactgaaaatattttacagtcattcaggagtcctgtcatacttttgctatcttagctactcttgtcctagtagactataggcaaaaatcacttaaaattagaaactgtaatctctccatctatattaggcacacagaataacagtgtacacaatagctcatgtcatatccataagatgttaaaaatgtgtatattttggaggcgggacttcaaggatgatgctacctagaagtaactattttattttctgtactcacttatacctattacatcttatgtgcttcagttttctttaaatagtgcacctggtatcagatataatctctgcctttttgagtgtcttatcagattcagttccacgaaatctaagtggaaagctagatatatagttgacccttgagtaacatggagattggggtgccgaccgcccgccatgcagttgaaaactcgagaataacttttgactcccaaaaaactttactaatagtctactattgaccaaaagtcttacaggtaacataaacagtggattaacacgtttttgtactttatattgtattttacatgtgttacatactgtattcttacaataaagtaggacagagatgaaaacgttgtgaagaaaattttaagacagagaaaatatatttactgttcattaagtggaagtggatcaccataaaagtcttcattcttgtcatcttcatgttgagtaggctgagaaggaaggggaagaggagagattggtcttgctgtctagggtggcagaagaggaagaaaatttgtataagtggacccttggctgttcaaacctatgatgttcaagggtcagctgtattctgccctttttcattcttcttcatggattgtcacagccaactctggaatctatgttttttaactgatattttagtaaaattttccattaagaaacaggaatttattgtatcttataagccagtttgaatttttaatttgattttattacaacacttttgttccaaattttacgtatttacttcctgctctgtctctgtagttataaccagttcttaagttcagattcaaagcattctgcgctaaaagcagaggcacactttggtggcagccatgagggaagcaacaatgatcccccacagtgataggactgaagtggctggggtgaagtaaaggccagcctaatggcgagcacagcaggtttgaaatagtttgctaggaaaaagagtcagcaggttgctgtcctgatccagtcaaatacatatgctgtctgcgactattagcagttgcttcttacctggctattatcttcaataagtttctagtaaaaccttcaatttgtaggatttctgattttttttttttaacataaggcagatttcattctattctttatgagatgttttttattttgtatggtaatagctctatccgcagtctacagatttcagaaaactagtaagaatcttaggggccatatattgaggatccaccgtacatttgagttttgctttgccttcagatttagtgtttaatcttaaacattgcattcatcttatatatgcctttataaacagtataggaccctctattatctaactcttggctacaaaattaataagaggtgcacagtgggcaattacccattattttactataaatgactagtcttatgtttttgttctatattgtttgcagtaatgttatgaatgctctacagcactgaatatagtattaaacggtagttctcacagaagacggagtttgtcatagctgagctgttatccaacaattttttttttaagttcttaaaagcttacagtccaaactgtttctggcatttagttgaataaatacctcatggaaattcactgttaaactgaaactacctaagtataatatatttcatgatacacaaacgcacacgtgcgcatgcacacacacacacacgcaacagttgtgattgtcaatattaaaagtaaactcaatattaaactgagtttactttttggataggtttcataacaagttgactccatttactttgataaataggttacatgttaaaatcaggtttattttcatagatagtatcaacatgctacttgctaactgaaacggaccttgacgtaaagcagagtattagactcaggaatgtgcactttcagtagaatatggtttctgagatctgttgctctaaggcccacaagctttaaaatgactacatggtgtccaaaagcaatgaaactaagctatgatgtgcttgcttaacattttgtctagctcagttctggacttttattagattgaattttctctcttttgaagactccagtttttaattgaataaaaatttttttcacttcctattttgcatattccaagtctttgcctgccttgattgttttcagtgacctggcagaataggtgtgtgtgtatagcaagcaagaatacactcatttttgggctggacacagtggcttacgcctgtaatcccagcactttgggaggctgaggcaggtggatcacgaggccaggagttcgagaccagcttgaccaacatggtgaaaccccatctctactaaaaaaaaaaaatacaaaaattagctgggcatggtggagcacgcctgtaatcccagctactcaggaggctgacacaagagaattgcttgaacccaggaggcagaggttgcagtaggccgagatcgcaccactgcactccagcctgggcaacagattgagactccgtctcaaaaaaaaaaaaaaaaaaaaacgctcatttttaactgcttttgatttccttttcaacagcagattattattattttttcttttcccgtcttctctacccctgtgacacctgtacctataaaaggggagagaggcagtggtatcttatattcattttagtatttattatttacataaatagttttaattaatgcattttatgcattcttattctaacttattctaagaacttatatatccctagcacagtgatagattttacaaatatgtgcaagatccttgccctcaatgatatatctagtttgtaattgatttaaaaattaacggagtgtaccttgaggatcctttgttctttcataaaatctcattatttgtcattcctatgagaccaatggttgaccaagtattgccttcagtgttagattccaagatttggaagatattataaagagggctttcatgggttactgttaacaatatttgcacttttctatttgggaagtatttattgagctattatagagtgttgtgttatgtactacagagcagattttctaaaccttgctaatatttggaattacctgaggagctcttaagaggtacaggtcctgaggccctacctgcagagatttcagcatgctaattcagtaggtatgagtgtgttagaattcagatcacaagtaaatgagagaataggagggaaggacagggagatggtgtcaggcattcttctgagatgcttggtagtataacaggataatagattgaggaggaagagggtagtgagtctgttcaggaaacaagagaacttaaagcttatttgaattttattctcgtatgtctttttacatttccaaaatggtctcaaatattacttttctgctttcaaatagaatgtcaccaacagactaaacttgacttaaaaaaagaaacaaggagccaggtgtggtggctcatgcctgtaatcccagcactttgggaggctgaggtgggtggattacttgaggtcaggagttcgagaccagcctggccaacatggtgaaacccagtctctaccaaaaatgaaaaaaaatagccaggcatggtggcaggcgcctgtaatcccagctactcgggaggctgaggcaggagaatggcttgaacctgggaggcaggggttgcagtgagctgagatcatgccactcctctccagcctgagcaatagagggaaactctgtctcaaaaaaaaaaaaaaaaaaagaaggaaatgaaatcttcaggtcctccctatcttactcttctcagaattattctaatgttttgatcacctgcaacagtatacactgatgtggtttctgaactaaagaaaattactgctgaaagataaaattgaaaccagttggaatccaaatggggaaaacagggacagtctaacttgatgtttcccattgagctcagccagcaacaaacaaattgagagactcagtaatatttttatgtgcatagaataagaactgtattatatgaaatacaaaagtctgatttatgtgtgtgtgtttgtttttacagaacttgctcttcattttattataaaccagtatgtcccaagtgaaacattaccgaacactgtagctgcttatgagctctcattcaaccccaataaggatgggatggtagaaactaattttttaattttattaaagttgagctgcgttttcagtcattttacatgaaaacgtatgtgagactatatggggaataaaataaaggacagttacagtttttgatgagataattgatccctgtaggaatgacacattcaaaaaccatgaggagtataaatgtgtttgattatgtgtatcctacttgaaaaacagaatgtcaacaattatagcaaggagcttctagatcctaatttgcaggggtagtgttgaacattttctcatatttgcaaaagtggaagcaagtataaattgacctcagttgcagaaggaaggggataaggaatcagacatttattgaacatcttgttatgtcaggggtttggaaactatggtctgcaggccaaatctagctgaccaactatttttgtaaacaagatgttattggaacacttccatccttatttgtttacttagtgtttctggctgccttcacaatacaatagcagagttgagttgttgcaacaaacatggtataacttgcaaagcctgaaatattcactatctagccttatagaaaaagttcgctgaccttctttatgttactggagcttttacatgtatgtgccatttctttctcacaacattcctatgaagcaggtgtcatcagcacatggtataaataatctaaatttcctatacttcaaacctgacgaatacatttttaatacccacattttcaaagtcctgaatccctacttacatgatatctaaaatttgtctcaactgcttttcaaagactctcctggttgattctgggagtctttgggaatggaggtgatcagaaactaatcagctaatgttctttggctttggattcttcctcttgcctatgccttctgtgagcatatagctccactctacacaaccattttttttcatctggcaactcctctgagcccttggattcctgacataatctccaaccctctcactccagttctttgtacataagttatatggctggactagataagtatggaacacataccccacccccctcaacaccattgttccatctctcgtctctagtctttatcttcccctgcaaccataaaaaattaataacacccagcacctcctgcagcaatcaccaaccatcaaattcagaattatatttcaggcaaataaggataccaagccatgtataatgagaagaaaccacagctttgagttaatattcaggaaggcacagcaaaacactttgattagggccacaaggaagaactctatgaggaatattaaagtgcggggttatgctcagcatctccacggaagttttttatctcaaattatttagtaataatatgtaggaggcaactgtgagtctcctagtctgaaaagtcctacattgtcaatttgagattatggctacaaatatttcagggtgttactttgttgagtcttactcagcaaggttaatgtacgtagcattaaactgaattgtgtgtaggatctgcaccaagctgagatggaccatatcaaatcagaaaagcctgtgtgtgatgaatgcccagactgtattctcaacaagaattgtcctattggcctagtgatactggtttttgtagcatcgcaattcctacagatatgcctttcttagtactttgtttgatgcacttagctcttggagttgattgctggactcactgattcgtgacaggaattctgacatttaaaataacaggaagttctctgaataaatgggatagccagaaaaatgtcagttcgtacttagaaagccagagacaaccagtgggtaaagtgactgacttgagcttgaataaggtaattcatataggttaaaggttaacaggaaaccaccttgacaacctcatttgtcaaatatagtcatgtaccacaaaacgatgttttggtcaacaatggaccgcttatatgatgatgattccataagattataatggagctgaaaaatcccaactgcctagtgacatgtagccattgtaacattctagtgcaatgcattactcacatgtttgtggtgatgttgttgcaaacatactgtgctgccagtaatatataagtatagcacgtacaattgtgtacagtacataatacttggtaataataaacaaccatgttactggtttatgtatttaccgtatttttcattgttattttagagtgtactcttgttaaaaaaaaaaaaagttaacagtaaaacagcctcaggcaggtctttcacatggtattccaaaagaagtcattgttatcataggaggtgacagctccatgtgtgttattgccccttgaagaccttccagtgggacaagatgtagaggtggacgacagtgatattgatgatcttgaccctgtacaggcctaggctaatgtgtgtgtttgtgtcttagtttttaacagaaaggtttaaaaagtaaaaattttaaaaaagttgaaacaggaaaacgcttacagaataaggatatagagaaaatatttttgtacagctttgcaatgtgtttgtattttaagtgtgattacaagagtcaaaagtttaaaaaaaacaaaaagtttataattactataagctaagtttaagttattattgaagaaagaacatttctgtgaatttggtgtagcctatgtgtacagcctatgtctatagtggtgtacagtaatgtcttaggccttcacattcattcaccacttactcactgactcacccagagtactgtccagttttgtaagctaccttcatgctaagtgctgtatgcagctaaaccattttttatcttttatatcataattttactgtaccatttctatgtttaaatatgtttagatatacaaataccattttgttacaattgcctacaatattcagtacagtaacatgctgtacaggtttgtagcctaggagcaataggctactaacctgtgaagtaggctataccatgtaggtttgtgtaagtgaaccgtataatgttcgcataatgacaaaatcatctaaagaagaacttctcagaatgtatccacatcattaaacaagatgtaagtgtactactttgaggtaaagaccatacttcagttttggtatttaagttaccacttcaaacaagggaaattcttccctaaaacctctaagacaactttatttgtccttcctaaaatatgcattacctgctgagttattgaggcccatttgaaaatacacaacattagctatgcacgctgttaaacataatgttctggtgacatttagcagtgttcagtaattggcttaatgaacaggtgtgcaagtatattagttatgcagatgttaatttgcagtaacatgtgcttcctgatttggggtgttcttgtataaactacaaccagtaagatttgttccttaattaggaaatcactacaaagtatgtctgtgttatccctaccattacaaccattagtcttgtttaatgtgctctgaacttcagaaacattcttagtaatgccattcctattgcttcaggtactatgcaggtgtcagaatgaaatctacctttctgtgggatgccttggttagtgtgcagctgtaggcaacatggagaggggaagcttcacagctgtaatatgtagcatgtgcaaggagacagaaatggaatctcttcctgcctattgcatcagctttccctcctaaggtttggtgaacacatgtgttattcctcacaaaacagactcgataacaattgaacacaaaatagtggttccttacaaacagattcatctttaccagcatttttaattattcttttccatattgtttgtaattcctgtctacacttggcccttgggatttccaaggttaacagtttgtaaactataaaaatggataggaatgtttgtgagatttattcatatgatttttatttttatgtcaaaaaataggaaattacaaaggctaatttagcaaacgcccatctaccagccacccaaaatgaacacatgttaacatttagtcatatttactccaggtctttgcttttaaggaaataaaacattaaagttaaaatggaagtttccaaggttctacctattccagcattagattcctcctcttaggcaaccactgtcattaactggtgaatatctagtctatgtttttataattttgctacatatatactcatccatcaacaatacgcaagattagtctccgttttatttttaatttagatgaaaattatactgcatgtaccattttccatagctttaatttttccactcagcattgtatttggcatcaatccttgttgaaatatatagctgtaatacaatcactgtaaatgctgtgtgatattacattgtattaatatgccacaatttatccatttcataacccctgggcacatgggctgtttataacttttctactgttataaacactgttgaagtgaacatttttgtctccttgaccacttgacctacaagcagaaatgttgggctatgtttatgacaagcataccttcaaatatattagatgttgatgcatgcgttttttaagtcattgctgaatatttactgtcaaccattggcataatcaaattcttcttcgtatcttcatcaatacttggtattgtgagacttaaaaaatttttcaatttgatgactgttaatggtatttcttcagttattttcatttgcatttccctgatcactagtgaagttgagcatgttttcattactagctatatgaccttgggcatatgatcaagtttgtccttgatttcctcatttgtaaaatgacagtggttaatacctatcatataaagtggtataaaaattaatgccagatacagagcagatatgtaataaaaatttgatttttgtggtgcttgtgaagattgtattggtggttaccagtagtaaaactactactactgctgttatttttgttttttaatactctcatctgttgtgtattgcatatgtatttatctattgatctaatcttctttgccctttttttccatcaggttcatgtgatatttccagaaatgcatagataaaggtgattcagaatacagtagaaaataacaaaaaaaatcattaaacctgtcacatgcaaaaaccagagtagatttcccgtacctttcattgccattcttgcactcattttaatattatcaagtcattaattgaaattaaaatattgtatatttcaaccaatatgttaaaaaattatttccatgtagctggaatcacctctggaattgtatccacatggataaaatatgtatttaagtatatatggatcacaattcttatatttgtatgttatatgtaaaagaacaattggcatttacttgttaaatatacaaatatgtatgcgtgaagttacataaatatacaaatatgtatgcatgaagttacataaattttcagtgtgtttgttgacactactattattagctttatttaccctggctttgtatatagtgtacttttttgttagtttgttttcctgagacggagtttctctcttgttgtccaggctggaatgcagtggcgcaatcttggcacactgcaacctccgcctcccgggttcaagtgattctcctgcctcagcctcctgagtagctgggattacaggcgcccaccaccacgcccggctaattttgtattttttagtagagacaggatttcaccatattggccaggctggtctcgaactcctgacgtcaggtgatctgcccgcctcagcctcccaaagtgttgagattacacccagcctgtatgtagtgtacttaataggaagggacatccttttaattctcctcatatttcttataatatgatgcaacacataatgtgatgctgattcaaaggtatgatgttccctatatagaactatgcttgcactaagaaaatgagaatttactgagtggtatacatgtattcatctaagctatattttgtggatattttatggtacctaagctatatattttatggattctttataacatttataaagaaaattataaatgttaggtaccttttggggatacttccataattagtggtttacatatgaccatgcagtatgagtagatatttatgtgttgtgtaccattgtatgctcatgctaagctaattcatagtaggtgctcaagaaatatttggtagattaatgaatgtgattctggccatagaaatcagtctttctcactgaaattttaagataaagtagttatacaaattttactgtgattcatggttagttatcactatgtaaatcatgcaatgttgcctatttaaaatatcttaatacttgctacaaattataataacttgtcacatgttctgtgtatccactgggatatcagaaattaataggagattcctgaacattgcctatattaaattggggaaagaatataaccatgtttactttatttatgctgatgagcatttctcagttgtaaaggaatacatttatagtacaattgcttgtaaaaatccatgtattaaaggaaatataagaatactcagtgggcattttatcttagataatgagtatcttgatgttaacatatctttaataataatataaatgtcttcattattaggattatcttcctacagacagtattttataatgtttcattattattctattagcagtgccaatttacacactcaaattaattcaatatattggattcaaacccatttgcaatatgttttttcatttgtacggggaaggtctcgtttgactgtgggcctcattatgaacctgaggaccatagggcaattgatgataaaatcaattcatgaagtttttgtatcaaaacttaaaaaaactttttagtttcatccaagtaacttcaaataattatagaattgctatttatttaatgttttgtaaccattagaaacatacagaataaaagtatcctaggataagtgacattttgaggtcactatgaaagcaggcaatttttaacatatgatgtgttgaacactatagggatatttgatgtctcattgctgttctttgaattctctatttatctaagcctgtggtcatgatccctaaggaatgcttttaaaacaagaaggccaaaggcaataatagccactggtctgtaattatttatcatggcaaaaatatgattagttctgaaagcctgtctagttagagaactgttctaaacttgtttttctctagtgattctcagaaaagcagtgcccactcatggaactcttatcacttttcgaacccaggatttaagccaagttatataacacaaggaaaatatgttgagattcaagaaagaaaactatgaactatagatatttagggcatctaatcttaattttaaacaatttgttcacttgaaaaggggagaggctagaccatattttaattaaaaaatgcaaaaatataaagtcattaaatgagcattatctattcctgggttagtcaggatcctgttagtttgcagaaccatctttataggtccttcatggcacaacatgtttttcttatatgtacttggctaattagtctcccatagtgaattttaaggcatattgagatattaggaaaattttcttgactatttccttgactgggttcaaattagtgaatgattctagaagtaatttcaatatgattcagatatttcacattttatagacaaagggaatgactattggactgtcattttcttgtatacaattgtcttaagctggaactggcttgacaattagaataaattaaaatgttgattattgcatatgaaagactctatgctcttagaaagatcctttgaagaatatttgagatatgttttaatgtattttaaaacatatttggaaatatatacagataaatatcaacataaaatatattcttttaatatattttaagagaaatacattaaaagtcacttttcttccagtagtagcaatgactattatgttgaatccacatggcaaactgcttgccatgtctcataagatcataatttctaagtataattatccattctccttagactgcacataactttagattggccagtctggtaaaatttagcactgttaggagtttagttatccaggtaatttattttattaatatctggtatttctgtagcatgctcatttaatttttctgtattttgtaccattaaaacaaaggaagtcttaacggacttccagtattttgatgaattctgtagaatgttgcttccaagatggtaacatctatgaacatattgcctaagtaaaagtgtactgtggttttatgttgctttttctctaaaaaagaaaatcaataatgcatttgtggtctttttaacaaagattaggtgaattaaaataatatcattattgcctcaaaatgaagttatctttttaacattgataaagcagcagcatgattatggtcatatatgaaccagtgatgtaatttagcagcatgaatttgggggcaaggacctaacactctacttgactgaaaaagtactagctttacttttcttatattttctgatggccccattacttacaaccctgtttttatattggaaaaggtaaactgccaacacttgagtacaatggtagctgtaaaatttctataccggaggggtttggggatttaacttaatgctttattttcatagcagacagccacattgttttttgggccggcctacttggggagttggctgatggaggttatggaaggctaaagccactccttggcactgctactccttaccctttcagtcctttaaactgtttttaattatactgttaccttctaaagaaagcaaagtaaatcttctgttctaaggaagcaaatagtatttttcaaatagcgagggatacaaagctaaattactcaaaagaacacattgctgagtctgtttaattacatgtatgcaaatggtgctactgttgtacaaattgcaaatggttcataactattcttcaaaacagtctcagcaggaatttgtatatggcaacctgtttagcagttaaacttaccttaggtgctttaaagcaatttcactgaattgtttaaattttagcatattttgagagaaatgcatgtcttccttttccctcaattagttcagattagtgaggttgtactatatatttaattccagtactgctgtaggtacctggtaaaggagtaattaatgttgcgtattaggtaagaaggagcaattgatttttggttcatttggcttatcttttctgcttaagtgctgatatttaatttgtagtgaaaactctaaacaactctgtatttttatgtttatcctcttccttgagctaatgaaatcaacacatttattgatttcagaatgagctttattaatgtagttaatatgccttactaatgttattccgtgtacttggattagtacccttattgtttatgaatcaacattttttctttcagttcaaaagaacgcagaagcattagaagaaaagaagactgggcctacaaagaagaaagtgaaagaactgagaattttggatcccaaaacagctcagaatctgtgtatgtaatattttcttcgtaggattggtataggtaacggtgagaggggtgggagctgtttaatgtatttaatgaaagttgtaacctttttaaacaggcatatttagcatcttctagaaacaaaatcctgtgtaaacatgatttggttgcctttttgtcacttagccagtaaggagaaaattctaattcaacctctgtcaggccagatgaaacttgggaatagtaaagatttggaaagtaatgataataaaacactgttggaggacatagtgaaacataaggcagaattgacaaaaagtgatttttttttccttctctctagacctgggattgatagttttagagtattcactagttacattggaaaaatccttctactgctattcctttatgtctgaagtaattgcgatgtgagctacttaaattgttaaccttaactgcatttaaaaactggttagtgaatcttgaagcctttaacaaaccagtcagccattaagtataccttttctaaagcagatggacagttaaacccatcttcatttatgtaagcctttaagttttaacatactcttccctctgtcttgaaatcagaatttttggtctgtcactacagtagactgtgtttagattttgctgatactaaaacactatgcatcagagatttccacacatcaagcatgtctaattgcacaaagtaataccatgggagcttattttgttaaggaatgtggtatagggaatcattacaataaacaaaacatcattctcatgtcagtagaaatgttgctttcagagaagcagtttatcagtagctgttgtgaatgtgtacattgcttatttgatagtacattttcaaagttgacgttcagtacttttctttaaaacacagtaggatctcaattgctggttgatttctgtcaacattattcttttagattgtggagatctcatttggtcttatgtataaggtaatcatttgtctatagagtgaggattttgttttcttttggtatggctgaaggcatatagaccttttcatgaaaaaaagaaaacaaaattcttagaagtgttcaagttctgcgtgccgggcgcggtggctcacgcctataatctcagcactttgggaggccgaggcaggtggatcacctgaggtcaggaattcaagaccagcctggacaacatggtgaaaccccgcctctactaaaaatacaaaattagccgggcgtgatggctcatgcctgtaatcccagctacttgggaggctgaggcacgagaatttcttgaacccgggaggcaaagtttgcagtgagccgagatcgcaccattgcactacagactgggcaacaagaacgaaactgtctcaaaaaaagaaaaaaaagaaaaaagaaatgttcaagttctggtgataagaacacatctgtgttctttaaaaaatatgtttaatggaacatgttgttgcaagtaccttctgaataattgttagctattctaggtttaatttgctgaattattccaatatgatatcatagatttccatttaagaaaaagttggcaggggaaattgtgagtcaatatataaagtaagtaatagtgtaccacaggaatataagcaggaatgcagagcacactgatgatttaggcactttaatttttttcttatgtgggagaattgcagagtagatggatatgattttttatttggttattttattgtctttcctgagaaatactgtgttgggtgcatctgacaatctccacactaagttcttcattgaataaaaaggtcaacttgaaataaaatctcttaagttttcatgggtcattttgtgttatcatcctaatctaaaaggcataagcatgtagtcatgaatgctattagtaggaattttattttgtgtgtaaatatgcactagctataaacattacagcccgagaaaatatgccattttgtctagatggatagagtgagtagtccatcaaatggaacaacttttgtttgttcataattctgtatattagtgacaaatttcatattttgagtctatgaaatgaaaatcagacgtttattaggactttaacatgttgatgctgttatacttttaataaaatcaaattttattttagccatctttctgggatcatatcgcatgccatatgaagacataagaaacgttattctggaggttaatgaagacatgctgagtgaggctttaattcaggtaacttggatattttccttttgaaattcattttcacagatttttttggactattctcttctcaatggagttgtaagaaaattctcttctataattagatttttaaaaagacattgaatagtttaataaaatcaggaatatctagctgtgttgatagtaaggggactcagtatagaaaatctaggttctaattctgtttctgccacttataagctatatatccgtttcagtataagcatatgcatatatagacatatcattgtccattattcactgtacatacaattacatgtacttcatcaccaaaatggctgcattaagtgtatattgttcttaccattttatgggtgaaaaacctgaggggtcaagaggttaaatagcttgctgaaaattagtgggtatttaacatacccattgttaagttgagtatctaacttttacccaactctgtttgggtacataacatgtattgctgattatggctagcactttctgtattttttatttcattgaatcctacagtaatcctatgagataagcactattattctcattttacaaataaggaaactgaggtttagagagattgcccaatttcacaaagcttgtaagtggtgtaagttgcaaagtaccagaactaggattcaaaacaatgtctgtcttgactctaaagctgttatattattctgctttccatgaacaaactgtttaatctttctaaacctctattttctcatttgaaattacagggtcattgtgaggttttaaccaaataaagtgctttgtatgataaaggactatacagagctgacacattatttgaattcttggtatgtctggccctgtctggtttaatttttgaaaggaataactgtaaagatttctgtggaagggtatagtcattgtagttttttctgtttttctttattttgttgttttttgtttttgagccatgagttggttttgagttttagaaaacatcaaatagggccaggcatggtgactcacgcctgtaatcccaacactgtgggaggctgaggcaggcagatcacgaggtcaggagatcgaggccatcctggccaacatggtgaaaccccgtctctactcaaaatacagaaaaattagctgagtgtggtggtgcgcatctgtaatcccagctactcaggaggctgaggcaggagaatcacttgaacctgggaggtggagaatgcactcagccgagcccatgccactgcactctagcctggagacagagcgagactctgtctcaaaaaaaaatgaaacaaaacaaaacaaaacaaaaacatcaaatagttaaatagcttatgctataactttaacaattttgccatattccctgcaaactctaaatctcagagaacctgcatatataatttgagcaagtgatgtctctgtggaagctcttctattttggattgtaggcttacattaaagtttacctcatatatatgtcttaaatctaggcgtgatttttaaaaataggactcaggtgtaataagatgacctatgtcatctcttccttgtttttagacctccattcccttttctaagcctttatctctttatctttttcatgtatctgtatattttacccatatcctgctttacccaccaattttgtgccttctgtttgctgaggacttttttaaagccaacttgctttccttctcagtaccagatactctgaagtttcttctcaatccttaccctgtttgatcaaaacccattttcttagttttgcttgtgggaagaaaacagtttaacatgtagtataatgtacataattggaattgtgctacttgggtacgggtgtagggcctaagtggcgagtaacttacctgagttattaaggttagtattgcttttatctagacaaatcaaatgtctgagtatcttctggtaaggaggatggatgctcctgggtagaaataattacatgattttctagtccccaagagagatgacttccctctgtcaggagaaaagactataatcactagcacctttttctacccccaattccagaacatttgtttcagtgatggaaaagtaacatcaatttgccattcatttgagctgtttaccatttatgtctaattaccatgtagcacatcgataatgcatggcattaaatgtgtatcatcagattaactttgttgtaagttctatttgattacagtgctaaactccatccatgcataattattgttttttgctcatgtagcatggttgtctcctcatagcaacaaaaacaacaaacaacaattaaggatacatcacttcccagaacttgaattaacagtagtagtattttctcttccagtatgggtcaataggctcttgctgggcagacaactgatagaatttagttagttggcaggataattgtcttacttaaaaaacaaaaaacaaaaaacagaaaaacttttatttaatcagcaagatccagctctaagttgaagcttattaataaatatcaattttcattttatttcaaaatatctaaatttaagctagaaaatgagttctctatgtgggaaaaattgaaatggcctaaaatacttgcagtagcacgtagaaacatttaaaagtacaccatatcctgaggttgttgaggagtttttaatacatgtaattatgagttactgtcaaataatgtgtactaaattttggtgacttttagaatcattattctagccttcaaaatttgtttcagtataattgaatttgatctattgagagaaaaatctaagaccaatcagtcagtgctttttaggatatcagtggtaaaacagaaatatgtatagacacacatatagagcattgacagagtaatgaaacgagcggtttgaaaaaagtgatgcatgtgtgaagggaaaaataaaagtatgttctatttgagatccttagtgcatgcaaatgattctaggtagggagtttatacttatattcttaaggaatatgtgaaaaaaagatgatcaacataaaagatagtgtattattactgcagaataatttgtaaagatatgataaagcataggttggtaacctggagttcaaagccctctttggggacccatggagagaattcagggggtcctgaacttgtatgcgaagaatattacatctttattttcattatcttctaattaatatttagcatattatttaagagtataggcaacagaccaaagtagtattaacagtacctctaagtttttcactaatagaaataataaatattttcatatcacattatagttgtggcagagatcttaaaatactgttacagtcattaatgcttcaaaattacagtacttattagagctgcgactagaaattatttttaatgctttaatcaagcacttctatcattatatcactattttggtaaatatgttgataactatttaaatgtaattggtattttatataatcctatttattttattttatcctgatatagaggttcacagaaggtgaactgtagggtagggtgggctgtggttaaggtagtcttcctggaagaagtgttctagactttgaaacactagtaggattcagttagagagggctaggataggagaatggtggccaaaggcttgaggtatataaaggatactgtctttatttttctggtatagataagccgtcatatagggtagcaatgagaaagagcgcataaaagattagtagcttggtggtggtcatattttaggggcacacagatagcaaattggtgactcacaggcattcacgctctctacctctcactttctctccctcacttctgttttatttggcctttctagtgcctaatcagtgaaattttaatgtcacacactctccggtttgccacaggtgccaccactccctattgcattttacttactctgactcattcctaacccctatatacaccagaagttttgatccctggtagacaacatgaatgctgagctattgagtttggtcatggtcaaattgtgtgcttaggaaaggtactcttagctgcagtacatcagatggcttgatgtaaagagacttgacatagggagatcattgcagtttcaagcataaggtgtaataaagccctgaatatttcagaagtaggagaaaagggaatttgggtaaataaggaatttttaaaaaaattattaattgaaaaatcctggtggtagagacagtggttgtagccctgacacaaacaggcaaatcgggtaggggagaaaatactttcagggcaagggagaaaaattttacaaaaaacattacattggaaaatgtattggaggtcagaatagaggctgagactgaaaataaggatttttggagtcatttacaaagaagtgattgttagaatatcaggaccaatggagttcttaagtttcctcatgaaaaaagtaacaaatggaaagttaaggactgcatatctggggactatacatgtcaaggggatgggagctattagagaaatcagagcaaaaggagtcagcatatcagagagatggccaggatgctatagtgtatcatcaaagccaacacaagaggcttttaaggagtgatgaataagagaatgagattgggagaagagatatttccttcgatatgtcagattataatgacttatttagtttaaatagttatttttctatagttttttcttgaaacaatctacactatataccagacacctgtattccttaagcaactgttctgtttattcatggtattttggtctctgtctcccttataagggacatctgcattcctactgggcatgcaactgtctggtgtcctatctattgttcttcttccacttgtattgttttttgtttgtttgtttgttttgtttttgacatttccttccttcctttcttccttctctccctccctccttctttcctctcttcctgctactttctcttacattcttttcattcccttcctccctcattcccttcttccttccctcccttcctcctctcctccctcccttcttttcttccttccttcctaagtaaattctttctttgatgaaagaccttaattttccttaataatacctaaggtgaaatacagctcctggatgcctccatacctggaaactacagaaatacctccatagatgtttctctacgatgcatacatgggactatgccagcttgcttctatcccccacaatccccctcccccgccccaccaataatttctacatatattggctgttttacttttctgaagcccatttgagtaaccagcactgtactcaatgtgtggtatttataggttgccacacgattatgttttctcaaatgtgatttttatctcaaaacagattatatgatctatataacttattattggataccgacagaataatcagaatgacacgaagatcatctagtccattcccctgattccaggcaatgctacacctaagtcatcaaagatagatgggtatctattgattctgcagggaaaaaagattcttcaacttccctcaattaaccagttctagagtataattattcttatagtcaggaagctcatgcatgtgtaatagtagagctcgtttttgtctcctcaatccatctttgtaatcattgatctatttacgtggctatcgaccatctgtattttatgcaggcttgtgagtctgcatgtgtgcgtgcactttacgagggttgatgactttagaagactacaagtatgtcaattaaggctataatggcattagtattgtagaatttgaaaacatttttctcttaaataacaacttgtattcaccatgttcattttcataattctttagggaaaatgaaacagtagcaatgacagtaacaatcataaaacatttctttcttatttctcatcatggtggaataattatggcatgcttttgcagtctgaaaattcttttatctataagctgctcttctttcacatctttggctcttaaataggtgattaaacatttttttttgtttttttcttttattgacgtttcctttgacccttgtttgctactttcagtctattattataattacacatattccaagcaaatgttatcgctgcttatttttattctctctatgtctattattgattaatgccagtattttcatttgtcaccatcaccagctgtgttgttgttcacagagaaagaaaaggtagctttaaacaattaattttttcttgtactaattggattgtgcaaaatgtttttaaaatataaaaaattgagcctatggccgggcatggtggctcacgcctgtaatcccagcactttgggaggctgaagcgggtggatcacatgaggtcaaggagtttgagaccagcctgccaacatggtgaaaccccgtctctactaataatacaaaaattagccgggtgtggtggtgcacgcctgtaatcccagctactcaggaggctgaggcgggagaatcacttgaacccaggaggcagaggttgcagtgagccgagatcgtgccattacactccagcctgggcaacaagagggaaactccatctccaaaaaaagaaaaaaaaaattggccgggcgtggtggctcatgcctgtaatcccagcacttttggaggctgaggcgggcggatcacgaagtcaggagattgagaccatcctggctaacacggtgaaaccctgtctctactaaaaatacaaaaaatcagccgggcacctgtagtcccagctactcgggagggtgaggcaggagaatggcttaaacccgggaggcggagcttgcagtgagccgagatcgcgccactgcactccagcctgggtgacagagactgtctcaaaaaaaaaaaaaaaaaaattgagcctatttacatttttagcaaaacgtaagtctcactaacagttcagtaagatgcgatctcagaaatcatattttatgctgccttggacactttaaaccatggtagaacttcattagaattttgattctttcatactatatccattgggtctattgaaattagacgatggtcagggtagaacaggaatttcctcataagtgtaaaactaggggccaggtgcagtggctcatgcttgtaatcccagcacgttgggaggccgaggagggaatatcacttgaggtcaggagtttgaaaccagcctgaccaacgtaatgaaaccccgactctactaaaaaaaaaaaaaaaaatacaaaaattagtcaggtgtgggggcgcacgcctatagtaccagctactcgggaggctgaggcaggagaatcgcttgaacctgggaggtggaggttgcagtgagccaaaatcacaccactgcactccagcctgggcgacagagcgagactccatctcaaaaacaaacaaacaaacaaacaaacaaaaacaagtgtaaaacttggtaagtggcctctttttccttatataaacttccaaaatctgaactgggaaatgaaaagcaaggttataccataacccctcctctaagtactagctgtgaggctacttccagacaaaaagcattagacacttagcctaagagattcagggtacaggagtcaaggctataatgtccttgatggaattatcagagagatagagaacaatcatgatttcctcccccagctagctccctattcattttttgtagcatacaaatttgttttaaatccaaagcttattggctagtcatatatttaacaaattatacacttttgtaattgatcatatctataaaaccactttctcttatgtactaaagaggtaatcaaaacctttccttctatacataaggaataaatctttacattctttttgcaaggttctattataattctagatatcctcctatgtaaaatagaaatgtacctagttattaaatcttttaaagacttgtgatagttatagtataatctaacataatataaaatttaacatgctatggcacactttaacatagtataataacgggtataacgtaatggtattttaactaatctctttaaaatattttaggaaggcaggaaggaatacacaagggaaatttaagtcttttaatttcttaaactcagtggtagacacgtagattcattgtctttgtatccatcttcgtgtcttaaatattacacaatgaataaatttaaaagtatttagcaagtgctgaaagcgtatgcttaaatcaggtttcctctactttggcactactgatgttttgggcccatttttctctctctctcttcttttatttttgactactgtcctgtacattataggatgtttagcagtatctgtggctctacccactggataccagtagcagctccaccaccagttgtgacaacccaaattgcctctagactttgaaaaatctctggggtgcaaaattttccctggctgagaaccattgtcttaagaattacttttatttctgaagtatatgtagtaaagtttcagaatttaatacgttcccaatcatttgcttttattttccgtgtttattataaacttcgtgacaggttttggacatttaattagtataggtccaaacaaaatgataccatacatttacaaattctatatcccaggaatggaaagtactcatgttaagctctgattctgacagaatgcattcctgttacgttgcaaataccactagtcaagcattgcttaaagtacaggtcataattgttttccacctgtgaatacaggcaatcatatcagtgtgaataggcttttttttttcctttaccacatagtatttacatttatagtttaatagtgctgagcaattcactttacaccatttttaaaagcttatttgtttttgttttgtttttttttaaatatgtcatttagataaatcaaataatatcatggtaacgacttcttctctgaagtgaagagagctgggtctgaatcccagctctgccactcaccagccatatgaatgggagaaagttacctaacctctctgagtccattttcttttatcttttaaatagctagtaagtttattgaacggatcaaattaaataacacatgaaaaagtcccctagcacattgctggttacatgataggcgcacaaagaatgtcttttccagtgagtaggaacagtacagttacaattggtattttgaaatattttccttcaaaacttacaattgaatagtcagccctcagttttctatgttaatggaaagaattatcagcagggtgataattctcctggggcttcttcctttctctgtactgtctgaatcccagaaatagagatatcaaatagggacaaaggaagtatccaggagtagtgtactatttttgaggggactattcagaaacctcactttaacccctttgatctttatttttcatgctttatgttgtattttagttcatttgcatgctgacaagagaaacgtagtcttcagagtagacaaatataattgaatgacaataaactagtaaggggcctctagataaagaaatcaaaggaatgtgaaagcaagagctgctttggggggactgcagtaggtgagaatgaggactccagaatgccatcaaaaccttttaatatttatacatattctatagatttttaaatattccacttaaataaatgaaacaaaagtttatccatcaattgtttccaacagctttaatgtgttgttggatttatattactgtaaattattcatgtctttggtgttgtaaaatttagctttcaatgcttgtattattattaaaaactgagatgaggctatcataatttgaggtccttaaggcaagtgatctgaaaatgttttaggaacctggtgtttttgtagttgcatattttttgtttagattttgttttattttagtatactgagtgatattagaatcatatattctatatttagaatcatttagaatatatgagaatatttgaaatcatagctatataaaattatcaatatctaatatgaatgaaattgtgtttgtttagtttgagtattgctagaaaacattttgtagaaaacgaagtacctaaaaagtaacaacatgaccttttctgaagttttggcagtagaagaatatagaaatcaaagtacctaaaagtagaaacatgaccttttccaaaggtttggcagtagaataatttttgtttgtttgtttgtttgtttttttgagatggagcctcgtttagttgcccaggctggagtgcagcagcacagtcttagctcactgcaacctctgccttctgggctcaagtgattctccttcctcagcctcctgagtagctgggactacagaccaccgcccggctagtttttgtatttttagtagagatggggtttcgccatgttagccaggctggtctcaaactcctgacctcaggtgatccgcctgcctcggcctcccaaagtgctaggattacaggcctgagccaccgcggccggccaagaatttgtcatattaaataattaatcaggaatggtgtgacccattcagaataactagttaggatttaatatcaactttgagtatttgttctaataaagaattgcaaaatatactaaatacttggggactaacaaagctagatggcagtgctaaaatgtggcttcaagagtgttttcagttgatcagaagtaggagaatgggattagtatatgacagcaggcaaaggggagagttgttagatgggagtaacctatagaggtatcactttacaggaaagaccgtaagcaggattccctcctaggaatgtctagaaagcatatgggtgaaagccaatatgatagggagaattctacctgatggaatgcttaaaatatctttttttttcttctcttcaaattgtggaacctttcatctatgaagtacttactaaggtgtgaccattcccttcagccttatacacattgtgctcaaattcatagtatgtacatgttggaacactattcaccctttaaaaagaaggaaatctttgaacctgcaggacattgtgctaagtgacataaggcagacatggaaagacatatactgtgtgatctcatttatacagtatatagaacctaaaaaagtcaaactcatagaagcacagagtagagtggtggttaccagggactagaggtgggagtggggattgggagatattgatcaaagaatatgaaatttcagataggaggaatagttcaggaaatttattttagaacatggtgatgatagctaataacagtgtattgcagctttgaaaattgctaaggtctattttaaatgttctcatcacaaaaaattaagttcgtgaaataatggatatgttaattagcttgatttagtcattccacagtgtatacatatatcaaaacatcattttgtacaccataaatatatcctttttgtttgtcaattaaaaattatttgcctttgtatctctgtcatagaatcagaggccaccaaaattaaaactaaagtaagctttataaattattcatttcccttatttcgcgggaggagaaaccaaggctcagagaggtttacatcacatagtcaatctgggatcacaacttggttcataagatgctcaatttattgatttttttaaagcccattgtttgacctgtttttccttgctgtggtatgcaggtgggcgagcgggttggggagtttactgctggacagcaataaaaagtagtaacagaaagtttactaattaaaaacacttagtgcaatctctgtcattggaagtcagagtagaaattaaattatcccttgaaacatcttcttccagtattagatgacattataaatgtcttcattgacattcattattgtttgtgttgtgaaatatataattaggtgccaaaaaatacttaattttacttaatgcagtataaggggcattggattccgtttctgcattaataagcagcattttagtaaaatgaaagggtagctcaattactaataagaccatcatttattttatcccatatgaaggattcagagtgacagaaccatttaatgaagtctttcagctttgtgagaaaaataagagtacatattttggccttcatttcataatttttcttcagtgtatatagctgaatagtgttgaaaaattagttgcttcttgggaaaagcaaagaaggtgtctgcttttcttccttgagtgctatgactaattgctacattgtctctttggagtttctactcttcggcggtttatacttaaaataccactctcagtgtagtggaaaaaaaattcttttgggtttcagtcctgtattctgtatatgaccttgggcaagtcacttttcttcttttagccatatagtttttgcctttagaaggggggaaatgtatacttataaaaattggttattatacaaattaaatatgagcatatgttaaaaacccttgcaaactataaaatactacacaaattgaacacacatagagattagtatcttagacatttatttagctgtaacctgtcactctttctggccatttatctaaagagaattaacacttaaacattcaactattacttgaaagagtatcccaaaaagaactcatagtcttcatccttcccccaaatgaaggcctatatctcctggaatttttttcatcccctctctcttctttgatcccagctcatcatgcattcttactgattgaagattttctcacctcccatgcccataggactagactactattgttttctagttggtctttgtctctagacttcctccagtctagcacatcacattacttgattcgactaggcattctttttcctccatcaattcattttcattcttaagaagtgattgcaatgattgccacctgttttcttctgtttttaaatgctgtaatggatctctagaaattggagagtttctcagagtcttgattttgaataatctgtgcattacgttacttacatttgctcttctccatgcctttgcacctgtccttccatcctttaggtgtcttttttatcttttaaaatatgacttaaaacctactttctcttggaaatactccctattctgtaaactagactgaacattctctccattcttcatctgctcatttctactgtgttattcttaatcttttgaagtgatttttgaaaaagatgtttgcatgtgatgcagacattctgagctgtatcataagcattctttgtattggtcattctttttacttgttttcgaatcagatgcatgatacagagttttctttatatgataatgttatatcatgtgatttggtgatattttcaattagatattttgagcctgttaggctagtcccctctacaaggctatattgaatgggtgagcactctatattaaactgactttcagatttacagatttccctttcttgaatatttagggctgctttatctctcaaagatttctgagaattataagaaccaccccatgtcctttattgaataaaaggtcttcatgaaagtaaacataaaaattccatacaatatcaaataaatatttacataaggttttgattaacgcttcgttctaaatatttctgtcatagatgactttgaaatttcttgtgcattgagagatgaaacctatcctcatctacacagtttcccgggtttcatctgcctattttgggggctttggttcacccaagagaatactgatggtcttcattagcctaagtgcatgcagtcagtgtgttcggtacactagatccaaacagaacagccacttggttctgtttatgtaggttccatgttgtatataattttaaaaatgaaagcgtgactacttccagatgaagagattttccgtcagtgatgagtagcatcgtaaatagggaagctttgtttttggctgccctaaatccatgaggaagatttgaagtattacaaagacaacagatgctaaaacagtatgcttctcatgtgaagttgtgcttcccctttggaccggaggtgtcacaggtctagagaagagttgagcttccctaaaggagagcttgggaatgttaggcatcctccttagatcctgaaagcatgggcttatctgatcttagggccaagtctcctcagaagagccaacaggttaaatgtcatcaagagggtggactttcagaggatgagtaactagttggtggcacagtaagcagtcatatagaagtgactgcttagagtgggactacatctgaataaagccaggataaactctgctcaaccaacataaagccagtcattggaaaacaaatgtattgggtcaccatatattgtcatatatgctacttaatcattttatttttatggaatgtggcatatgttctagatcatctttacatatgatctatctcgttgcatttcatttgatggtagagtggtggtagagtttgcctgatgaatgtttataaataaacacgaacacatattgctagttgggaaaataatcaattattttattttattttttttttggagacagagtcttgctctgttgcccaggctggagtgcagtggtgccatctcggctcagtgcaagctctgcctcctgggttcacgccattctcctgcctcagcctcccgagtagctgggactacaggtgcccgccaccatgcccggctaatttttttgtatttttagtagagatggagtttcaccgtgttcggcaagatggtctcgaactcctgaccttgtgatccgcccgcttcagcctcccaaagtgctgggattacaggcgtgagccaccgggcccagcccgaaaataatcaattcttaagcattggagtgaagactgttatttgctttatatctgttagaaacagtgtcccaggccaaatacacttatataggttatatgtatagataatttgaatactgcttcaaggggaaaatatttcaaacaaaactagatttgtaattgttgtaggatttctttgatttctacttgactagctcccctcagttcatggtacaaatgaatgactaagagtaagaattgttcgtgatcctctgattgtctctgatcccttttttttttttttttttttttttttttttttttttgagaaagagctctggggcagtgggctagaaaggggtgctcccctaggaaacccccaggccaccgctgcccgccacgcccgggcctaatgaccaggtgccccagggctcaccgcctctccagtccctgtccccctgatctcattctttctacactcagttgatgattctctttgtgaaaatgtatgggatgtttggaaagggtccccaaaaagccaaagcaaacccaggagtgtgtctatacattacaaaagtgaagggtcagtatctagatgatggtgaccagctgaaaaatgtccctgaatggctcatcaaaagaaatccatattgaattggatcagattaaaggaaggctaagtcccaaattgtaaaattttaaggcaacaatgtaaactctcccagagtaatcaaagactatctgagaacagaaggttgaattaagattaagaaaagggtcatttgagatacgtctctaatatttaggctgtgtgtgtacagttcaaagcatagtattaataaaatgtaaccatgggtgtgcacgttaccattactgtgaagccattgtttacccttctccccagaagaaaccactattctgaatctgaggctcatcaaccccatgcctttcttttgccatatatggatgtgccccaaaatatatgttatttagttttttcctttgtttttgttttgagacaggatattcgctctgttgcccaggctggagtgcagtggcacaatcttggctcactgcagccttgacctcccaggctcaagcgattctcctatctcagcaaccccacaactccctgctttccacctcctgttccccacttagatttactcacatatttaacttttttgtatacctttcttcttatatgacaaaacttccttctaggatcattttacttctccccaaaacaagtctgtttattttatttattttaatttattataattatttttagagacagggtctcactcagttgcctagcctggagtgcagtggtccaatcctacgtcgctgcagcatcagtcttctgagatcttctcaccttggcttcccgagcagctgggaatacaagcttactaccatgaccagcaaatttttaaaagctattttagcgatgggggtcttgctgtgttgcccaggcttgtctcaatctcctggactcaagcagtcccctatctcagactccctaatagctggaaccgaaacaagtctttttgaaagacttttagtgagattctggtcatagcaaacactgcttttgtttctctaattattttttttcacccttgttctgaaaatatattttcactgggtatataattctagcttgtcaattattttttctcagcactatgaagagattatttcaccatattctgggttcagttgttaactgagctgtagtctaaattgacattccctgggaggtaatctttctattctacctaggagtactaccaaagaataatcactttaaatataaattatcagcatatatttttacaactaggtagtttaaattctaacccaaaacttgcatggtggagggcgggggtgttgccttgtgtttagaagtttccagcagagaagccccttatctccaatcccagagtcaaggcaaaaccagacacaattctttactgttttcttctctaggcgggctttgttttttctccaaaataaccccttttctggaggtattaccttttggggttctgtaaaagctctagaccagtagagtttggtagatgttcctacgatagtcttggacttcagtgtctggttatgtgtctggattagtgctttctttttattttttttcccattggggagtttggggggcaagtaatgagaactttttaaaaatgtcttgccaagttagcttttcatctgaagatatttttaaagaagtctattcagcattttaggtgttctgtaaattgacagttcctctgggtaactaatcagctatattgctggaagcagaagtctattctaaagtatctctatgactctgttattgggaagttgagagaaacattagatattgataatctgccaccatgttcaggttagtgtatttaaagttctacagatgacaagcgttgtttctgcttaaagaaaaaagtgttagcttgccagatgtgtcaaaatgtccagggtattatggatgctccattttgactttgtatttctttagtctaatggataacttatactttgttttcgatacaggcacctttaactagtacttaaatgaaaacagagaactaaataatgatagccgatcatcatgtatggcagtttctattataaatattttgaactaattgaagtgatttatttggtgctgtaatgataggggtcttgaatatgaggatagaattcagctttggaagcatctgcatgtactattttataataatgaatcctagcattggtttgtggcagtttgtcatggccgtgataggatgatatctaatgaaagcagaatatagcattaacagggtatcatatatctgtcaacctattttgtctgttaaaaatctattctaggccaggcacagtggcttacacctataatcccagtgccttgggaggtggaggcaggagaattgcttgagcccaggagttcgagaccagcctgggcaacatagtgacaccctgtcactataaagagttttttaaaaatcagccaggcctggtggcataagcctgtagtcccaactgctcgggaggctgagttgggaggattgtttgagcccaggagattgagactgctgtaggtagtgattgtgctactgcactccagcctgggcaacagagtgagactgtgaaaaaaagaaaaagaaagaacgaaagagagagagagagggagggagggagggggggaaaaagaaaaccagtaaaccagttaggaaagggtaggtatatgtaaaataggtgaaggatggatatcaatcagaggaaagcacgccaaacagaaagacaagttctcaatcctgcccaaggatttaatttgcagcttggctttcaagctataaactgtcttcggcctggagttggggaattggggtttcaccaggtacccacccgcgtctgcctaagcatttggctgcctcctgttgctatcattacatttagacatgggcatacatactttggatgctgctattcaatactcatagtcattaatttattctatatgtcctactttttaatgcttaatatcactttttatgtttaatatggtttataatttttattttagagtacaaaataggacataaacaaaataaaaggtaaatagcatcaaaggagtacttttcataattatcctttatactgtaaatcataaattatgtagaaagcaatacatgtattttgcaaataggatcatgacattagtgggagtagaattttttacatataatcactattttttctattatagtagtaaatatatctgtgatcttcactgatctacttagtacagggctagaaccccttgaatagtttaattgaatttaaattaggaaatgtttagctaccgtgtaatttccctagcccagatttttggctgtggaatggaaaggaagggttgaacctgaaagagattttttttaggaaaaattgtcagaagtgtgactgaaaggtaattgccagtttgaaagcttagaagatgaaaaggatgccagttctgttggcagaatgaagccattaggagacgctgataaggtgtagggatgggtcagagtgaggatgagttctcctttagatttgttcagtttgagttaatgatgggacatctgggtgggaatgtcagttagaaacatggagcttgaggatgcctaagagtagtcagggctggagacgttcatttggcattatcagcagtgaggtgatattgatcatgggaaagtcaatgcgccttctagggaactgagtataatctgaatgttaaatgtcagagtttcaaatcatttctttaggatatgtttctctgcctgggctagattaaagattagataggaaacctttaaatccccgattatttctaagacacacttgttacttcaaggtcaggaattttctcatcgattttcaatgcttgtgtgttattttattaactaatgtgtttttgaaaatagtgactgcatgttgagggattgaaatgctccacccccaaatactttagtggtaatcagcattttaacatacttcagtatgtatgtcgattcttggagtcaaatgcaagagttttggaaatgttaggaattttatatcaaaaggagaagattgtaccatcaccacctgacagaaaatgtattttggatcaaatggaaggcaaattactcagtcatatgttgattgtgttccattgtgtaaacaagaacatacacagcccttttggccctgtcatctttatgagggcagaatctccagaggttaatgtggtggtagtcacgtggtagacatccagtatatattggcagaatggatgaataaaacagaaaataagtatagaaccaagtactggcatgaaactgtcatttcatttgaagaaaagtaaaggaacacatgatttaagaacagtaaacacatacacagtgatttaagccatataccataaaaaagttctgaaaaacatgggtaaggaattgtgttttctgaccaagcaaaatggggaaaagatgtgttatgatgatagagatttagccaagggacttttagggaaatgtttctttttcttttttttttttttttttttttttttttttttgagatggagtctcgctctttcacccaggctggagtgcagtggcgctatcttggctcactgcaagctctgcctcccgggttcacgccattctcctgcctcagcctcccgattagctgggactacaggtgcccgccaccgtgcctggctaattttttgtatttttagtagagacggggtttcaccgtgttagccaggatgatctcgatctcctgacctcgtgatccacctgcctcggcctcccaaagtgctgggattacaggcgtgagccaccgcgcccggccaaggagaacgtttcttatctagatttttaaaaatacacaattgtcaacataagttaaagtaagacattacatatatatataatatatatataaatacattttttataaagaaatattagccccaatccgtttatgtggaaaatgatagtcttaatcaaaatgaacctaacgcagttcttctactagtaaagtgacttaatgagatagaagacaaaaaagaaaggttatgttttggcaagaaggaaagggcattatggttcaatacctttacttaactaacctttaagtgttcaattaacatttaaaggaaataaagttttggaagtattacagaataattgcagaaatgtaaaaagtagttaaaagcgtgtggtctattcgtagaaattccttcacttaacactgacaatcatcagaatgtaaatttgtgatgcgtaaaagatgaagaaaactctgctcaatcaatgacatagttgctgctttctcttttgctgttttctttgtgaacttcagttcattgacattttctaggataaaaccttcatacttatccagaattgatcttttaaacacaaatcctgaaatatttgaaaaaaaaatatgcacagtagtaagcagcagcaggtggggttgggggacggcggagaaattgaagggcttgtgccttgaaactttccaggatatttgcctatcaactcacagtttgtaagaatctgttgtacttaaaaatttatcacttctagcctttactactatgaacagtttttcacttatagcgagcatagagggtagtcttcgactattaactcacctttgcagtttatttagagaacagaagcaattgtagtatcaaggaagcattaaattcaaaagctattttaattttttttaagtacagagttttggggcaatatgaatctaacaattttattgcctagcctgatctgtgtcacttcacctgtatttttcttgctcttgctcatagctgctgttgcaggaccctgattcttatcaaaagtctcaacattagatgtttctagaggtctcaggaaatagcttacacattctctgaattaattttgccagcttccatgtggcaactgtgggttcttgttttgatcctctcccctggggacaactgtgtgtgggaagaggggaggagtttcccacggggcacagctggtggtgtattgaagccttctaggtgccaagggtgtggggtgttctctggcaaagtatgggaacatgtattttttccctgctttcctttttaaatgtacttgattagaggagtaccaaagcagtgctcttcacacagttctcctctccacagtactcagacatctgaccacgttggggatgaatagtctgggcctggaatcacatccaaaaaacaactacagtgcactcagaatcaccctaactctttccaaattgcaggttttctcactggactaatcttgtctgcttgctgcttgacttctctccctttacaaaatgtctttcctgggagcccccttagtccactacacaaacagacttcaggctgattccgaggactctgtatatcagtgtcaagctgtgccttgaacccctgccttttttccatattctctgttggtatgcttttgatgagtaggtgaagtggaggtaaatgagtaccattacatctctctctcctctgtattatcttccttcctcttttatttaggaatttatgggaatgaaaaaatactcctatccaaccttatactacatctttgtctacaacgtttagtatgtacatatataaaaaatcagatatgtttaggcattgactacaaggaccacttgcaacatgagatcctacaggtaggtgactcataagagcaatatgtactattgtagtagtctgcatctgccgcacatttgagagtgagttttattctaattcgcaagtacaacttactaaacagtggcagttacataagcttaaaactcataagatgatattcagagtcagaatacatccaaggccactaaatgtgttaaatatttcatacagctgaatagagaaaagatatgtcacctcccactgtggcgccttcattctgaaaataacaggttacctatagctaggagaaaaataaaataacaaaagtttcacattccaagctaaaattatattttaggcttgattcattccacaatacttattttcccagttacagcttaaaattgaggtggagatttttaaatatgcagaattgattttaaataattttgattatcttaatctttctaatttagtttcactgtggtgaaaattattcaagttaccaaactgagtctttgtttttcttaataacatacatacttcacacaaaaaaaaatcaatagaaacagtttttaaaaacaattgagtaatttccatgcatcaaaaatatttgaaaaaaatggaaataataccttggtatttacttaccttcttattctataaaagaaaataatactaatggagcaaaatagtggattctcttgatttcatttcagtattcatatatgtggttatatccatatttatattttagtcaaagggtgcgatattttaaaacttgggtctcattaattagatgataggtgccattgcaggcccagagtttaatggaaaggcaaaattgagtgggaggagggaagagacaaatggggagaacaaaagggtacttatagtaggggtatagtacagttgttttccatgagacttatgttctgtgtaccctaccctagttatcttttcattgtggaaaaataggtaacataaaactaaccattttaccctttttacgtgtataataaagaagcattcattacatttatgttgttgtacaaccattaccactatttccagaactttgtcatcatcccaaacagaaactctaaacctattaagcaataactccccatacccttctacccccagcttccggtaacctcaattctactttttgtctctaaaaatttgcctgttgttgatacttcatatcagtggaatcatacaatatttgttcttttgtatctattttgttttactaagtgaaatatttacacatattgttatctatgttatgacatgtcaaaacttcattcctttatgactagtagctgggattacaggcatgtgccaccacgcccggctaatttttgtatttttagtagagatggggtttctccatgttggtcaggctggtctcgaactcctgacctcaggtgatccacctgcctcggcctcccaaagtgctgggattacaggcatgaaccactgcacccggccactggcctcttcttaagagggaactaatcatattcgtgagggctccactcttatgacctaattgcccctcaaaggcgctgcctttaaggataatcacgttgaggattagatttcagcataaggattttggagggacacaaacattcaattcataagaatcatcaaatttgagcatgcatcagacttcatcacttttgcttgattctccattaaaaataggattgtattgtgtacttaaatatagacattgtagataatgggagatgttgtacaagccaggtgtaatttataagattgaagattattccaggttttgaaaaattatgaatggtagagttgatactttcttttttagtattattgtacctaagcaaattctacatagtatttttctgtttttagtttagattgactaattattgtgactggaaataaagcttaaaaattattctaaacacggtgaaaccccgtctctactaaaaatacaaaaaattagcccggcatggtggcgggcgcctgttatcccagctactcgtgaggctgaggcaggagaatggcatgaacgtgggaggcggagcttgcagtgagccgagatcgcgccactgcactccagccagggcgacagagcgagactcgtctccaaaaaaaaaagaaaattattctatatgtttaagtcccagaattttactcggttttggaatacgatttattcttatgtgatcttttattcaatatgtatatactatattgtacaaaaaccaaacaagtttatacgttttattcacaatttattgtagttcatttttaggtcaaattttggaggggcggggaagggcggatactctggtaccataacagaaccacagtcagaaatgtactgtcctagttaatcactttcataattgttaatgcatgtttaaaaattctaatactaaaacactaaacttttatacttttatttctttttagaaccttgtgaaacatcttcctgagcagaagatactcaacgaattagcagagcttaagaatgaatatgatgacctctgtgagcctgaacaatttggagttgtggtatgtatccaacatgagggaccacaaactcagctgggaggttaacacttgccagaaacagtgaaaagacaaacatttcagttgtcaattattttttcattactgtattgctacataatttaatataatattggctgtcagaaaaaaatacttttttacctattattatttgtcatggcattgaaaaataataaaatattcgcattcataaaatacttcaaaatatctcaggggatcttttgaataacagtgccaatttttaattctattaatatatgcaaacagtatacattattattatatgggctatttttctttccatttagatcttaatgttagaatttggcctccaaaaagtaggttaaaataaaaggataattactagataattagcaaagtactagagactctttttctagggtatatgtcgtgtcagaaaaagcaaaaggattttcagatttcatatagagtgtcattaattgatttaaagcttaaaatgtgctgttttagctgggaagaaaatcttatacatcatgtctttaaatcatcatgtagttaaattattattggaatgaattattttttcttattccacccttcatattaaggggtacaaaggatgaataagtataaattttgaattcaagattatagttatattttaagtattccccaaactgactattcaaatagttgacaaaaaacaaaaacaaaaaaatggcaggaaagagggcattatgatttatttaatttcttggagaaaaagctattttttacttaggtggtcagtgcaagtttgtttgctgtatgaataaatagttccattatggtcaccaactttaccctggctccctgaacattttccatttgcatactaaaattttaaaattaccattgaacctaatagtcaaacattttcagccttatccaaaatattctataagcttttaaatagtataatatgttagaactgatccaatttgataccttgcagtttaaaaatcctgtttaaagtcaaactgtgctagatgggactgagcatgttccttttgaacatgtgcaataaatgctcacccatatttagagtttattaattttgagacatggcattgactgcacttatatagaaggattctgtcaaattcttgcaaagaaaatcaggaatgtatgtttgggatcagatagagcatataatggtatctgagaaaggtatttctcttatttttgaacaaggtgaattaatcaactaaattcgatagatatcatttgttaactaaaagcaatttagcacaacattgagtaatacagttatttagatcaaagtccacacttgaagcctaagctgcttggattcatattataattgaagcaagggtatataccctctgagaattcagctgtgtcatgatggttatgagttttacagtaggtatactacacaatttctctgaagccatttttttttttctgaatgcagtttatcttggaagatgtattagtttgccaagcaagtcctttcaagaggcatatccttggtaccacactgaggaaatgaagtttggggacgtaaaaagcaatataccttctgaactaaaagcaaaatagaaaatggaagagatttcttgtttatgcacataaccataaataattctgaggctgtgcatacatgaagtaacctagtccccgtatttactttcaccattcttagctacatgtctgggggtggggggcggaaagtcaaggacattacaaactagtttacactatgtaaattacctaagatagtatcaatcaggatttgcccaataaagtttagctgcattcacatcaaggaaatattttttaaacaatgatatactttagtttgttaaacgtgtactttgcagtgtttagaacaatatcatgtattaaatagacagtaaataaatgtttatggaattgaattacaggacaattattaagcctaagtccgagcctgaaattagaaagtagtatgatttaaatctgtaacaatagaaattttgctaaaacatatttctctaggtgtatgctgaaattcaattcacttctgtgtgtatacatccaaacactttttaacccttaaacatatatcaacagcctaatgtgaggacagttttggaaattgtttaatagaatcatctgcagtaatgagagaggctccaaactggaaaggctcattgcctctgctcacttctcttgttaacattattagtgtatttatcacatgatttctatatggaaaacctccggtgtctccctgaatttacagaatgaagctccttcgcattctcactgtatctctgactgtcttgctttcttcctttctgctccctttggtgaagtgagtcaattggtatctttttgacattttagcctttatttcaatcagactctcactgccgttttaacagctatttcactcgctccctattctgcgtcctttcatttttccatagtggccataccatacctttccttctctcctcaagtcttctgtctcctccccattcttttaacttaccacgaacatcctaacctgttacttgccagagaaaaaagaaagcagtttgacttcaaaacctccaatatttcttctacctacaaagttttctctagctatataccttttacttattctctgtcaagcctcagaaaaagaggagctccattatcattaacattattgttgttgctattagtatggatagaaacaaaataaatattgaggacttaatttgtcagattctatgagaagcatgtttacttccaccaacttatgtattcctcatgacaaaccctacgagtttggcactattaatggctccatattaaggatgaggatgccgggcgcgttggctcatgcctgtaatcccagcactttgggaagccgaggcgggaggatcacctgaggtcaggagttccagaccagcctggccaacatggtgaaactccatctctactaaaaatacaaaaattagctgggcatggtggcgcacgcctgtagtcccagctacacaggaggctgaggcaggagaatcgcttgaacctgggaggtggaggctgcagtgagctgacatcaggccactgcactccagcctgggccacagagcaagactccgcctcaaaaaaaaagaaggatgaggaaactgggcccaaggaagactagtttacttgtccaaggttacatagtaactagtagtcacagaattcaaatgttagcagtctgaatttgtagccagtgctttaaccactgtgctcctgggttgtgggtatgtgggtgtgtatgtgatgctctaccacatgctaatcttctcacttcagttttgggcattgttatgcactgcctactttaggtggtagtatctcttgcctgctttccttctgttagttattttattacttcctcaatttgtcagtttccactctgccctgctcttcagaaaaaaagaaaatcttcagtcatttgctgcctggaaaggagtggatagatgggtggatggatgaataaaaatccttcctgactgaggtttctgcttgctactgccttctctccatttcctagcatcagtttttttcaaagatcagtctcctttttctctctgcttccttaactctcattcactgttcaaccaatggtgatcagaattctgccttaaataatgcattgaaattgaaataagaaaggcccttaaatcctgttcacatccaaaatacacatcaaatatactcacttctctgtctccatcaccaccaccttagcccaagccagaatcatcgtttcaattaaccattacaatatacatttatcttgtttttcccgctaccacttttgcccttctccaaatccgtctcggcacaacccttagtaggatgtttctagagtgtatctgtattgcatcataatttttatctgcttaaaataccagtgctgttctatagcactaaagctacagcattaacttcttaccatgacctagaagatactatctggtctggcacctgcccacctctcctactttcatcacctgctatttggcctcttgctcattatgcctcagccacattttatttttgaacttaccatgttctttcctgcttaggaccattgcacatgctgctcctttactcctgcttgctgcctccctctcttgtttatacttcaagtcatagcttaatttttgctttcccagtggtaccttcatttgcctttcagtcagaaatagatcttcctactaaactctcccagattaccttttttcttttcctttctagaaatcatcctggattttaattaaatgtttatatatgaggttacttcttgactgtctataatcccaactatattgcaagttctataaatggatgaactatgttgattttattcacgtgtgcttaacaaatatttcttgaatgcatttgcatgaatggaaaatcaagtggactctttcagtcccatcttattctgtatctatatggcatttgataacataaaagaatttaagctcctttttgaaacctttcctctccttcttaaataataaatagtatttcctgattttttttttttaagagctgcctcttaaagctcttaaagaaagttctctctgtgtcccccagggtggagtgcagtggcgagatcatacctcactgcagcctcgaactcctaggctctagtgatcctcccacctcaacctcctgagtagcaagttccaccatgcccggctaatttttttaaaaatttttctgtacacatggagtcccactgttttgcccaggttggtgttgaactcctggcctctagcaatcctcctgcttcagcctcccaaaatactgggattataggtgtgtgccaccatacctggccttatttcctgattttaatactctaaccctgtgtagtgccctatagagtttccttgattatataacttcttagatgataaaaacaaaatctcatcagttaggggtgtaaatatgccagaaattagattactcttgcagtattcattaaaataatgataatgaataattaacaaattggctggtcatggtggctcacgtctgaatcccagcactttgggaggccaatgcaggcagatcgcttgagcccaggaattcgagacctgcctggccaacatggcaaaaccccgtctctacaaaaaatacaaaaattagccaagcatggtgctgtgcttgtccagctacttgggaggctgaggtgggagaatagcttgagctcgggaggcagaggttacagtgagccgagattgcaccactgcactccagcctgggcaacagaaccagaacctgtctcaggaacaaaaccaacaacaaaaaaacacaataaaattgacaaaactgggggaaattgtgaaagaaagaaacttatctaaggcagtgactgggacactaagctttctctaaccttttgggtttttttagcagccacatcattaggtttgcttataatcatgtgcaaccagttggaaaaaagagaaaaaaaaagaaatagaaaaacccagagacttttcctctgtctagagacagatcctggtaagggggacatgctcgctcccacatattgtatgatcaataatcttgtttagggggtagattggctgcatagcttcccactgacttgtcctccaacctacctcccacagaattgaatttggtacatcattgtaattatgtgctgtacctttactagggaaaaaagcacagatttttgaaagctctggcagttagaaccctcagcaggagcttttagactcttctgagtgtctttgcagctcagctgttctcaaacctcagagcaatggaagttcccacttgtcttgcacaggggatggagacccatactgtgtgtatctattaaactaacacatcttctgaggaaaagaaggcaataattaattctcttagtaatcgtactttgtttttctgacttcaaaattatccatatttttcaattaaaaacatcctaaagctataatctaacaaaaaatgttgaaattggcttgggcgtagaaatcttcataataggaagcacagatgatgtgatattgcggacagcacatttaaattttttttacacaaatatatgaagttgggaggagaggatttatgcatatagttggaagtacaactataaatttactgtgctttttaatttttttaaagcctcataagagcttatgagctataaagatagcttaaccaggtgaaaagaaaattcttaaaagctttttttttccttccacatatcatcaaaggcaattagtttggatagaaaattgtaagtcctctgttccattaatatcaaatcatttttcacttttgcatattcagtgtgaaaattgcatttttctttattttatatgcctgcatttggagtattaagtgttttgatttgtaatgccctgattgtttctattttcattacttttgtaaatattagtgctagttcttacttctagatatatattcattttatctgaggaaaaagctggtttaataattttgagatcaggtaaaagaaaactcaccatgactcattctcaaatacatgtatttatattcttatccctcttactaacttcttataatcatttttttgtgacagaatttcttatttccatcagcttttgcaataaaacaaggtaaaataaaaccacctgaaaattgaatattcaaattaggtcagtaggtgtcaattaattttgctattgattggttttcattaaattttttaaaaatcaaaagttaaccctttcatttttcccctccacatatcactaattcctaacaccaccatagaaatttttatggctgtgtccaggcatggtggctcatgcctgtaatcccaacactttgagaggctgaggcgggtggatcacgagatcaggagttcgagaccagccttaccaacatggtgaagccccgtctctactaaaaatacaaaaattagccaggcatggtggcgggtgcctgtaattccagttactcaggaggctgaggcaggagaatcgtttgaacgtgagaggcggagggtgcagtgagccaagattgtgccactgcactccaacctggatgacagagcaagactccatctcaaaaaaaaagaaatgttgatggctgttcttggcctcaaacatgttttcagaaaggtgttttaaaattcttgcctaactttttagtgtgattcttctgagtttatagtgccttttgggacacacaatgttattgtattctgttctagactaaagacaagtgaatggttgttgatgggtagtttccacatatttttatctttggggaaatattctctaccagtacatcattatttttcttttttctttttctttttcttttttttctgagatggagtcttgctctgtctcggcctcccaaagtgctgggattacaggcgtgagccactgcacccagcctacatcattatttttctgatgtagaatcagttttcaacactcaattttttcaaggcttcaattcacagattaagtatggcccttttctctcatgacatctaatgtacgaacatttggcattgactccatatagttggtacacttgtattgattattttttccaggcctggtactggatttgctacagaaagtattagaatgagtataagtaggagaggttctgccctggaggaggttgttgtctcaaagaagataacagtctttactttataaggtgtcataaatgcccctgccttatttccacaactccaggcagaaatctggtcagtattgactcaatctcatttctgtaggcagttctgccttctattaaacttaagtccattctcctttaatgtggtttcatgatcattctttttgttatagtcacagatacaaaaggattctgtatattcaatgggcaatggatcaaaagagtaactatttggaaaaaataccttgtagcaaatatatatttgttacaaatttttctgttaattctaatgaattcttaacattatattttgaagagacggggggatcagtttttctcccatatgttaggccttaatggaatatgtcttagaagtgaaaaggaaagatgatagaaataaccctaaaggccacacctgaccataggagtgccatgtggccatctccttttccgtcacatatgatttttacatttgtgctcttttcctttctcggtggattcgtaggttagttgggtagtagatcaatattcatgagctgcgtaggtactgaagtgtgtaaaattcaaattatataaacaaaactgtgtctaactctttggggaaataacccacttgtagttgctctcactaaagctgtcaatgcacttcttttatttttttttaatatagtgaagatcagctaaagaaatgagagccacttgatgtgatttgatagacaagtacatcgtaacacaaataaatcccctacataatacaataccctggtcagcatcccacagcacttcaaggaatgaattataaaacaaaggatgccagtcaactaaaatgctgcaagggaccacaactaaatacaaacacaaatttcagcagagtttttattttatttacttatatcacttaggtgcactcaagtgcctttatgagacatgagccttttaataattgtatctgtggctggggatgttgctcagtgcttcctactatttctaagcttagttatctaggacatttccttccatatccaaatcctctgatggagttgcaactgtttctatcagtgtacactggtctgatcgtaaaaattcacacttatggttgcaaaaattctgtggttatgatcaatatgtactggtttgtggcttttgttaagagatgcacatgtatagcttgcctcctacatcatctcttgattttgtaataatacaattttaataatgacatttctaatagtagatgtatattatgaattaaaaatagctaaataaagcatgatatttacagtggataatgagagctgttcttcactgagccctggaaatatatttcttaattttgaatgagagaaattttacgttgggtttgggggaaaagataaggaccccggtttcttcatactgacaatttctgaagatgaataaagaatgtaataacaacaagaactattgttttagggtgtttacatcatgtcagttactatgacaggagtgatacacatagtatcacatttaagttctaatgcatcgtgtatagatgatttaatgaatacattttcatgatgaggaagtaacttagaaactccaggtaacttgcagtaggtcatacaactagaaagtgaggcccagtgaggtcacttacatctgaaatcccagcactttggaaggcccaggtgggcagatcgcttgagccccaggagttcaagaccagcctgggcaacatggcacaaccccatctctgcaaaaaaatacaaaacttagccaggcatggtgacatgtgcctgtagtcctggctactcgggaggctgaggtgggaagatcgcctgagccccgggaagtcaaggttgcagtgagctgtgatcaccctacagcactccagcttgggcaacagagtgagaccctgtctctaaaaagtaaagtgacagaagtgtggctcaaacctatgtctgtgtaactacagtgtcgctgtttctcctactgcagcttacagtatgggtctggagaatgcagataattgtttccccctctttcctgggtttagagaaaaaaattctcctaaatcctattctttaagaaaaagctgtatggggctctgaatttgggctaagattgggccttggcggtattgttggggtgacctacctggaagctaatgaatgaccttacatgtacttcctctttccccacatcagcctgctgttatacctcttgaaactatatgtcctcttcttgacccagcattttactgaatattatgtttcctatttatatgaatgaagccattcattcattttacgatggtttattttcaaaatcacttttcatctttatcatctgccatgtatcaaaccttgttgtaggagatgaatcaatgaagaatttttgccagatcaaagggcaactttgaaccccttacagtatacaacttcttctgaaaagcaggctgactcatgatagattaatatctagtaatactggttcaacaaagttaattccctaacatttctggtttgacattataactgaagacattattttgtagaagtaaaatattactgtcagctattaattttgttgaatagacaattgtcctacttgggaaaagatctggaaaatagtcagctaaggagtgctttaaaaatcaatcagcacatattgatatactcaagactctgtgctaggtgctccacaagatgcagcttttgactcctttctccttttttttctctatgcagtctctgtatcaatgaccttacctcccatagcatctattcagataactcccaaatctgccaactccaatacttctaacccctagaactatagtttcaaatcctagcagatatcataataataacaaaaactcaacatgtcaataaagcaattttattatttccctatcatggaggtatcattttattattttttagaggatttgagagggatcaaggagaacatttagtctatgttagtaatccaagcttgaagtacataaaattatgagtttctatatggtgagcatggaaaataagggacgactctcagaaattctgcaggttaaaatattggtaaggattggtattattataaataacattgtgtttactgtgacttgaatatcacttcaagatttggggtcttgaatgggaaaataagagcatcattgttagaagtaagatgccctatttgccgggtgcagtggctcatgcctgtaatcccagcactttgggaggctgaggcgggtggatcacaaggtcaggagatcgagaccatcttggctaacacagtgaaaccccgtctctactaaaaatataaaaaattagccgggcatggtggcggctgcctgtagtcccagctactcgggaggctgaggcaggaaaatggcgtgaagccaggagacagaggttgcagtgagccaggattgtgccactgcactgtagcctgggcgacagaacgagactccgtctcaaaaaaaacaaaaaaaaaaaaaaagatgccctatttgatgtctgagaagatggtcagctgaatttacttaaatgctaatacaaatttttcgtagcagccaagcaatacttttcctttatggaactagtgctttttactctaccttcccacagctgtagaggcagagcctaaaaaagaagaaagtaaacgtatggatcatttattttgactcccttcttttcatcaaaacaagaccgctttacaggaatttctcccactttacgatggggaaactaagaccagaaaattaggcagactgttttcacacagtcagctcacatgacagtttctaaattcagtctcatttgacttagttgctgctaagctacacctacctgcccctgctgccttagtccctgattggcttactggaatttaagtagcagcaggtcagggaaagcaaatccatctactctcattctctgaaacaagcaaacaaccaggtgacaaactgtaccaaattagcacatccttctaccttcattattgccggcagacttcaaactttggagccatctttgactttctcctgctataactggtcggttactaagtcccatttattcttccttaattctatcttttatatccattgttttctttatcttcctactgtcaacatgctacctcattacctgtttcttacaccattttgctaacttcctgatggtctccctgccattaatctctccttcaaccaatcatacttactgctcctaataagactcaagaggcagtgtggggtagcggttgagagtctggggtctgtagcccaaaggcctgcattcaaatcttcaggtttccaacataaaatttgattttgtgcaagttacttactatttgtttcacttttctcatctttggaatgaaaataacgataaccgtttcctaggattgttttgagaatcaaatcagttaatatataaagcaaatgttgaaaaatgtctggcacaaagtacttaataagtgttaattgctgttagcattgttaccatcattatcaaagcatactttggttatgtaatttcaattggagctgatatttttataaaaatatcaaatccatgttctctgagtttgtaggccaaacattgtaggttaatacaaaacatggaaaggataagaatatgattgcaggcacatgatattgggaccaaagaagactaaaagcccacatatgcctaagggttttgttccttgtccatctgggaccaagggcaccctggtgaacatggcccctataagctctgcaaagtatggccaggagagcaagtgcatggtcactagtagctgctcaaagtagctctatagcttttttagtcatcagggagactaaaaaactactccctaaacgtaaaatgatagaaaacctgcttcagtgctagtgatggccagttaccagtaaaaggaaaggaaaaataaagtggggagggatttggagacagaggtagaggcagaaatgaaggcagaaaaatatatagagaaactcagagtgattcccacacaaacatacacaaagagacctgcaaattcacggagacatagactttgatgcgattagcttccacttctgcggcctttacctggactctttagatacattgtttccaattctacccctaggtatgtatgtcatatatacctagcctataaaccttttctcacaccattctctctctctttacttttctcacaccattctctctctttactccctccttccttccttctttccctttctttcttttttttttttttttttttttttttttttttttttttttttgagacagggtctcactctgtcgcccaggctggagtgcagtggcacaatctcggctcactgcaacctccgcctaccaggctcaagcgattctcctgcctcagcctcctgggtagctgggattacaggcactgtgccaccaccaccatgctaatttttgtatttttagtagagacagggtttcgccacgttggccaggctggtctcaaactcctgacctcaagtgatcctcctgcctctgcctcccaaagtgctaggtttacaggcctcagccaccgcgcccggccactttttccttttagtgtcagttctatgtgtgcttaaatttacacatgcatgcacacacctatacatatattttttcatgtgtatttcctctactgtgaagccttcattaatcactgtaatcataagagtttaaagttttttcttcttccagtgaacacctccagaacttaatttctttttacctatctaaaatcatgtgctggctttttcaccagcaatagttttcaaggttctatgttgagtttcagactatattgtaagctttttgtgaataggtggcgtgttttatagttgccatgtgagtactgaagaaatagcagtacaatttgtataataataccctgaccagataaaaaaaagtgagtcataagtgatgagacctacaaaaatacagtaacaggtagatatttcatcatacttttgtatatctgcctgtgaaaagcatgaaagcatataggaggattagtagaaggcagaggttcatatttggagaggcagatgttcatggttaatgggcaaattcgaagaagaaaaataatgggctatgtcttgattctgtattagagtagatatggtctgcccaacagctcatctgctgcttttgaaaggtactttgtggtttaaaaacttttgtttatgtcgtcaaattctcttcatgttatctgcagatatgttggtgtctaatctgtacttggcatttgtatttaaggaagtaggctatatatacaaaaccaaatataattaggaatgttaataatttattttcactgtgtgcatgtgtctgtgtgcgttcatgtgtgtctacctctcccccacctccctcccagaattcattttgtgaaggaaaactagttgagtaacttggagctataggaaattaaaaactaaaacaattattatcatagtaactataccaagtggaatatttaatgtgcaccagtgctatgaaacaagtaattaaaaccaaagttgaactgtattgaagaaaaccaatgtagaattcttgcataatgtacttgaaagtaagttcatgtgattttactatcatctaattacttaacagcagcatctgtcaagtaggtgaaattctttagaaattctttagagtatatataaatagtatattttatgaatagaaatcataagtttaaaaattattaaatgctcaatcagagctagtcttctgatttcaaacagcatagtaataggtaatttcttaggaaatgttccagttatattttctgtcatcatgtacatcttttatctgcggcccaactattcactcaactcaatttcatgtttataaattttcctagttcacctcagggacagattttggcagtttgaatgctattgatggctaatgattatgcaattaacatatagcaactgttcagcttctataatattttattaatgccataaggatgatttatttttttaaaaacctgtatagccaactgctttttaaactttgataaactatttctttggaatgtttaaaacaaaaaagatttttaaaatcccagagcaaactgactttatgcagaaatgttacagtgttgtctatgaaattatccccactaaagagataaaataagaggcattaaatgtatattctcatagggtatttcttatcttacagatgagctctgtgaaaatgttacagcctcgtctcagtagtatcctgttcaagctcacatttgaagaacacataaacaacatcaaaccaagcatcatagcagtaactcttgcctgtgaagaactgaagaaaagtgaaagctttaacagacttttagagttagttcttcttgttggaaactacatgaactcaggctcaagaaatgcccagtctttgggatttaagatcaacttcctttgtaaggtaagatgacattttataatgctaatttacaacaataatcttcttgtctatgaaaggtgatactgcaaatagcaatcgtacataaaccacaaaattgtatgcttaaaaagggtgaattttctgggatgcgaattatatctcaattcaaacaaataattttttaaaattttagtaaaatctaaaagacttgaatattcttttggaatacagtacttaacatttgctgattacattttactgaagtttatagacaaaaaaatcccacttttataaactagatgcagtattggccaggcgcggtggctcacacctgtaatcccagcactttgagaggctgaggcgggtggataacctgaggtcaggagttcgagaacagcctggccagcatggtgaaaccccgtctctactaaaattacaaaaattagtggggcgcggtgacgggtacctgtaatcccagctactctggaggctgaggcaggagagtcgcttgaacacgggaggcgggggttggagtgagccgagatcatgccactgtactccagcctaagcaacagagcaagactctgtctcaaaaaataaaatataaaataaaatagatgcagtattatatttcctttacattattacttatatcgttctaaaaagtatctgacaagctaaatttaatgagataaatagccagaaatttatttttgaatatagtttgcttattctactctaagataataatactcttcaatgtcaagtagtgttgtacactggtatctggtgcattaactaagaggtaaaaaagaaaattgaataacaatcatcttgttttgattggatcatttaataatatttttgagacttatgaaaagcaaacaaagaaacagagaagcccaaaagtgcttgtatatgtccatttttaggctagagcaaaccaccttattcaaagaaaagatctgtctgttatagaagcctgaaaacactctgaggtgaaggcctgtaagaaagctagagacgaaaataaatctgaaaacaagcaatctgtctttgacaactcaccattctttcactcttttttttctctcacatctgaaaatattgcagaactttggttagttcttgaagtatattataatgagaatcccaaatctagcaatggatatgaatttcttttctatacatgcattaaattgatgttcattacatatacatggactagcactttgatatgtatcaaaaatgatttgatcttggtagttctaacccaaatagacataaagaataacacttatagataataataggatgtacaatagaattgtgaacatctgtttactcctgatatatttttgagggctgtaaggaaagagaacaaggaaaatacagaagattatctggaaatgctggattttgtgaagaaaacatttttacccccatcttcttgtgatatttggggacatgtaaaatcatttcataatgccagagggaataaggcagtgcttgtaataaactgtactaaatcatgccagatttataggatgaaataaagtatttaggacttcagcattgtattgcataccatatccccaatgttaatagagtcatctctaccatggtgctacttgcctagagtatatgctatatgcacactgagtgaatctaaaagtgttcttgcttgacaattataaagagattataagttaaaatatcatcagaaatttgtattagatacctattttgcatttaattcatataaaaatatttaaaaccattctaatttgaagaaatatgtaccttataagtgtcttaatttcacactattcaaattaattacatgaactgatttctttgaagcaagaatgaataagtcatttatacataggaacaaaaggttacgttaatctcaccgaaggattttacagttacatcttatattttggagagaggcttctttctgtcatctacctgtcaaataaaagttcttctacacaacgctgatctgacatctatcactagaggtatgctcaaaggattcagcacaaagatttttgccaacttcaaataaaataaaaaataatcttgcgggaaatactatcatgtagcaataggtgttccaaaagtgaaagaagtgaaggttttaaaatctgtcccccaactcaccccccacttttcagtaagatttttatcttctgggaaattttctaggaaaacagttgtcatttagaaagagaaatatcatacacatgcatgatattcccataatgtataggattcgaaggatgttcctggaatacaaaggattgtgagtaaatgtaaatgtctaaaatgacagaaattttctgaagcacgtagaaatagttagcttagttctgtattatgtttgaaatagaattaactagctactgatgtatgattagctagaattgctgtttaatttcagttgtattatgaaagattacttcgttgatttttcttagtgattgccttcttaaagaaaatagcagggggaatttccctcatagaacactgattatggttttaaaatgataccatttactctcctaaatttttctaatgataatttcttttctcagtgattttaaaactaatccagtgcttttaacaagaagctatagagtatgttaaaatattcacctaggtaaaaaggaggcatgtggttaaacttatcagatgtatcttgtagtaaggtaatataaaaatttcagatggtcacagttggctgttatggtatttgggaagaaaaggaaaacagatggattaaccaaaatgtcaacactaaagggtatcattattgtaattactaccttcaccacaaaatgctttgttaatttgcagcagtgaattatcactttgtgagtcaccaaaccagtgtgctgaactgtaataaaaatcatttcaatgaagatgagctcccaatgttagcttagcctgttggttattaaaattctaaccaatagaaatgctacacttcaaggccatttgtttgttgttttttttttcagtacgaaatagcatatataatctgcataaggacaaaacattttaaaatacttagcattccctatatactaagctttgtgggtttatcaaataaggatctttgtttgtaagtatcagaacgtgactctgcctgattcaagcaaaaagtgaaacttgctggaaggatatgaagtaactaagccagaaactgaggaaagactaaagaacttgccctttaaaagaacagcaactgtgacagctttgagaattcaggtagcaggaatgaatgaaaagtctttttaggatgttgcctttgggatatatcagctccaaccattttccttctcctttccctatgtttgattcaaattcaaattatgaagagagcctaatgagcccggtgtggattataagaacaccccttgttcaagggagagcaaaaaaccctgattgacagtgctaccaaaactacctgccatggaagattggttatgccctaaagggtgctgttaccaaagatagggctaccaaaggttaggagcaggtaaagggatatcaggcagctctaaacaaatacaaaataaaacagatgatctattcatcagaggcctaccaacaatagagaagatacacagaaacctcaagaagcttgtggtacagttgagcagccaggaaatatacatacacaatattatgtaatgtcacaaggtacactgtcaatgagggcaaaaataaatggccactgagattagcagtagttcaggggaggaaggaatctttggtgattgggcagtgctggtaaattgaaaaagaagaatcttgaaggataggtaggattaagaatctataactttacaaaaggggagaacattgtggcttggaacctacgttttaacttacacttttgtcaattactagccaaattttcctgactaagtcacttaccttctctaaatctcaatttgagattgaatatttcttgaatatttctcccttcacttcttgtatctttttttggatttccttgcattgggcttcacctttctctggtgcctccctgattagcgtaataaccaacatcctgaattctttttcaggtaaatcagggattttttttcttggtttggatctcttgctggtgagctagtgtgatttttgggggggtgttaaggaaccttgtttggtcctattaccagagttggttttctggttccttctcatttgggtaggctctgtcagagggaaaatctagggctgaaggctgttgttcagattcttttgtcccatggggtattctcttgatgtagtactctcctccttttcctatggatgtggcttcctgagagccgagctgcaggagctgcagtgattgttgtctctcttctggggtctaggcacctggctctgggctggtactgggggttatctgcacaaaggcctgtgatgtgaaccatctatgggcctctcagctgtagataccagcacctgttctggtggaggtggcaggggggtgaaatggactctgtaagggttcttagctttggtggtttaatgttctatttttgtgctggttggcctcctgccgggaggtggtgatttccatagagcatcagctgtggtagtatggagaggaaccggcggtgggcagggccctagaactcccaagagtatgtcccctttgtcttcagctaccagcatgggtagggaagggccatcaggtggggcaggtctaggcatgtctgacctcagactctccttgggtgggtcttgttgcggctgctgagcgtgagattcccagctcaatggagttgtgtacctaccgtggattatggttgcctctgctgagtcatgcaggttgtcaggaaagtgggggaaagccggcagtcacaggcctcacccagctcccacgcaatccaaagggctggccccactcccaccatgcccccactaacagcaacgagtctgtttccaggcagtgggcaaacagggctgagaacttgccccaggctacccacctccgagctgtgaaagaaaagggctttagttcttcccctgcctgtagagtctacacagcggattcacgccctccactgagttctggccaggaggcttcttgaccacttcaagttgttacaaagatcagctggagactttcttctccttgtggcttttccccttgtgcctctggctgccctccggaaggatccctatggtgccaggcaggaatagcctgcttggggacccagcgaactcccagggcctttcctgctgcttcctctacccctgtattttgcttggctctctaaattgactcagctccaggtaaggttggaaacttctccctcaaactagaccttcggtttccccagtaggggtgtgtgttcggtggtggaggatctccctttcccacttcgcaatttgggcactcacagtatttgggtcctgcagcagcagtccccttccttcagagggtctgtgggtcctctcgggattcctggtttatccctgcagtcgttttggagctaaaattcacaacgcaagcctccgcacgcttctctgtccatccgagttggagctgcaatctagtcctgcttcccgtctgccatgatcctcccacaaattcataaactttcttaaaacattatgagagttttttgtgggtttttttttttttttttttttttagctcatcagctatcattagtgatagtatatactatatatagcccaagacaattctccttcttctaatgtggcccagggaagccaaaagattggacacccatgatctagaatatctataacatgtaaagcctcatctagaggccattacatggtattagtgacaaagtatcataccaactatacaaaggaaacatccatctccatccatttcccccatagaagttgttagaaggaaagtaaaataggttcagctttattgtgaaatagaaaattactgcagaaaatatgctttgtaaagaaaagtgactgctgtctatggtagtaaaatttggaaatctgtaatccacacacacaaaagaatctacaaaagaccttagaaaaaagtcatatgtaagtacacgcaaagttttgcagtgtctaatcatttctagctaaaataatgtggactatgtccatataaactcagaatgtcagcatatgaatacatccagtctaacctcttcagtccacaagtgagaaaactgatgcttgtagaagcaaaatactttagtcagtgtattgttcagcttggactgacataacagaaaccaaaggctgagtggcttaaagaggagaaatttattttttcacagttataggactgaaagcctaagatcaagatgccagcagggttggtttctggtgaggtctctctccttgggttaccatatggccaccttttcaccgtgtctttacttgacatttaatttactgttttcttcccctttgtccttcacaagactcagaactcgtcaaatttggatgtatattttattctgcattatatctccagtgtctattatatgtgaagctctcaatatattactacagattgaaagtcagacaatttgattaaatagaggatttgttattaatactcagcatgtgttaacttgttttttaagttagaacattttgttcctcacagatacaaagggcatatttttgccagcaaaactgttgaatatgtaactgtaagattttttatgctttatttgtaaagacgcaaaaatgtgttgtttgctgtaaatctaaatcagcaactcattattaaatatgggttattaaataaattaacatgagactattaatttaaaaccaaagatattttagaaaataatcactataggatgtactgaaagggaacctagcaacgatcaataaatcctggtcaacagtccatgcatttgtttgcctgtgtttttatagtttataaagtgttttccttgtgattcagggaggttaagtattattgaccccattttgcaaattagaaaactaaagcccagtgaggttatataatttgtccaagattcaaaaactagtaaaggtacaagttggggcttacatacaggttttctgtttacaaaattgtgtagcaccctgcctcttattgcattgtaacaatgtttggttatacttggctcatttcaaggaagcattatagaaccaactctggcacttacagtattctgaaaatggggaaaacctcatgtgaattttcttggctctctggcatgaaacttggaatccatcttttttattttaattcagcttggtgtaactgtaggcctatcaataggaagtttctcatcttgtaatagattttaatgtatccaagcagcagagcctatatatttgtaataaaatagcatctaataatttgaataattgtggagctatcccttggtgttgtatagactgtcagagtattttagttttgtgtaggcaaggttgactgctgttttcaatattttacaaatgaggatctgctctccagagagatgatctttacccaagatcacttagtgatgaaggcagagttaggatccagcttttcctgggactcaaacaaatgatttcagtggatcatgctattttcagaattttcattgactcttttgcttcactgaaatatactttttcctatcagacaatatttagcattaattgaatttgagggagatgtggttgataatttgctgagaagaaaatgactttgtgggttataatttgtcttgaaaaaaattatgtgaaagggaagattagactctcgatcatttatggagggggatgaaatgttaagccctatttccaaacttttatttttctccttgggggtcctttaaactttcctttctgtggagctatttgtgggaaagagttttcatttggtgatctctcctagtcactggttgctaatcagtgatgcaagattctatgctacaccaaatgcaaaggaacatattcatggtatttgcatttaaaaatgtcatcatataatatagtgacatgctgtaccatttgttcataattcattaccagtggatacaaacatttcaatttaagggtctgtctgtgcctcattatattacgttgaagcaagaatattcgctatagtttagacctctgaaataactaagcaccatggaatgacacaagaacaggatatcattcttaattttaaatagtttcctttgttcagcttatgtgatggttgacctttatttaagtccattgtgtttcattgtactgtgcttactgagctctcatcattgagaaccactgaatagtttcttgagcttaaagatgaatgttacactgttgtgatactatgtcagtggtgacattctggattcagtttttatagttgtgtcatgggtttttgtttcctacactttttcatgtaaatcaatacaccaaaatatgtaatttttcaaaggcaaccattaatactacttaagttagtaaatctagaagtatttaaatgtatagaacactaaattttttaaaggaaagaattctccataaggtcttttaattgctgtatgttattcattgtgtattctaatgcacatgccgttgatctgtgcatatggacttgtgcacgtaggcaaatggtaatagtagaagattgcttcagtcatctgatttctccactaaatcaagatacttggataccagctcagaaatccaatccaaagtcctcacctctaatgcccttcattgccatttaaaatctgaaccaaacacaggccacttcttttgagtttatcttctttaaaatgcagccctctaagagttggaaacagactatcatggctccttgattttgtaatcctatgaatacgctactgtgtgctttgaagattgtccttcaattagcaagtcagtgctttatcccacttctaagatgtcagctacctggtctccttgtgtgtctatatagtatagtggtgcacatacagattgactacttaagtagaaagaaaacttgatgaaggtaatatgtgtctctgtcttatgaggtgccatcttctaaaatgatagcctcaatttttccaaatggtcatacatcttctagatttatattaatgtggagatgcatgatatctttcttgttctctgtagcctacattaagaaattgaaatgagacaaaacactaactttgtggtaagctaattacagcagagggaaaaatatatgatcatgtcaggcataggaattaacaaagtttatagatgtattttaaaaattgctatagttctaaaagcttatgtgtctcaaaatatctttttgaaaacttgagctctgagtgaaagaaactaactcacacctttattctcctccttgcctcttaaaatatagaggtcccgtgagcttatttaaagatctttttctctaagttgaaatattcattaatttacattcattgctgcaaattagctagtactttaagtgtaacacttgtttgttttctcagaatttgattacatctgtttagacaaaatcatcacatttacaatactataggttgtgtgaaaacttgattatactccaaaattttcagtttgttaaattctctagagaacaatagtttgtaaatgtaatttgtctgatgcagacttgattagtattccttgtcaatactgactgctttggagactcatgggatttttttctattattcttatgtatgttaaaattttctgttgcctattacacacacacacacctccctttacctgtgattattaatatcgtgaagcctatgctgctatctctgattttaacttatatgttacagttatgtctgcctcctagatatctagataacttgctgtgaggtgtatatatgtatatacatgggacatacttgccttgagtactagtaatgcctcgttattatacacccctctgcaaacacatgacctttttgttatggaagagttttcaacttttgaaagttttgtattaggggaaggaccaaggaaaataaaataagagccagatgaagccaaaaagggtgtgtgtgcatatgggtgttgagtaagagagacagggagatagacagagacagagagattgagacacagaatgagagaaagataatgaaagagtgagaagggttggggtgattttcacaattggataatcagagagaaacaggattgagttaaatgttcctttgtatacatcaattgactcataaagagcattgaaaaatgcaaactggccgggcgcggtggctcacgcctgtaatcccagcactttgggaggccgaggcgggtggatcacgaggtcaggagttcaagaccagcctggccaagatggtgaaatcccgtctttactaaaaatacaaaaattagccgggcgtggtggcgggcacctgtaatcccagctacttggcaggctgaggcagagaattgcttgaacccgggaggcagaggttgcagtgagccaagatcatgccactgcactccagcctgggtgacagagagtgactccgtctcaaaaaaaaaaaaaaaaaaaaaaaaaaaagaatgcaaactaagaattaccaaattatattccttatcttctaccaataataagcattaaaaagtcaaccatatatatttgtgtatagaactgtaatgaagggtataatttgttttctgtagagaactcacctgtggcttagtttttgactcattaaatacagatacattttcaggaaataagaaaattaatgcatctgtattttctttcattttaaaaaaattatccttatagagtaatacaaaaaaagtaatcaaattaatgctgtgtcacagctatacttgttgaagtcgttgtgactaaacaataatagatacagttaatggttgaatagtataactggcagagatgaatactcctctagttaacaaaaatacattttttttgttcttgatgaataccccatatatcaggagcagcaataagcattttcagcgctagagcagacaaaaaatgatgatttatggaactagctgtaggtcttacttagttcgccatgaagactgttttcatagaggatttaaatgaacccagctggcttcgtattctgtgaattgctatagtcgttttctgagtataatcttatgactgattttgtaattctcacagtaggggaaagttgacaacatgaatggcatttagtgaatataattagtaagtctgaaaacaaaggcttttttattctataaaagctctgttcgaaggagattttgaccctgtatgagactgttccaaaaacatagctaccatgactaagtttgaccagtcatcttacaagctgattttcctgttaaatgaagccttcctagtgaaggcattgcacaaccttaacaaggagagctcatgtccatggaaggaagtttataaagtagcagttgatactaaaataaagctctgtgataattttagagaatctaaggattatttatatacatttaacgactttttagtgagtacttgtgcagcaagttggccacatttattgagcctttaccctctgtggaaccttgtgctagatgctttgtggggataaagagaagtaaaacatacatctccagtccttgaggagcttatgagctagatgccagatatagaacattgtaatgctaaagcaagagacagggagaagtgtgtgtggggacaggcaaatggattttatataatagcacacatgaaaaataaattatgttgctcataaacactggctaactaaccacaagacaagaaagcgcatactctgttagatgatatctatactgtaaagctgctccacttctttggaaaggaaggaaaaaacaattccagccccatttccaagatgtacttttcttctcttccccaaacaatgtcttcagttttgcttttcctgccttccgtcatggggacaagcacaaagccttgccattcattattttcttatcttttagtcttttttgaattttaaatctgaattatcagaatgctctcttcccttttatgctacaataaaagtatctttaaaactgcttctcaagttcctaacatctttctacatatagttaaatattagtattttaaattttttggataaaatcaatacctgttcaaaaacaatagtataatggtactacttataactattgtatgtctgtacccctcccaattcactaattagtcacaaaagtcaaataatttccttttgccagaggatatcatgagattgtctagataaataagaatgaagaaacttgttatttaatgttcagtatgagggatcactccaggatgcaagtaacctactatgaggaaatataagcttttcagaggctatttagggaaaggatctcaatatttcagatttaagcaactagctagatacacatattaaaacagaatcctctacttagaaacctgtgctgagggaagtggaaaagtattgtaagttatattcaaagacttggggacagatgaacatgcttgattccaaggatatttcatcaatcacagcctggcccattcagatcactttatgcttccaaatttcagctttcaaaaagtgtacgagaaaggctagggttactcgttgatttcttaaagcatcttcttaggactttgtttgttgtattgttattttgttagaagtaaaatgtattcatggccaagagagacttgaacctaacctataatttcttgtagtaactttactgaggtttttaactgacatactataaaatttactcattttaggccaggtgcggtggctcacgccaataatcccagaactttgggaggctaagtcaggcagatcacttgagctcaggagttcgagactggcctaggcaacatggcgaaaccccatctctaccaaaaatagaaaagattagctgagtggggtggtgcgtgcttgtggtcccagctacttgggaggctgaggtgggaggattgcttgagcttgggaggtggaggttgcagtgagccaagatcgcgccactacactccgcctcagagacagagtgagactgttacaagaaaggggtcctgatccagaccccaagagagggttcttggatctcgcacaagaaagaattcagggtgagtctgcagtgcaaagtgaaagaaagtttattaagaaagtaaaagaataaaaaatggctactccatagacagaacagccctgagggctgctggttgcccatttttatggttatttcccgatgatatgctgaacaaggggtggattattcatgcatcccctttttagaccgtataggataacttcctgacattgccatgacatttgtaaattgtcatggcgctggtgggagtgtagcagtgaggacaaccaaaagtcactctcatcgccattttggttttggtgggttttggccggctcctttactgcaacctgctttatcagcaaggtccttatgacctgtattttgtgctcacctcctatctcacctgtgatttcgaatgccttaaccatctgggaatgcaacccagtaggtttcagcctaattttacccagctcctatttaagatggagttgctctggttcacatgcctctgacaagaccccatcttaacaaaaaatttactcactttaggcatacagttagatgaactttgttgtttgtatacagctttggaacctccactgcaatcaaccagtgtggtttcctcatgcccctgtgcagtggatccccactcctagctcgagacaactgctgatttgttttaaatcaccatggtttcgccttcttctagaatttcatatgaatggaatcatacagtaatagagcctttgtgttactttgtgttgttagtgacttttttcacttagtgtaaagttgtggcatgtattggtagttcatttttattttgaggtagtattccattgtatggctgtgccacattttgttcatctgttcatcagctgatggacagttgggttgtttctaaattttctattatacttgttgctatcatcatttatgtataagacataaattcatttatcttgggtaaatacctaggagtgggaatcctgggtcatatggaaagtatagttttaattttaagagagactgtttttcaaagtgtctataccatcttttcttttcttttcttttcttttcttttcttttcttttcttttcttttcttttcttttctttcttttcttttcttttctttcttttcttttctttcctctttcttgtcttgctctgtcacccaggctagagtgtagtggtgcaatctgagctcactgcatcctctgcctcctgggttcaagcaattatcctgcctcagcctcccgagtagctgagactacaggtgcacaccaccgtgcccagctaatttttgtatttttagtagagatgaggtttcaccatatagggcagggtggtctcgaactcctgaccgcgtgatccacccacctcggcctcccagagtgctgggattacaggcatgagccgctgtgcctggccatctaccatttttcattcatacttatgattaaattaaaccacaatgatggatttcatatttggaatatatgaatatatatgaaaagatatctcatattcatgagactggcaaaaaatgttaaattctgttaatataaagtagaggtaagaataaggggcaaagagaactaatggtgagagtataacttgctaaattcattttggaaaacaatttggtactatcaagaaatgttaaaccatgcacagaaatgccccttctagtgtatacactagataaactcttaggtaaggaccctggagacatatacaagaatgatcacataatcaaataacactatcaacagagtgaaaaaaaggcaacccacagaatgggagaatgtattcgtaaataatatatttgataagtgattgatatccgtaatatataaagaactcccacaactcaaccacaacaaaacaactcagttcaaaaatgggtaaacaaattgaataaatatttctccagagaagataaacagatggccaataaacacaggaaaagatacttaacaccactaatcattaggaaattgcaaatcaaaaccacaatgaaataccacttcaaacatactataatggctactatcaagaaaacagaaagcaacaagtgttggcaaggatgtggagaaatttgaacccttatgcattgctggtgggaatgtaaaatggtgcagccaatgtaggaaatagcatggcagttactacaaaaattaaatggaattaccatatgatccagcaattccacttctgggcatatacataaaagaatcggaagcagggactacagatgattgcataccaaattcatagcagcattattcatagtagccaaaacatggaaacaacccaaatgtccattgagtgatgaatggataaacaaagtgtggcatatatacaatggaatactgttcagcctttaaaaggaatgaaactctggtatatgttatattataatatgaatgaatctccgtgatgttatgctacatgaaataagccatatgaagaaggacaaatactatatattccacttatatgaggtacctagaatagtcaaatttgtagagacaaaaagtctttgtttaccaagggttgggggataaggcagatggggagttaatgtttaatgggtaacagtttcagtataggatgattaaaacgtcctggagatggatagtggtgatggttgcacaacagtgtgaatgcacttaacctcactgaactgtgtgcttaaacatggttaaaggcaagcatggtagcccacacctataatcccagggctttaggagactgaggcaggattgcttgaagccaggagtttgatagcagcccagataatatagcctgtaatctcagcactttgagaggccgaggtgggcgaatcacttgagcccaggattttgagaccagcctgagcaacatggcaaaaccccatctctacagaaaaatacaaaaattagcacggtatggtcgtgggtgcctgtagtcacagctactcgggaggctgaggtacaaggattacctgagcctgggaggttgaggctgcagtgagctgtgatcatgccactgcactccagcctaggttacagtaaaatcctctctcaaaaaaataaataaataaataaaaaagtgttcacagcagcattatctgtaattatatccaaaacagtgattccctcacaaaaaaaaatggaaaccagatattgaaaatgttcgatgagataatatgcctaaaatttataatatttatatggtcaactaatatacagcatggatgaatatagctagaaacatcaacatggttaaatacctcactcttaaacagctgctcttcagtgctgaattctaattacgcttttgtaatattctgtgtcttagaccttcaaagtttttcataaatagctaaaatcactaatgttaagtgccatttaatgccatttattaaaggttaaaacctttaaatgcgatttattatttatctacagtgtatagacagagcgaatgagtcctatggactcttttggtgctagtgacaatctgaagctatgtacataaaaaaaaatattccatctactctcaaacctcatacatataaaacaatttaagtaaaatgctcatgacaataaaagttaaaagttttagttacgtgcttaacccatgtctgagaagaaaccatctaacaccaacaaacattcatacttgtaaactatttctataccaatttaaataatttgatttttattaaaactattctcagaagaatttttatttggtaagccaactatagacaggatgattaaaagcatatgaaagtaccagaacagcttttctttgcatagatatatttcattaattcattctggcctttcctaaaaccagtgagtacaaatgatggttaatttgccactggtcctggcaatgcaggctaatgcacatgcaggtcattctccttggataagtggggctagaagggaaaatgctgagaaggggagcaggaaggacaggaaacagaatttgtcttgtctaagaaacttagcagcacaaatgccctgctggtccggaaggtggcaattgagatgaatccttattccatttaatgttgttacggtttcaagtttcagctctcctttcacagattgctaccataaattaggctaacaagtgtgaaacttttaatttgcttgactatacaattgatattatctgtttccttttggttggaaatatcattataataccaaactaaagggtgtaaaaaagggactatcaggcctacataaaggatgaagacctctttccaccgtaaattacatttggctgaattagtgtcagccctagtcatgtagtgcccagaaaagcatttttggtgacagatttagaaataaagctgggaaaacatgtattaaacctgtccggtcatagctacagaactaatgtctttatggtaattgcaatctttaaaaatacattatctttttcaatgttactgcagtgtgtggtggtattaaagaaagcaataatttgtaaacaacccttggcagagggcacagaacttaattttgtttaaataaaggagactaacattagaattcttgtgctgtatcaagactgacaagcagtagtagctgttttgatatgtgcactggagcattcatgattgcttaaatattaactgttccatgaatatacaaatataatagggaaaaaggaagccatgattaatgaaaattttcactaaaagaaataaagttgaattatatgactgtactggtggtttagatggttttattccattgactcaaccagatctcttcactgagtttcagtatttcttttcaaggacaattatatatgtgtattgtgtgatgttgctatgtgttaggaatgtttccttgacacagaaggattaggcaatttttttttttcctgagtacagcacctgttgataagtttgctgaagttcatgtggccattcatgtaaatccaaaaggaaaggggggagatccaaaagggcttccttcagatactctagagatttgaacttttatctcacatttaagttttaatatgctttaaagatagtcttccgttaatgtgtgcagaaacatttcctttagtgatatccacgctgctttactacttcatttcttatactctttatgcaaaaatcagtttttgtctcagagcagtttacactctacagcaattcatgcaagaaaaccaggtgctcctcccacacattcttgcatgtttccagaagagaactaactgttttgttttttcttttttcttttttttttctttgagacggagtttcgctcttgttgcccaggctggagtgcagtggcaggatcttggctcactgcaacctccacctcccgggttcaagtgattctcctgcctcggcctcccaagttgccaggattacaggcatgtgccaccacgcctagctaattttgtatttttagcggagatggggtttcaccaagttggtcaggctggtctcaaactcctgacctcaagtgatccacccaacttggcctcccaaactgctgagattataggcgtgagccactacgtccggccaagagaactgttttctgtgccactctgcaactgaggtcaggattgctttgggacagggagccaaggtccgctgctttgttcctatataatgtatggtaacatatgaacctagccccattctcactcttggtcttcaacccgaaatgagtatgatgacaaatgaaatgcagtatcagcatatgccagggccatggagcaggaatgaagcttccttccttgattgtcttctttacatacacccaccatagtctgatttcatacatgtaaactgtttggcatagaggtcaagcaaggcattaggttatttagatacaagaacttttatggcaagcactgaaacccgatgtctgcaacttacaatttcagaatctgattcaaactttctgagtaaatatctaagcaacaatgcagatttgcttgagcaggagttggaaggcatgaataatctgctaggttatctagtccatcactctgatgatacgtagtagacaagacatactatagcagcatttaagtattttttcaatacagttttaggtgaaggatgaaggacagtttagaacactgaagagcaatgtatctggaatcttcacagcatggagcatactgtttgtctcatctacttttggataggtagctgataggttatgataccaatcagtcttatttttatgtgaattaatcaagaacacttagagcaattctgtccttcagatgccacaaattgctagataatttctctcttattttaaattgacactaagcattgaaaacacgttgacacttcaactttttatatgtaaaagcagttgtgagaggacctaggcaagctgtagacaattgccaagcatcttctcccctggaaatttatttgaaagtagcctagtgtctccctagtggcatgcatcagaatcacctagaggtgatatcagaagttttcccctagtatattcaaactcaaattgctggaccaaaccctcagagtttctgatttagttgatttggggttgggcccccaaatttgcatttctaacaagttcccaggtgatactgatattgctggtccagggaccagggattgagaaccaataaagtagcaaatgctcatgaattcttgatttttcattcttatttcttccgttgcctgatcccttcaagcctaattatgctgaacttattcgggacaataattagaataatttttgtcactaacctcaccattttccagctgccagctctgctacctcctgtattatctggttattatccacagtcaatatttggaataaattattcgttcacattacctcttttttctgactacccattccttttaattttgaatcctttgcactgtattcaaacagtgcttgaaggtcaccaaagattaacatcaagtcagccctaattatttttggcctgtctaaagaatttattcattcaacatttactgaataaaattgatatagtcctcatttttaagcagttcacaatctggtgggtgagactagttgtgtacacaaaattatatattgtggaataagtgctataactagagtatatagaaaccactataggagaacaaagacagaatttagtagttttgctttgttttgttttgttttgttttgagacagagtcttgctctgtcacccaggctggagtgcagtggcgcaatctcggctcactgcaacctccacctcctgggttcaagcaattctcctgccccagcctcctgagtagctgggattacaggcatgtgccaccatgcccggctaatttttgttttgttttgtttttttgtagagatgggatatcaccatgttggccaggctggtctcaaactcctgacctcaggtgatccgccccaactccttgacctcccaaagtgctgggattagaggcgtgaaccaccacacttggcctagaatttattaattctattcagggaagttgagaaaggcttattactagtaactacgactctcctccctttccacacgcataccatcttcatcacccatgacagttcaatccagtaagtatatcttaaattccaagtgtgcataaattgccgtgctttgttctggcaccaacacctattgagtgtgggaactagatcaaacaacttatgagctctatcttatctataaaagtggcatattcgtaactaactcactgaattgattttaggatttaaaaaaaagcacttatgaaagtgcctgagttataggcacatgatagataggcaacaaatgttggttctcctaccccttaaaagaggaataggatattatcacctgatgaaggaagaacagtatgccgaggtcaggaggaacataagtaaatgggtagaaatcttcacccatttgtgcagtcaggaggaacataagtaaatgggtagaaatcttcacccatttgtgcagtcaacaaatacagatagagtgcctattgtatgctacccacttttctagatgctgagtatataaaagtgaacaaagaagacaagaaaactctgtacttgtgtccagcatagctgaagtgagtgtgggaacttgagagaggataatagctagagataagatcacaacagagtaggagccagagggatttttagtttatagtgatgggaagctaaggtaggctctcaacacttcttatctggatgatgatggtacccatgataacatgctatcttattcaattctgcaaacatgtctgtgaacataggtgcttatctaatgctcattttatagataacaaacctgagacatggagtattcatgtaacttgcccaaggtcatacaagtagtaaatggtagggtcaaggttcggacctggttctgtctgaatccaaaatctatgcttaataattattctgattagaaatttgaattttattacatgagttgtaaagaaccatttactttttttaaggaagggagtgacatgatcatatatatgtttaagaaccataattaggctaaatcatataggataaaatgaagcaaagagaatggaatggttatgaccatcttttcatagtgtattttcacatagctaacacttctgtttaaaatttgagctgccatccttttcctaatgccagttcactctagagttatttcccttattctggacatgatacaacattcttttaatcatcgggacttaaagcttttggagtctttgatttttccctttccctcatcttaatattcactgactaaatcctgtttttccttacaatctctcttgaatttgccctttttttgtcttttctacacataccctagttatcattttaagtatatcagtctttgacatttgccaccaaattattctcctatgtcgtttcttttctatatcattttgtattttctactaaattctaagcttaaggccttaaaagtaccatgcatcatttatctcttatccctggtgttcagcatagtcctcaactcacggtggattaaagaatgtacttctccattcatatttgctttgctcctaacctgcctcccctaaaaaaatgtacagtgctccatttcctgagtgacaaattataactttattctggcattcacttgcacctaactctagcaaatgtgtgttctggaaaagtttggcctttgtagtcaacctctgtgtgtgtggtggggtcatatataaacgcagttatacatatatatatatatatatatatatatatatatgtatagaattaaatttaggagtattgctctatagcccagaaaagttggagtttagagaagaatctgcattcggaaacatttattgactatctagtattttctaacatcctcctaggcaccatggattcaaaaatattaccaaagcaaagtctctagccatgtaagagctcatattgagtgtgagagactactatgttgaaatgtttacagtgaatgaagatggccaaaaaaagttattaattgcttctaagatagagaagtcttcagaaatgacatgggagttgagtagtctgaaatgtgagtaggtattttcttggcggataaaaaggaacaaaaaggaagggcgtccacacagagagagctgttggtgcaaaagcacagtggcatgaaactgcatggtatgtttaagcagttgtaatcaggcagacagcagcaggaggcaggttagaaaggtagacaagggtcagctcaagggagtgtcttgtatgcaaaatcaagaacttttcttttccagcagatgacaggagcctttgcaatggatcttttgaatggactctaattaccattgagaaattaaacatttgaagaataacatctatgcggttaggttaaattaactgcagttgtttatttggagaacaggacgggaatgagaagggaactttcactctgtgagaggttgttacgtacagcatagtgaccagttattttcagttcccactgaggacaaagcaagaagaaataggcttacatctcatcagaagggaaaattacctacagaaggggtccttcacagaaagattgaatgtgactgacgtaggtcattaaaatgttgtctgaggctctctggctgtgtgctggtttctgtgtactcaaacagcccaatttcaaagacatggcaagactgaaggttttgaagcttgaatgaggatatttggaataaagaaatttcttatgtgtcaattagttattgagaaattttgctatatacctaactaaattttggagatgtacttgaacatataaaatatatgtagtatctttcataatataacgtttgtgtgtactaggaaaaagaaatgacaaaatcagctgtagaaacacgtgtcctattaaaggtattttgtattcatgtaccattttagaaagttattaaagattaggtagatagaattcaattaaattcagttattaatctttatgtgtaacatttattggtcagatgattaaattaaaattgctgtatatggtttattaactgatgattgcacctgatcagttaatacagtgactcactcttgtcttattttcattatcatccagtgataactgcgcttattaaaataatataaaacttattttagctttttcaaatatttcccatttctagaactgctgtttgtgttattgtttgaagatatgtaaaagaagattgtagagtgaccattttgttcatccttttgcatcttataaaaataagtcatatatgtctctccctacctgtcatggctggagagaggaaaaacacatacagggatgcaaaaaggcactttgcttctggctagagcaaaccttgaaatgcatacaatataaccaccactaagacttaggcaatctaggcaactattaattggatatttcatgttaatgtaaaattttaatatgatttcatattaaacagctatcaaatggaaatcaattctatttcttaataaactaactcaaacattttggaaatgacttgtacataatcagattagattactcttgttctaccccaagagatgtgtatatccaactagtacacttagaaaagcaaattattggataaatgtctttaaccagtagaactgatgttcttagttgctttctgtgctgacattgaacaacacgatagggcctgagagagatacaatggctaatgtgtgaatggcatagacttggtaagagagactgaaggcatgatataaagtaattaagcttcaataagtaaaaaatattttccattatattttaatattatatatatatatattttaaataattggtctaaggcctctcacacatagagaaaggtttaaaagaccacccatttgtcgtgatttcctgccagtttgaaccattaaaatggtctctgtgtgtttttttttttaaaaaaaaacaacaaatattgcaatacattaagcagcttgtctcccagaccaactaagatacttctcaacttgacaagacaaacatttggccatgtttgcccatgctttgaagggaatattatgattctaaaagaaatacatgcatagtctgtctaaaagtcttttatcatttcatcaaagatactaatacatttaactgatgttgtgctttatttatctttttaaaatgtaaccattaactcttctaaattttgtaacaaattaaattgttagtggaccagatactgaataaatatttattaataaatacaatttttgaaaattaagcacttataagtatgcatgccaaaaactgaaatgttttttaatacaaaacaatctaacacatgtgacaaagaaaaaaaatcacccataaaattgacatatgagcacagtgctatttttctgtttttatatttcctttccagtgttagccatgtgcgttttattgtaaactataatgtacttgtacaatttgatgtcctaaaaaactaggtgggtttttgttgttttgaattgtgttcttttttaaaaaaaaaaattgtttttgtctccatttatgttatgactccaaagagtccataaaatacataggaatttcctttcctttgggaagatgtacctgcaattttttctaagcacttaatgtttccagaattttaggatttaggtagttagtgaacttctaaggaaaaagaaaatgttaatttcctttttatttggaatatccggcatactcttaaaaacgatgcactttgtaaacacatcacacagtaatcccaggtaaagacctctctttaggaatgtgagcttcccattgattcctctacagctgctatccttacttaaggaaaattgcccttgaggtttgtgttgctttttgttctttcagcttgtccttgagttgtgtcatttctaccttaaagtacttaaaagtgtttagtggatcagcatgataatgtaaaattttaaatatttttcctatgtgggataaagtaatccccgaaattttgaaagaaatcattgtgacctcttgaactatcaacattatgcctcctgtggctgtttggttgtttggaaccttgagactaatatttcttctaagttgtttacatcacattgagatgcaaatggttgttaaaaacctgtagaacaaaacagatccagtgtgggcctgatttattaaatgctatgtttttctttcttagtcactcaaacaataaggattaatttactctgttacctaaatatcctgtacagccttttcataaacctgtttgtgaaaaatactcatttattctaaacagagtaatccttaaagctaaaaattccaaatcagtatgaacatcagtggacaaacccatcatctaaggattatagaattataacatccaatagaatgagaaaacttgatactttatgctgtatttatgctttgtttctaagtaaatccttgattttatttgcagcttagtctagtatgagaattatattgcagcactagattttctttttttgtgtgtcctatgctttaaagatttttaccattctaactgtggcatctcttttgttgtgtgtctgaaaaggaaatacaatatgtaagcaaataaaatttttcatattatcaggattgtatggtgagattttttttaataactcagtataagcacaaccttgagaattattttctgatggtccatgcaagtagaggaggataaaatgtgcttgctcctttacattaatttacatcaacaatggctagaaataaatataatctcacaaatgaatctaacttttaagaacatatttttgtaataaagcaaagaacagaatgatgataaaataagcacacagtaacttgggctattatcaatacttaaatggatgttcttctctcatgaaaagaatagttcattttgccacaataatttagacatttttgaaaatacagattaaggtttaatttggcacttttactggtcatcttacttgcttttaaaatatggagctccttttaaaatctagagcaccgctactagaccacattaagaacctaccccaaagttttaaaaacattttaaatgggttataataaattcattcatttcacttgtttaaaaaagtatttactaaaaaattactaaaaaatgtgttgttgttttctcccagatcagagatactaaatcagcggatcaaaaaacaacccttttgcattttattgccgacatttgtgaggaaaaatatcgagatatcctaaaatttcctgaagaactggaacacgtagaaagtgcaagcaaaggtaattgatttataactactttgagattatctcttgcctatatggtttaaatggaacaattaaagaatctgtaaacattattcataaaagtattttttgtttgtttactgataaaagaaaagcaggaaaatagtttccattagcttatatttgacagcatactacattttaataacctattttgtcttacatcattttttttaccactgctacgttattaaagctttcatttctctgatcagataatatgtttgtactttcatttgataaacatttaagtggatattgtttgcaaaggaaccatactatagggctcttggttatatgacaatgattgtgagagtttttgattgagtgtggttaaaatatagtaaatgagaaaaatgtgtgtatatatacatacacacaaatgtgttataaaataaggatgcatgtgagaaatgctgcaggaaaagataatgtcctatagttgagatgaggaggaaagtactcttgaatgggtgggtaagagaaggcttcatggaagaggtcaaaggtgaaatatgaggttagggttttacagacatggaaaagaggtttgctttccagagagaaaacaacatgagcaaggcaaagtggcagaatgttttaggacaagtgaagggaatggttgactctgaggctggagcagtaaggtaggtatctctgagacttcagtgtcaggctaaggagtctagtcttgatgtggtaagcagtacagcatcattgaagggatagaatagacaagccatggctcctgtgaggaacaggatgtttgaaacaaaaatgtctctgagattttaattcagggtaattagctttgtcagtaagtattatctacttttgcaagaggttgaaaagtgaaagaaaagaagattaaggaaacatttgctgaaggtgagattatgtgcgagaagaagtgcattttccctcttagataagagaagtacaccataaatcttatacttgaaattacgctgaagtaatttcattctgtaactctgaggacttttggtaaggacttcatatatgtttctcaagtttattacaaaccatataaacctgttagtttccttttaagttaaaaatagtgaatctataaaacccagaatattctttgaataacattgtgcagtggtcatctcagccagttgggtattgtcaatcaaatcctcaacatatttctttaattttaccgagtttgtatcgttttgtggtccaaggagcaaactaacacaaaaagacaaactatgattgtattgtattatttattttctttcgttgttttcaaaaaattgtgaaatatgatggaaaattacacaaattacaactataatggcaactttctggtaatagctcttctaaagaatttatcttcggatttaaaaatacagctttctgactagaagcatatttactaacatgtggctaatgtgaaataataacattttaaacatttgtgttgtaatttgaaatgtatatatatatatagcacaaaaaagaccagttattaaattagctcattttgttgctattaatactttttgattgccttctaccagaatttttttctaagttttctttgttcaacatgtataatcaatttttacaacattttggaaagaagtatgtcaataatatatctatatatacacacacagtgccacacatgaaaatatatatatttatatgtaatatatttactatacataaataaatatgtaccacacacttatatcaatcaacaggtatttatataaacctcaatcaacagttatatatatgttatatataaccataggtatttacatgtgatccagcagttccactactaggtatttatccaaagaaaaagaaatcagcatatcaaagggatacctgtaccccatgtttattgcaacactgttcacaataggtaagatatgaaatcagcctagatgtctatcaatggattaatggataaagaaaatgtggtgtatatacacaatggaatactattcatctgtaaaaaagaaataaatcctctcatttgaagtaacatggatggaactggaggtaattaagtgaaataagccaggcacagatagacagatattgcatgtttttactcatatgcaggagctaagaaggttggtctcatagagatagagcgtagattgatgcttaccacaggctgggaaaggtgaagggtagggggatgaagagtggttggttaatgtgtacgaacatacagttaggtggaagaaataagttctggcctggtgcaatggctcacacctgtaatttcagctagttgggaggctgaggtgggaggaacacttgaggccaggagtttgagaccagcctgggcagcatagtgagaccacccccatcagaaaattttaaaaattagccagtttcatgctacttgcaggggctgaggcaagagcattcctcgagcccaggaggctacagtgagctatgatcacaccactgcactctagcctgggcgacagagcaagaccctgtctcttaaaaaaaattaaagaaagaaataatacgtcctaatgtttgatagcagaatagattgactgtgggtaggaatgatatattgcatatttcaaaatagctagaagagaagatttgaaatattcccaacacaaagaaatgataaatgttcaaggtggtagataccctaaacaccccaatttagtcattacacattctatgcatgtagcaatatatcatatgtaccccataagtatacaaatattatgtatcaataaaaaacttaagaatatatagatatttatatatgtgtatatagtgtgtatatatatatatattttatatagttatgtagtgagacattcaataatcttgtacactttagccactactgctactgacaaaagtagattgtagagcccagccttttgggttagacactataaatttctttctttctttctttcttttttgagacgaagtcttgctctttcgcccaggctggagtgcagtggcacaatcttagctcactgcaacatctgcctcccgcgctcaagcaattctcctacctcagcctcccaagtagctgggattacaggcgcacgccaccatgcccagctaatttttgtacttttttagtacagacggggtttcaccatgttggccaggctgttctcaaactcctgaccttgtgatccacccgccttggcctcccaaagtgctgggattacaggcgtgagccaccgcaccaggcctgacactataactttctaatcctagctctactacctattagttctataatttgagctaataatttaaacttctaagattttgtttactcatctgtaaaatgagaataataacagtgagattaaattagttaacataggcattgcatccagtaaaatggtatagtttatagtatatgcttgacacatagtaagtatgcggctgttgctgaactactaccagtagtagtagtagtagtagtagtagtagtagtagtagtagtagtagtggtagtagtagtagtattgatataccactaaggatattatagttctttcttttgtcttattagaagggaacaatcataaaatatcttatagttcctccagtctcagtaagtatgtattatattcaattctatttgtttgtttcctattcctgggcttttggtaaatccttttatatatttttttctttattttatttttcctttttaattttttgtatatcaccaacttcctttttccaatccatttcaagagcgaaatctctctgctctattttgatcattcctgattttgtgcattcttcctgccagtgtattcaaaagactgttgccaaaaatcctcttcttatatcactgtttgggccatagcaatccctactctcaaattattttgactagttatttttctttccctatgaaattcagactgagaattctcaactcaaaaagatcttacgcacattctgcctgcttgcatccctctttcatttcctcctagttctcatttcagtatacccagacatatagtctcctgagccatttttattcctttataataatcctgtctctgtgtacgatttcatgctgcatcctctggctggaaatttcacctgccctgtactctaagacaactgactgtcatttgccaaatctctgttcagaatctatttcctttttcttcttccttttttttttttttttttttttttttactaaagccttaggagaaaatactttttgtattagtctgcaggaagaaacaaagcattgtaaaaggtcaagccaattacctcttatttatatttaaatatttttccttggtatttgagtctaacttgtcttgtttacttaatgtacatttcagccctgtttgaatcacactttatcacattcaggactgtgtataacatagcaaaaaacaaaaataggtcaacactatataattcattttatttgatgatggactatctctttgtaaaatgatcccgttctcttcaaaaacaaaaacaaaagattgtctttttttttttaaactggagtgatatagataagaaaaaactaattcagttaatgaattatatagctaatattgaaagaacaacttgattactaccaatatcttttttcatatttttgtgttattagaacgcacatacctactttgatagagtaagatcttttctgtgtggtatagcaaataccaaatttattttagttcagtactaaaattccaggcatcaacattactggcaaaggggaaaaaaatcaccttgaagtgaaaggcaaacaaaaagaaagaagtatgtgggttccatggaaaaaatcatcataattacatttattccttgtaaagctaagctgctaaaattgtgtgcttcttggaaaatgcaaaactatggtataaacttggcatatttttctagacctctgtagctcaaagatagtggggaaaaacacatcatttttacattaaaacagatatgtattatggagtagaattcaaaatccacattaattttaaaaataaaacagatgacttcaaagaaatttcccacttgtagcagatccctacaggattattttcagtcttctcttccattaggggtactttggtgggaaaagtttatgaagcattgcctgaagaattagagagcagttttgttttgggttaagtttacgtatttatttatttagtttgttattcagttagttagtgactattgcagggaaaagggaggaaagtaggcaaggtgagggaagagagagtatatcacttccttttaaacattgtcataggccgtatgaagttcagaagcaaattgtataatgtaactttattaccagtaaagttaataaaataacattgctcttgtcattttattcttggttaaattataaatctgtgggtcatttcattcaagattggcataccaattagtctttagagaaagaaaatggttgttacagagactttgatgcctttaaaacattgaatttttttttcttttggtgaaccacaattatttttttccccaatgattaattttaaagtttatatatatgtatgtatatgtacatatgtaaacttatatctaatagatatatattgtataaaacattgctggtttactagacatatttgatgtctttttttccccctgtggctatcactttaattttcagctttaaggattttttactgtttgatttaaaaccactcctgttttataggttgactccaggttttaaaccaaatggttagtaaagtttaattaaagctattttattcaaaagggggaaattatattaatgtatttgaaggtattatttatcctgaggtttgcataaatccaaaatgggtttcacttcagttaaattggtgccatcctacaagataaaagctagttaagtttcttctgaacagtgctaacttttttatgaattaaataaattattataattttaacaatcaactataccttttgatatctgccatgtttccatgtcatgttagttaccgattagctgtttatccactctgactttttcacgggattaataacaatggaagttctgattaaaggcaatgttataggggaaaatctatggattcattccatagtagtatttcttttttatataaaagaaaaaagtaaaataatagcaaagttaaaaagtttggggggaagaagaaagatgaaacaattccagaaactccacagctggttgaagctttagagattatctagtccctgctaaaagggacccaagatgacatttcatccaaacttattttacagttgaagaaactgagatgcagaatgataaaggacttgcccacgatcacatagctgggcagtagagtccatgtacatttggagaccttgtttagagttattacatatatttcatccacatttttacctcctttgtggtcgaaaatatgcaacaaagactcatgctcacatactggaaaacatatagaaagtagatgctgaccaaataaaaaacttactggaagtataaatgctactttctctgtagttgtccataatctttctagctccattttgacagaattaaccattcctttctctgtgtcacagcagccctttagcgttattggtaatagagcacataccacatttgcactttttatttaattatttgcttctatctgtacctcctcttgagtttcttagtaacaaagactgtattctttttgtccttacaatctcggtgctatcatagcacctcagtcggaggggctcaatctatggccataccaacctgaatgcacctgatattggaagctaaacagggtcctgcctggtcagttcttggaagggaggtagaagtgcttaataaatgcttattaaattaattgcatatcattttagtacagcagtcatatttcaaaataagacattgtgggaagttgacaaatagagagtaacagtctgaaaattactgttcactgtaaatttgagaggagaaacaaggtaaattagaataaggaggacaccggtatttaacaatatttcccagtccacactttgcttcttcaagggaaatggtgaaattggaaacaatttgttaataatggagaggacctaaacttatggacgccaccaaaccacaaaggtttatggtgaacagtaaggaccaagtcataggacctaatgggagtgactgtctcaatgtgaaatgtaactaactgctgaaacatctatgtttaatacctgaaaaaaaaaattgcatattgtctgctattagtttcattgaaaaatctttgagttttttagtaatctattaaagaaaaatctgtggaacaaaatcctgtttttagagtgtttaacttttacttatagtgacttataggacctaagatgcaagaaagtattaaactaaggtttcctaacagatttaaactttgagttataatctaactttttagaagcacagaatgataatataccaatgtgacaaaatgttagtagaattgaccttacttaaatcttagcagcctgagtaaaactgagtatacatattactacattattttaataaaaatgttaacttgtttgttcagcttggtttggatttttttcatatataggatttcaggccgggcgcggtggctcacgcctgtaatcccagcactttgggaggccgagatgggcggatcacgaggtcaggagatcgagaccatcctggctaacacggtgaaaccccatctctactaaaaatacaaaaaagtagccaggcgtggtcgcgggcacctgtagtcccagctactcaggaggctgaggcaggagaatggcgtgaacccaggaggtagaggctgcagtaagccgagatcgcgccaccgcactccagcctgggccacaaagcaagactccatctcaaaaaaaaaaaaaaaaaaaaaaaaaaggacttcaagtaacttaaacaatttttgctgaacgaattgtactctatcaatagcaacaccataaatatgttataaaatttaggggaacgttgttaaatgttagggaatcaaatacatatttatctacataaattttccagtctgtaagacttctttcttcctcactctcaccaagtcagtcctaatttttctaaacaaatgactgtctttaaaataagagaaaaaataagaggtctaaaacagtcacagaatttttttttattattatttttatttttggtaagaacacttaacatgagatctaccctcttaaatttttaagtgtgtaatacattattattgactataattacagtgttgtacagcagatctctagagcttattcatcagttaaggaagataagctcaggaaaatgtatttttaatgtgaaatgtcaaaaggacttaggaaagaaagtcatgttttcttcttgctgttcagtaatctagtcattaccaaacaatgttatcaatgcataacatataaacatttcataattcattttcatttctagaggaaactagtgagtaaaaacaatatcttcaggtagcagtgaaaggaagcagagatcatggccgtttggatttgagtgaattctttcaacacaaatcaatgattttatagacatatataggtttttgtcagggttccttagcttttgcatctcaaaatctatttttgctagggaactgtataatagctcatctgtcttaccctccttgtctcagagcccaggcttctgtgccttttccaatctgaaaagcctcctccttgtctctgtccttttgagcctcatgtatctttttaaaggcccactttaaattccaccactctataaaaagcttctccaactattctacctttcaatggcttctcagtttcctccataatactttgaaccttttagctgatcctgtactctcttgcactacagtgtaaaggtttctgtatttatggctgcatactggcatgatgctttctcagttatgtatgatatcattagtctgctttttcaggacaaaatctgtgtcacagtgttacagacaaaatctataacacagtgtcggcataataaattcagctcagtgaatgcttattaaacattaacgtaatccttgttgctttctttattcaaccctacagtgaaattttctgggtgcttggagtaactaaaatatatttgcagatatttaatttcaacttcttacacattaaacaagtagaaaaccatgtcttcaaaaacatattctttaaaagtgattgtttagggcaaaagtagtctatgattttagaattcattataatagttattcttagggtgggttcatgattggaatggaatatgtaggggcttctggggtgttggtcatgttctgtttcttaatcttgatgctagttacatgggtgtgtttagtttctgcagattgattcaggtggccacttatatgcacttttcttaatgtatgttttacttcaaccaagcggtttttaaaagccagtcattcagatttttaatatgtgtaatatgaatagtgaggatggtactacattttaattcagaaggtcctcttgcttttacccatgcttagttatagtgatcacatgcattgtataagtgtaaataggcagctgctgtcagagttaatctgatgttattctaaataattattgttaggaagttgtatgtctcctaaagattttatccaaacacctttttttttttagtctaagagtggataggtgtactttattttaaaaaaagaaagaaaaagagccaccaaccacattatgtaccacgtgaagatcatggtaatctatatcatacttgtcaatattatgctgtcttatatgtcattgaatccttggcacatactgacctaaaatattcaccaataacctgtcgctgctgtcatttttattattttatctttgcttcaatgtcagtaaaaagaatatataggaatattagtcagctttagctcattgtggatttaagcttgttagttaaaaagtgaatattcgtatatcaaatgttctaatttgattgactcctgaagtaaaacacagggacatacttgatacaagaggttgaagtactgatactgagtagtattgtcaaggggggagatgtgagagtaagggaagaaggaagaaagacaaatgaagaaagaactagctttctgctgccacagcagaatcataagaaaagctggatcatgccctgaatggagactcccttgtactactatggaaataggtggaatccaggaatcaacttggttaccattattgtagttttcatcaccaccagtccctctgatatattcatcaataaggatgagcctgcttaagagatgtagggcttagggattggggaggttaccaaacagtatcagagctacctgagcaacaccccacattttccactttttacacgttttgagtgtagcttgaacacaaccaagtcatgggcagtaccattgctgttgtgatttcttgaaattaactggcatcttttgctggaatttggattctacaagttgatgagacaaatttagcaaatataacatttccttgtgccaaagttatatgactcaaactccttaacagtattttcatgtaaaacgatcagaggggaggtggcagttgtagccagttttgcattgccataataaaataccacagattaggtaatttctaaagaaaaaaatttatttcttacagttctggaggctgggaagtccaatatcaaggtgctagtacctagcaagtgccttcttgctctgtcatcccatggcggaagggtggaggggtagaagggtcaatgagcatggatgagagagaaacaagagagagtacaactcgcttttataacaaatctaatcctgtgataacaaatccactcctgtgataaccatattaatccatttttgagggcagagccctcatgacataatcacctcttaaaggccctatttctcaacacctccatggtagggattaattttccaactcatgaactttgggggacacattcaaacaacagcactggcattttaagtttaagattcattgaagtagtgaggagaaaaccctgacttctactggaaactagtagctctgtggcaaaagattctggtatagtcataatctgaaagatgtattcactggaaataatatgtccagggatgagaatcaggacacacacatttgagttccagctttgttaccagctacttttttggacatagtttggccatataacctctcagtgcctatttcctcatttgtacaaaaattttcttaatttgaaaaatagcaatggtaatatctaggctacttatccctcaaggtggttatgcaagtaaaattagatatgcaatatgaaaatgccatatgaaaaaggtgttacatataaaaaattattattcaagctagtatgaggatattaattccagttgattttgattagattttgtttattcagtccagtttaaaaaatgaaggtcagaccaggcgctgtggctcacacctgtaatcccagcactttgggaggccgaggcgggtggattccctgaggtcaggagttcaagacgagcctggccaacatggtgaaacctcgtctctactaaaaatacaaaaaaattagccgggcgaggtggcaggcgcctgtaatcccagctacttgggaggttgaggcaggagaatcacttgaacccgggaggtggaggttgcaatgagccgagattacaccactgcactccagcctgggcaacaagaacgaaactctgtctcaaaaaaacaaaacaaacaaacaaaaaaatgaaggttagaattcacaagttaaaatataaagctttctgaaatgatgtatgattttattaattttagtttttctacatattcttttactcttttccattttggacacttttaaaaataagactaaaaacataatcatgaaggctcatgttattttaaatgacatctctaagctttcatggaagaatcattgtcccccatttaaaggttgatcataaaatttccaatatcctattttgttaggatatctttttccttagcatgtataaacatggaagaaaagataaagcatatagtattaactgaatagcctaagtaattgatagtaaaatttaggggcaaataaaaaaggtatgaatataaaagattattatagtaactaataaagatgataaataagtagaaagccaggtcttcaaaaaaattttcttttatgtgcattttaaaggagtagattctgcttgaatttgtagcagaaaacctgaagctaatgtttatgctcggcactgtttcttaattatgcatttgctgatacctaatagtgattatagtaaccactatcatttataaagggctaagtgccaggaattatattaagcatggttttatagaaaaggagactgaggctcagaaacgtgaagtaaagtgcacaagatcacacaatgaataagagcgaatattttttctacttccgtgtctcttgttctttccactataacatggacaataatatcaaaaacataattcaaaaggatataaaatatgaaaattttagttataaatttaatataaactgataaagcagtataaaccttggtaatgtccatattttaatgggaaggtcaattattataattagaaatatctaatcacatcatataaatactgctttgttcgaaaacttcagtaaactcttaaatatataaaagtgctatctttagaatttagggttttactcaattgatttttccttctacgtgtccacagagaatagtaacatacactgtgatgaggagaaagaataatcatctctgttgcacaccctttttgaggggtgtggtcctcaactaaccacatctttatttaacgctattcgtatgaggaactgcggctgctaaattgttcatttgtatcccttggtttaaatgtgtcagttttcttcagttatctattctctggaagtaagtgtatgctttaaattaatctgtgcacttattcatgtatcttttaccattagaaaacacactgaatagatattcttcggaggaaaatgaattgttgatatctcagcttactcagaaattcagtagaaatgattcttaactcttaaatgggaaaatggcacatggatagaacattttcgtaggaaaaacattccaaacgtatttagcctcaccagtaatggaagaagtgcacatgaaacaataaaatataagtttcagctatcaatttggtaaaggttaaaaaaatcaaactatatcgtattctcagcagtagtacaggtggtataggtgagatgcttatgtattaattatttgcttctctatataaattattgattatcacaaaatcccatacataactatttggagattaacatgtgaaataggccgggcttggtggctcacgcctgtaatccagcactttgggagggtgaggcgggtggatcacgaggtcaggagttcaagaccagcctgaccaacatggtaaaaccccgtctctacgaaaaatacaaaaattagccgggtgtggtggcacccacctgtaatcccagctactcaggaggctgaggcaggagaatcacttgaacccgggaggcagaggttgcagtgagccgagattgcaccactgcactccagtctgggtgacagagaaagactctgtctcaaaaaagaaaaaaaaaaaaaatgtggaatattatacagtgttccaggatttagaggacctggaagtatgcaaagatttatcaccttgaaatttatgtgtttttgaatgtatgttattatttttattatttaccttgtgaatctttgctacaataacttgtagtcagaagtctgagaatattggcatccttatgaaaaatgcactgaggaaaacagacaccatttttgcagctttgagactctgctatgtgcgtctcaccatacttcttggtaataaaagtctctttaaaacacactcaaaatacctacttgtaactagcagcttttttttaaagaaggaagactgatgtatatggctgtatttttattatatttgcatgcactgaaatataattattctgaagggaattaaaacaggcaagtgatttcaggaagtggatagagtttaaacatgggacagatcaaatgtataggaaacaagtggtttgtggtaatgattggtgttacatctttcaaggcctgataccattgacatgtggcggtgagcagcatatctctgacacttttgcacagttagcaatgatgttagacagcagttcttcctgaaataagtgagccaaatgccagtgcagctaattggtttacttgggaaatgctattcaccaatataaagcctagaaaagtgaaatttcagtttgcaccttataaactccatcggcatgtagataaccaactaattttgagttacagttggtccagtaccagaagtattgtatggtttatctgaagggactatacagaattcatcactgatatttaaatttttctctatgattgttttatgaaagcagcaaggcaggttatagaattctccgtattgacagatctttaataaataaactttaataaatgaatcaataattggcatagaattaacctccagaaagacacatattgcttagccttaaaagacatttttgaaaaaatgatttacggatacaattttaactctttcattgtactgtcaaaccttattttataattaaaatcctccatgatctggaatctcccttttattaacagtggctaaggagccatagcagtgagactagaaaggagagaaaagattctggaaaatgtgggacttaaatatgtgtgcattgtgacatgagtagtggatgagggaaccaccgatggggagaaaaattgcaaaaacaagagtaatatttgtatgcagatatccacctatacaatatatgtgataatttgaaattacctatatctttttttttaaccacacatgattccctgagtagatttcatttctagtatcagcagtgtcatactatgaacgctcaaaagtaaaagttttagaataagctgtaatttcagatccaataatctcagttaaatttggaagaaagtgtcagaggtatttgaaccagagcaactccattttgaatgagggctaggaaaatgaggctgagacttgctgggctgcatggttaagggaacaaattaataatgtttactggccgggcgcggtggctcacgcctgtaatcccagcactttgggagaccgaggtgggcagatcacttgaggttgagacttcaagaccagcctgtccaacatggagaaaccccatctctactaaaaatacaaaattagctgggcatggtgacgcatgcctgtaatcccagctactcgggaggttgaggcaggagaactgcttgaacctagaaggcagaggttgcggtgagccaagatcgtgccattgcactccagcctgggcaacaagagcgaaactccatctcaaaataataataataataatataataataatgattataataatatttactaaacagacccagacttgggagtgtccagatgtcctgatatctggagaacaaaggcattcctaattttgctttaaagataataatatcaattcttgcaaaatatagtaattaagaaagttaatcctgtatcacaaacccttgtagcaaagcacatctccccatatatataagcgttgtacctacagtagatgcattcctcctcttttgggaatgtcctactctgtctatggagtagctgttctttcaccactttactttcttgataaacttgctttaactttggactgcggactcaccttgaattctttcttgcgcaagatccaagaaccctcttttggggtctgcatcgggacccctttcctggaacagaagtacatagaaaggaaatgtttattctgtcagtccagatttcaaaacaaagtgtctagcagaatcaaaccattatcatatttgtattttgtgttctgtctatatttctgttctcaaaactaattatggcatttgatatagttagcgcagaaaagtatacgccgagccttactctgatgttaaatgcttgtggagttcaaatattttgtaaaatactatttacctttctacagatattaatcaaggtagaattacctctctctaaatacagtcttgtctgaagtaaaatcccagtcagtttattatatatcaaaagaagtaaacagcttttttgcttgcttctctaagaaccataatcagttagtcatcttcattctattgccttagtctggtcttccatgatcttaaaaaatgggaaatgactgtgattaatgaagctatttggacgatgatatttaagatgataattgcatttaaatgttatattgtttaaattatatgcaaatatctgagatcaaaggaaacataaagagctctattgtcccataagtagtttccaaattctgctagaaacagttaatatgtttgatcggttctattgtcttgtccagattcttgaattctgtttgtgcaaactggacttgaggggagtatctacagacagagcagcatttctatcactcctcggcagtgttctcttcaacagtgcttattgccagctatcgaaatgtgcagtgtgtgtatgactaagagtggatgagtactgtaacaccttaattacaaaataaatagtgactgtcactgttgctttttatagagctttctgactcaagtgcttggtttcctctgattttttaattatttgcatgaaagaaaaaagaaatcactcctttgacattcgatggagggaaaaggaagagctaattaaactgttgtggaacattattatcctctttagttttacactgacaattctaatgcagagtcactttaaatggctttgcaaatcggaatttgctgggccctttattatttctccaaattcactgaacaagtccattcacagggatattgaaaatgcaaagtaagtccagactgaaatatcatttatttcatgaaacattcattagcactttcagtagctgaagataaaggaaaaaatgtttcacagggagtcatgagagattaatatatacagatttttaaaaacaaaacacagaagtttgaaaaaccatcaggtattgctttgaaaggaatatagagttatatggattttgaatgtgttgaaaaatggcttaaatgtactgagctattcacagcccttggcttttactttttatgtgagttatatctgaacaaaaattttattatagtcagtgttgttcatgctgctatagttaaggttgtcagcatttccattacaaacccactatttcagttggggttcataactcagctttagaagtcaccctgggctaaaggttggcaaatgccttttcaacctgtggtggtaatgatgggtatgagtgtggttaaatatgtagtaaacatttaaattaacatatattacttcttatgttatgaaatattttaattgaataatatattatggttctctgattatagaaactgtctgaggaatgttagctttgtcagtataattgattcagggttaaagaaaactttttttcaatctaattagtccttgtagccaagaaactctgaacatatcttggagccattagccaaacacttcctgctaccaatgagcgatggcttgtaaaaggcactcagtaatatactaacattactgccaaacaactggttaattctgtccaaagattagtgtgtgccacgaggattgaaaagttaaactgacaagtttgagattttgcatacaaccatagccacatacgcaggtaggtaacagattttttaaaatgaaaatcggtttcttttgaattaatctcatttttctggttataaaattaattatttttcctagttatgaaaattaaaatattttagattacttagtaaaaacggaaaaattaaaacagagtaaagaataaaataaattacctataatttctcaaaccagtaataacgactggtaacatgttgatgaatgtccttctgatctttatattatacataaacacagatatgctacaggactgccagcttcatatgcccactgtgcagcagcagaccaatacactgactgcggggttgcagcagaggagtttaatcacaaggcgccaagcaaggaaatgggaggaattctcaagccttgaatttgtttccttgagggattctgggcaagggtgtttaaggggattcataaaagacgggggcggggcggggtgggggctggaaaatttggtgttgtgatcagtgggggcagggaggatgaaatcataaggatgtgtaactgcttttctccaagagtcagcttcttactgggtccaccagaccagcttgattccctagttttgttgatatgcagaacctcctaaagaagcatctcagacaaaaggcttatcttctcacaatgtctgagattttatctatagaaccggaagagaacagagaatcttgtgacaaaggctatgttatcctggggtggtaagtagaaaccagttacaaggaagtgggccaaagggcaagctggcttaatgattgctgctgcaaacctagttggattttattttattttatcttattattttattttatttttcttaaacaatttcattaaattatcttgggaacagtgtcagatatatatatattgctaaggcatactttctctggctgcccagtatcccactgtatgaaatgtttaacttatcacctactgtcgtggatttcgaaatctggttaatgatttatcttagttaatcttagttactttggaataaaaatctgatgaaacctttcagcagctagagtttgctcaggatcttggtcttaagtctggttttagccatttttaggtatgctagttactgtatcctccaaatgttaataatttataattttgattccaaaaatagattaaacacatagaatttattatatattgatcacagagagataccatataccaaacacttaaattccattggcatggttacatattgaagcttttagtgtaaatggagcagactttaaaaattaataaatttggaacatatggaatgatcatttcctttgaattcttcttattttaacttgaagagcaagggaaaaactttcttgcaaaccacatttttccctttaaggtttttgttttttgtttttttgttttttttttttttttcctccctagggaggatatagtggcgggatgcagccggggactctctgtaggaacagaatattatttaatacagaattccatgatccgaaagacctggatttcaatctcaactctgctttctagttatgtatgtgattttagggaaggtacatgacttatgtgagccttacttttctcttccttatgatgtagataatacttgggtcaatggtgttataaatattagatggattatatataaaaatttacttatttgttgattggcatatagctggttccaattaggtaaaaatgatgaaactatgttatactggacttcaaaagttttttgtgggttttttgtttttttttcttgagaagtctcactctgtcacccaggctggagtgcaatggcacgatattggctcactgcaaccttcacctcctgggctcaagcaatactcctacctcaccctcccaagtagctggacccacaggtacatgatgccacacctggctaatttttttgtatttttggtggagaagggggtttcgccacccagactgggaaaagttaaattgagtttagattcatgcgttaaggctgggaagccattgcctactcctgagcaggagagtgatttaatgaaagtgctattctaggaaaattattccagcactgatatcaaaatatctttaaaaggcaagcagtagctgggggtacattgcttttgtctttctctaaaaatcatgattatcaataaaagaagactgtctcattacctctgttttagttaagaagctgccagggttttaccattatgttgcagtttttaatctttaggactcatgttattctttacttctgtaacattatagtctcttcatctgtaatttttataagagatatttggaaccttctcattctgtcctccgaagtttaacttttccttcttgtatgcatctcttagtatctctttattattcctttttatatgacttcttaatagctcttcttagtatttcttcttaatatctcttaatattaccttaatattatcaatttcttgagaattatcttccaatgcactaattctctttttttctccccactaattctctctttacctgtatctagcaatcttttcgaatcatctattaagaagcagtatagtgtggtggttaaaagcaaagacttcgaagccagacttcctagattcaagtcatttctctgccacttactagctgggtaatgctggtctagtttcttaacctctctgtgccacaatttcttcattgtcaaaatggatataagagtagcatctgcctcataggtttattttagtattaaatgagtgatgaatgagtttagaatagtacctgtcatatagtaaattttgaatttttctgtttttattgaggttttattattgtagtatctatatttttcctctcatcccctccccctctcttcttctcacagaatctccctctgttacccaggctggagtgcagtggtgcagtcactgctcattgcagccttgacctcccaggctcaagtgatcctccctgctttcgcctactgagtagctgagactacaggcgtgtgccaccacacccagctaatttttgttttttgtttgtttttggtagagacaggatttcgccatgttgcccaaactggtctcaaactcctgggctcaggtgatccacccgcctcagcctcccaaagtgatggtattacagacatgagccaccgtgttccttttattgatctattcattcttttttttccccgtctatttcttgctttatggtgcccctttctttcttcatttcttagatccttatgaacatatttaaaatattgttgttctgatatttattgtttctaaggtatgaatttcaccctttgttatttctgctgactttgtatcatagtggtttttaatgttcatctgattcgcaatttcttcactgagagctcacctttagcagaagttttctttggaagtttcagatgctctgggttgtagaggtaccatatgggatggtttcaatttttctgtctttcctaaattttaccagtttttacattaatttttatctttctattcttttcctttcttttctttttctttgagacagggtctcgctctgccacccaggctggagtacattggtgcaatcatggctcactgcagcctcgaacccccctggtctcaagagatcctctacccttcagcaactgcccccacccctacctcgccatagtgggggctacaagcacatggcaccacgcctggctgatttttgtatttttttcagagctggggttttgccatcttgcccaggctagtctcgaacttctgggatcaagcaaactgcccaccttgtcctcccaaagtgctaggattataggtgtgagccaccaggcctggcctaagttttcaatacatggtctccacacaggttggtaaggcattgaagtttcacctttatacccatagactgatgtggctaactttttccctgctatctttcaggaagtgactgaagcttttctagacttagttttccagatgagaccacccttccaggctcttagctttgtgcagggatctcagttccagctcctcatgtacaagaagcttgtgacataaattctcttccctatgcagatattaaaactctagtctctatgcttatatttagttccttattcctcttagcctgttgcctttagctccctaacagagctttgactttgaattgctactttctgtctggcccctaggaatttgccattcttaattttgagcttggcttttttctttaagttttatacagaacaatttgactagtagtagcttttcacattaacttattcaccattgtgtttggtagaatattgtcaggaataacaatgtaaatttaccagagatatttctttaatgagtaaattggctcaatgtatgcattaattgattcataagtctttgaggatctctgatatcaaacaaataagcaagagtcactaaaatcaagaatttattgagaacctactttaacccatttttaaggtcactactgtgtcagttccatttcaaagctagtctcaacctttaaaatacttatactctagttagaggcaaggaataaatacatgaagtacaatgaaaagagctaagtgacaatgcaaaacaaccaatccataaaactgtagatcagagtcatctgggctgaagtaccttgttctgacaggtcatacaactgtacttatccctataaatacctaaggcaaaaatacctatttcttacttcctgcaaagaaattatataaaattatctttcccccaatctttactgtctgtcggcaaaagtgaggcagacttatggttctgagtgagcactaccatttaaaagaaaaaaagaaaagaaaaaaagagtgtgaattgccttaggtaaactgaaattgtcaactctgagccaaaacaatgcatcaaatttagaaatgtatgtcttcttatacattgactttactattttcacatgtgtgacttttaacttttcagataatgtatacctattatcagctttctcagtaaattgtttacatcactgaccattaattcttagaagtccttattgctactttttttggtgttcagaaataaattaaaattctcttctttgttcttttacctagtagtgttttacaactttttgaaacatgaacgatgggttaggattttatacaatgaatgatatgaaagttggcttgaatatatacaccacaaggtttgccgtatggtcctctgtcaaatatctgttctcaagatgccccaaggcatcataaaaacaaaatggaaaactgcaacagaagaccaagaaagaaatattttcaggtaaatggtaaagcagggagatgacacatttcgtgcattgtatttcactctttcaacaactatggattgaatgctgaatttgtgccaggtattttataaactgggcacttgtcatacagtggtgatcaaagtggatgtgatcactaccccttgtcacagtctcataggagagacagacaattaattatatagctctagacttaatatgctaggaaagaaacagagtggatacaataatgggtaataatactatatggtgggtgcagggagagggctccttctgatagtgtgttcagagatagcttctctgaagagtggccatttaggtggggacctaaaggctgagtaagaggttgaagtattttctgttggcagggttagagtttcttgggagacataaaatagtttcaaaagaagcattaccaaaataagagtttttataccttcacctgtgaattatacgcttttgtttgtttgtaaacattttattttacaactctacatactctgatgcaattctgtattttggagttttgtttgtttgtttgtttgtttttgagacagagtctcgctctgtcacctaggctggagtgcagtggcgccatctcggctcactgcaacctctgtcccccgggctcaagggattctcctgcctcagcctcccaagtagctgggactacaggcacgtgccaccatgcccagcaatttttttttttttttgtattgttagtagagacgcattttcattatgttggccaggctggtctcaaactcctgacctcaagtgatcctcccgcctcggcctgagattacaggcatgagccaccatgctcagccctctgatgcaatttgagaataaacaagtatagcaagtataagcaaaaggcacaaggtattctgcatagttaaaagtgcagctgcttaaaaaccatcccgtcttctctactctctctctctctctgtcctcctcctcctctttttttctttctctcatattcgtcttacagaatattaaatctgtttccatattgcttggtcccttccttcatcttaagagagatgttaatactgtgcgttcattgagaataaccaaatggatgttagcattgttctttatttaatcttaagtaaaatattgtttttttcttaaaaaaaatacatttatcaaaatttatcttacccttatcaatctcaatacagttgtctttacattaacttctattagttggctattgtcctatgttttatatattcagtaattatataatatggaacaaaagtaagatatcattgctgaatgctgttttatggaaaaagaaaagcctttggcattaatgtaatatatactcctgttgattaatactttgaatgtctttctgtgagatatatacaataatgcccataaaatgatcaattttgataccattctgatgcattaaagatggtgaaataaatgttttaaaaagactgggagatgcgaatacctattttttgaaagcaggttagaatgtaatgcataaatgggcaaatgaaaataaaagcataaacacatagaactaccagggctgttgaatagtacctgactcaggtctcttccctccagaaagactataaaaaaacttctaggcaaaacagttgtgtttcatattttttaagtgctggttagtaaagactttaaaaaactcattacaaagtatttcatgattacagaagaacatgtaatagatagtatgtaaggtataaagaatagtgataatttaaaatcccacgaacttagcacccagctaaagaaatacaactttatcagtgctctttaatgccctgtctgttctgagatcctgtattcctccccctgctccaaacggaactactatcctgaactctgtgtctgttgtccctttgtttttctttatagttttactgtatattatgtatacataaataatctattgtctacttttcctcagttttgaatctttacataaacagaattgtaaaatatgccttattctgcaattagtttttatttttcactaaatcttgtgtttctgagattaactaatattggtgcatgtatctgaatccaattcctctgccacatagcgtttcattggatgactataccacaatttacttagccattctcctgtcaatgtacttgtggtcgccccctccaccaagtcttttgttaatataaacaaagctgacgagaacaatgttttattttgcttcctgatgcaaatatgcaagagtttcctctagggcgctattctgaaacttttttttttatcttagaacctctttactcacctaagaattgaggataccaggaacttttgtttacatctgttaaatgtatcagtatttattcaattagaaatcaaaacagatcatgttaaagcatcagaatatataagcacacattccattaaccatcaaagcagcggtgggcacttgaaacatgagtggcattggaaagttttgagatagagactctggaaactactgtacactctttcaagaatgagagtacaaaaggcagatttcttagtactattatgaatgtagttttgacctcatggacctgctgaagggacctcagagacctgtagctttcatagaccacacattgagaactattgttccaatacaaatctaaggttagaatcattaggtcattatgtctcttcaattactagataacatcaaatatttttctaaagcagttgtactgtaccaatttataatatcaatagcagaatatataagtacttcctttggtacacattctagccaacatttggtcctgtcaaacttttccatttttgacaatctagtggtttaagatggtgtctcactgtggtttcatgttacatttctgtgatcactaatgagcctcaaaatttgtattggccattaaaaagactgttaggtctttttctgatctttcttttgggttgtttatcctctttaaagaaaattctttcaattagttattgaaatattacagatacaaaccccttgtcacttatatgtcctgcagatatttagaaacagttgtggctagtagtagtattacttttaaaaatgtgccttttaatgaacaaatgaacagaattttaaaattagacagtctttttttttttttttgatggaatctcactctgtcactcatgttggagtgtagtggcatgatcttggctcactgcaacctctgcttcctggtttcaagcgattctcctacctcagcctcccgctgtagctgggattacaggcgggtgccaccactcccagctaatttttttgtatttttagtagtgacggggttttaccatgttggccaggctggtctcgaactcctgacctcaaatgatccgcccgcctcaacctcccaaagcgctggattacaggtgtaagccaccacgcccagcctatatagtcatttttatcagtcatttcctttagcacttagactttttgtattttaagtaaccctttctaccttcagttcatgaagatatttttctgtattttcttttattcattaaaacaacactttttgattacctactactatcagacacagttctaggtagtgtggatatggcagtgaaaaaaatacatttaaaaaaaaaccctagactcttagagcttacattctcgaagtggggaggaaaacaataaacacatatgcaagtatctcttagtctcttcagactactgttacagaatactatagactgggtggcttaaacaacagaaatttatttctcagagatctggaagttgggaagctgcagatcagggtgccagcatggtctggttttggagaaggccctcttcctgttttatgcatggccgcttcttactgtgtcttcacatgtcagagagagcagacaggaagcaagtgctttcatgtctttttataaaaggcttgcatcaggtggttggcaataatgaaaaatgtccagattcttaacgtgaagttaaaaattcacaaattgattagaatccacccttatgatctaattatttcccaaaggccctatccccaaataccatcacactagggactagggtttcaacattggaattttgacaggacattcagtccatagcagcatgattttgtatgaaggatagtgataaatattatgtagaataataacgtcagtgagagtgccaagtggtcagaggtggggttctgtaggacagaacagcaaagcacaaacttcccaaggcaattaatgtacttggagagtttgaggaaaaggatgaagtccagataactagaatggagttagcaagaggaagcgtattaggagatctggttgataacagaaacccagatcacctagggcctcctaggccattttaaaggcttgagcttttactttgagatggtaaggcgatggaaagttttgagaaaagaaatggcaggtttttaaaagatcactctgtctcctggtttgagatagtctatatgcaagcaagggacaaaactaggggaacatgtaggaggttgtttcagtaattgaggcagaaatgatggtggcttgcatcaggtggtggcagtagtgaaaaaatgaccaaattcttgatatattttgaagcttttatttgcaattggccagtcacagtggctcccacctgtaatcccagcactttgagagccaaggtaggcaaattgcttgagctcaggagtttgagactaggctgagcaacatggtgagacctcctctttacaaataattttttaagaaacgaacagggagtggtggcacatgcctgtggtcccagccacttgggaggttgaagtgggaggatcacctgagcctgggaggtcgaggcagcaatgagccgtgatcgtgccactgcatttcagcctgagtgacagaatgagactctgtctcaaaaaaaataagacaaaagtacccaaaacaaacaaacaaagatttgcaaattgattaaatatggtttgtgagaaaaacagagtcaaaaatgagtaattcctttttttgttgttttttgttattttttgacatgagtaactagaaagacaaagttgtcatttagagagatgaggaagattgtaggtggaacaagtttaggtacaagagtaagaagttatttttgaacatggtaattttcttatgtccatgttcaccacatagggacaccaagaaagcagttagatatatgagtctggacttatggggagaagtccaacctggacatgtaaatctgtgaggcattagtgcacatagtctttgaagccattagactggatgagattaccaaaggattgattatagatagaaaagggaaggggcctggtgtgtgatccatgacatactataatgtttagagttctagaagatgaaaaggaaccaacagaggggactaagcaatgaccggagaaataaaatggtatttaaatcatatcctgcaagccatctgataaaagtcttttgtaaagagagtgatgaaatttcttaaataaaatgaagtcaagtgaaatgaagacagataattaaacatgaggtctgacaacatgagcctgacaagtcctgtttggatatagtgttggggcaaagaacaagattggaggagattgaagagagaagggaggaattggtaataagaagtattttcttctaaagctcttaaattttcaacatgttctttaaatacattgctttttacctgttacaaaagtaatagtgttcattgtagataatttaggaaaaacttaagaaaatattttatatggtccaaaaaactaactataaccactgtagatattttggtttatagcattggagtccatttttttctgtgcatttttataaattcattttctaaacaaaaaatacattatagacatatttacatgattttcttttttaaaaaattatttatttatttttttttttttttgagatggagtctcgctctgttatttaagctggactgcagtggtgcgatcttagctcactgcaacctctgcctccccggttcaagcaattctcctgcctcagccccacgagtagctggaattacaggcacgcaccaccacacccggctaattgtattttcagcagagcccgggtttcaccatattggccaagctggtcttgaactgctgacctcaggcaatccacccgcctcggcctcccaaagtgctgggattacaggcgtaagccaccgtacctggcctatttacatgattttctcacgtaagaatgtaccatgtttgtctttccttagtatttttaatggtagtgtagcgttatattatgtattatggtttatatgtagccaatatcctattattaggcacttttcaacattttcttttagaaacattgcagtgagcatttcaatatgtaattatagtctttcattagcatattcttaaagattttgacaattagcccactgggatatgtccagaagagaaatactctgataatggtcggtctgcaaaccttatcatacatacagagggcttaggaatagttgtccacgttgcaaaaattgtaagggttcagtggaagaggaaagctgcccagcagcagaaggtagtccttatagggaagggcagttctctgacagaagaggccttgtccatagaaaagatatgggtagaattgcagcagttgtttgtatgtgcagcagttttttaaataagaaactttccgggctgggcgcggtggctcacacctgtaatcccagcactttgggaggccgcgacgggcggatcacaaggtcaggagatcgagaccatcctggctaacacagtgaaaccccgtctctactaaaaatacaaaaaatcagccaggcgttggggcgggcgcctgtagtcccagctactcgggaggctgaggcaggagaatggcgtgaacccgggaggcggagcttgcagtgagccgagatcgcgccactgcactccagcccgggcaacagagcaagactccgtctcaaaaaaaaaaaaagagtaactttccatattttattgaattgtaggtcatgtaatgaaggttttccatatatctcataggcacaaatataaacattgtatgcattctaaaatcaaataaacacaatctcatttatatatgtctatgcatgtctgtgttgtagttgaggaactttagtttatatgttatactaatagtttactgaatataagtttgaaatatttttctagaattaaggagtatttttaaatcaacttagaattctattttctgcaataggaatatgacaaacattttctcttttttgaccataaactacttgaaccctgtagttttccatttagcttactattttaaggaatgtgataaatcaattgcgaacctttttgttttctttttcttgaggcttctgttgtgatttccagcaaaaaggtcgatgtagacggcattttacctgatgttgatgttgcttgggatcagaattgacaatcaggagtagtctctcagtttagatttacaaaaggccagataacttggatatcactactgcttatagaaacatctctatctctcttcttccttttcaaatattatactcactagatcattaataagtaagataaaatgttctttacactttcacatagcctctgaatttttcccatttaaaatgcactgcttgaaaaatcaaggggaaaacaaaggtttaaattttctttacattttagataatgaaaagagggctcaaatgaagagtttaacagaggcacctgatgggactctttttattgcatataaatagaactattcgtgctgctatttaacaatcaaaatctaaatacttcagactgaagatcaagtcccctactttcaaactatctcccaaaacttcccattaaggactgtatactctaggtgaactgaattaccttccgttcactatgcccagaatacagttttctagaaactctctgtctctgtgatattcacgtcatgtaggtttcctatgtccacgactttgaaattctaaatctaatccataatttaaggttcagttaagttgccaccctcttcaaataggcttcctggaataccacaactaaaagtaaaatctctgccattgaactttattttcatataccaagattctactacagtgctaaaacataattatgactatgggctagtcacaggggcttatgcctataatcccagccctttgggaggccaaggtgggcggatcatttgagttcaagagtttgagaccagcctgggcaacacgacaaaaccccatcttgacaaaaaattagccagctgtggtggcgtgggccggtagtcccagctacttgggaactcagaaggttgagatgggaggattgcttgagcccaggaggcagaggttacagtgagctgaaatggtaccactgccctgtagcctagatgacacagagagacccagtctcaaaataataataataatatttatgattatgtttaattttgatttgttctgttgcactcttatgatgcatgacatatataacaaacaattcctaaatatgagtgttcctcatgaaaatcactagcatatgtggatgcatacttatatgtatttttggccttttgattgagtattcacaaatcataagtgttccgcttaggagtacttttaaaaagtgaaaaaagggctggacctggtggctcagacctgtaatctcagtactctgggaggccaaggtgggcaaattacttcagcccaggagtttgagagcagcctaggcaacatggcgaaatgccatatctacagaaaaaatacaaaaattagctgagtgtggtggcatgctcctacagtcccagctactcaggaggctgaggtgtgaggatcacttgaccctgggagaagctgaggctgcagtgagtcatgattgctactgcactccagcctgagtgacagaatgagaccctatctcaaaaaaaaaaaacagtgaaaaaaggagttaaatagaatagtatctaatggtatctaaagtagcagttaagcagtagagtaacagttgcatttattaaggatttagtatataataatttttattatataaaattattatataataaaaatatataataattatattatataattatataaaattgttatataataaaatatataataattgcatatgcgcatgataatttttatatgcactcatctcctctgtacttcacataaatcctgataggtaaggtactattattattcttactttacaaatgaagaagctggaacttggggaaattatgtaacttgcctaagttctcatatatagtcaaagacccccaagccttttaaccactttactatgctgaaaaaagtcagaagacgtagcaagaatgtaaagttttgaaattaagtcttaggacacagaaattatgttagaaattatacttgggtttcaggattacattctcgtgtgttggcaaggaggacgctactagctgagtaagaaatgatgtgtgtgctttatgactttattatgtgaaagggtactaaccatagtagagggttacattaatgtatctttagttgttgtagatattaatgggagaaaaggatttataagagctttcataaaacaatttgattcctttatgcctctaaagctgttttcccaggaaacattaaaattgtaaataatgatttatcctactgtggggttcttcggaaacttaactcttggggttagatttctactggtgtgtgtgtgtttaaaagagctattaataaaactgcatatacattattccattgtggtgttttaattatttttgattgatcctgctttctaagctccaaattagaacaacccctttaaacatttattaggaagaaatatctgaaccagtctgacctgacatttgtagacatcatcttagggctgttctccccttagaggatagtaacttaggactatatcagttacgtctggtaacgatatgccatgtctgtgatactagcatgcatttctataaggaaggaagagatggagggagagaggaatttgttttgaatactctgaaaatgtctagccagtggattataattaccataatcacagtttttggccatttggatgaaagaatgttgttcatgcccatactgctagctaagacagtcatgtgcacactgcattatgaacctatttccaatagattaggaaaatagttacaacaggtttgaggcttctgttttgcaaaaaccttttatagcgttatggtctcagaaggaaccattgaagaaaataatcattaacattttctcgaacactaaatcctccgttctgctcctccaatatctcataggctgtcatctgatatcagcacttatgtaatgtcacgataggtggtgccatagttctatactgccttacattataggaaaatataaagtgttatttgaccaattgaataaaaagaagaaaaaatgtaaaaagttttctgaaccctggttttaagaaatttatgaacaactaaaaatttctcaaaggactgcatttttccattctctgttagtaaaatatctcagctgccttttgattctgctagctgcgagaatggcagaatggggcctgaatggcaaactatattatttgtaacattaatgccagcctgtttggagattaattactatctttgtattaaagtactggttgtgttggaattgctgcctttttaaacttccccccaacccttggtcatttctactgatgatttgcagtaaaatagctgacaactgcctatgattagtttagccagatgctacttgctctggtaaattcattttaagcatttgacaagactgcaaagattagtgccagctgagcttaaaatatttttacagacgaatgatatgtgaaaagtcagttacttttcaggtatatgatgactatgtaaattaactgacaacatatcttctttggtgtttatttgtgaatcatttatctactttatagaacaattggtagagttatccttcacaggtatattcagaagatgtcaccaaatggagtgctttcaagtttttgtatgttattatgttgtcctatgaattgcctgtgctccaagacttatagaattgcagggtaaagttgggaatctctggattagagaatgaaaataaaagtgagaagtcttttctttagctacttctaccattcaacatcaagaaagaggctcttactctcaaaacattgttcttaggaatggccatcaaataaatgccttagttacagataacattgaacaatgatgagtagtttattggtttttcacctttcttcattctttgccctcttttattattatatctttactctttctcttatgccctttttaaaaagcatgtattatactatagaaatgtttcctattagtgattaatgtgataaatttgattagttgaataaaagcaaactttgattctagattttatctatttcttggtatccggcactgtcaaatacagttgtccctcagtatccatgaaggattggtgtttttttgtttgttttgttttgttttgttttgttttgttttgttttttgagacggagtcttgctttgtcgcccaggctggagtgcagtggcgagatctcggctccctgcaagctccgcctcctgggttcacgccattgtcctgcctcagcctcccgagtagctgggactacaggcacctgccaccatgcccggctaattttttgtatttttagtagagtcagggtttcaccgtgttggccaggatggtcttgatctcctgacctcgtgatccgcctgcctcggcctcccaaagtgctgggattacaggcgtgagccaccgcgcctggccgaagtattggttttaagacctctgcagattccgaaattcgtggatgctcaagttctttatttaaaatggtatagtatttgcatataacctatgcacatcctcccatatactttaaatcatctctaaaccacttataatacctaatacaatgtcaatactatgtaaagagttgttgtactttattgtttagggaataatgacaagaaaaatagcctgtacatgttcagtacagacacaaccatccaatttttttcccaatatttttgattcgtggttggttgaatttatagatgtagaacccatggatatggagggtggagggcctactgtatagttatctctataggttttgggtagtttcctgtccttcacccagctgactgtgaccttgtctattagaatcatatatactgttctggaataagcttgagatgttatcttttctaatctcattttaccaatgaggaaactgaggtcctacaatttcaataattagtcaaatagcacatggcaaaaaaagtggtttatataggattggaccctagttttcttcaccttccagtgttctgtccactttttggacttcgtacatttgaatttctttatactttgctgatttcactcaccaaacttactgacttacctgacttctgaattatactcagaacaaaacacctgtatgaaagtcttcagtggcaccccattttcttttccagttttccttcccttctttcatctctccctcccataaggtcttcctttttccttcattactgcattttttaattcatgtagaatctacaattttcacttgtagttttatttcaaaatttgttaattttttctacgtctcttttttgttatagctctgaaaagcctacttaaaaaaaaaaaaaaaacaaaaaccctgctaattggcttttcttcctggtctattgaataaagcactagatagggaataagaaaaccttgatgcattttcttaccttgaccagtgacatgcacactctgtgctctagttttctattaatatcaataaagcggtatttatctgtactgcagagttatcaacctgatttaattaaaaaatctagatatgggccaggcacggtggtttgcccctgtaatcccagcactttgggagaccaaggagagcggatcacttgatcccaggagttcaagatgagcctgggcaacatgacaaaacagtgtttctacaaaaatacaaaaaaagttagccagttgtggtggtgtgtgcctttaatctctataatcccagctgctggggatggggggccttggggggaatgctgatgcaggaggatctcttgagccctggaggtcaaggctgcagtgagctgtgatcacaccactgcgctccagcctggctgatagaacaagaccctgtctccaaaaaaatctagatacatttggggctttctcagagaatggtgcacagaaaatagaaaacggtattagcgttttaagatatggaaaaaaagataattgttttgatattgatggttattattactaatttttaaagactagtatactcctagcttttcaagacaatgatgaagcaatcctgtacctgtgacaggcctatatttctctttttttttttttttttttttttttttgagacagagtctcgctctgttgcccaggctggagtgcagtggcacaatctcagctcactgcaagctccacctcccgagttcaagcaattctcctgcctcagcctccagagtagctaggattacaggcgcccaccatcacgcctggctaatttttgtatttttagtagagacgaggtttcaccatgttggacgggttggacaggtctatatttctttccgtgcttattttacaactggtatggtctgaatgttctccaaaattcatgtgttgaaatgtaatcgtcaatgtgatagtattaagaggtgaggcctttaggaggcgattaggtcctgagggcagagccgttaaggatgggattaggactcataaaatggtttgagggagtgggttcattttcttccactcttctgccatgtgaggacacagatttcattccttccctagcatacaacaataagccaccatttcttggaagcagagtagccctcactagatgtacaatctgctggtgccttgatctttgacatcccagcctccaaaagtgtgagaaatgattttctgttgtttacaaattacgcagtctgtggtatactgtattagcagcacaaaaatactaagacaaccatcctatgctttagattaaccagtatttaccatataacttgtaaatcggtgttagtggtggtaatgggattactaatgtgcatgtgttaacatgttcattggttcaatgcgaggctgtgatcctgtactctgagtgtgccttttttttttttttttttaattactttaagttccgggatatatgtgcagaacatgcaggtttgttacataggtatacatgtgccatggtggtttgctgcacctattaacccatcatctaggttccctcccctcacctccccaacaagcccgtgtgtgatgttcccctccctgtgtccatgagttctcattgttcagctcccacttatgagtgagaacatgtggtgtttggttttctgttcctgtgttagtttgctgaggatggtggcttccagcttcatccatgtccctgcaaaggacatgacctcatttctttttacggctgcatagtattccatgatgtatatgtaccacattttctttatccattctctcatcgatgggcatttggtttggttccttgtctttgctattgtaaatagtgctgcagtaaacatatgtgtgcatgtgtctttatggtagaatgatttatattcctttggatatatgcctagtgtattagtacattttcatgctgctgatgaagacatacccaagactgggaagaaaaagaggtttatttgaacttagagttccacatggctggggaggcctcagaatcatcacaggcactttctgcatggcagcagcaagagaaaatgagaaagatacaaaagtggaaaacccctgataaaaccaacagatcttgtgagacttattcactaccatgagaacagtatgggggaaaccacccccatgattcaaattatctcccaccaggtccctcccataatacatgggaattatgggactagaattcaagatgagatttaggtggggacacagagccaaaccatatcacccagtattgggattgctgggtcaaatggtatttctggttctagatccttgaggaatcagcacactgtctttcacaacggttgaactaatttacattcccaccaacagtgtaaaagcattcctatttctccatagccttgccaacatctgttgttttgatttgcatttctctaattatcagtggtgttgagctttttttcacatgtttgttggccgcataaatgtcttctattaagaactgtctgttcatatcctttgcccagtttttgatggggttgtttgtttttttcttgtaaattccttgaagtttcttgtagattctggatatcagacctttgtcacatgggtagattgcaaaaattttctcccgttctgtaggttacatgtttactctgatgctagtttcttttgctgtgcagaagctctttagtttaattagatcccctttgttcattttggcttttgttgccattgcttttggtggttttgtcatgaaatctttgcccatgcctatgtcctgaatggtattgcctaggttttcttctagggtttttatggttttgggtttcacacttaagtctttaatccatcttgagttaatttttgtataaggtgtaaggaaggggtccaattttagttttctgcatatggctagccaggtttcccagcaccatttattaaatagggaatcatttccccattgcttgtttttgtcaggtttgtcgaagatcatatcgttgtaaatgtgtgttgttatttctgaggtctgtgttctgttccattggtgtatatgtctgctttggtaccagtaccatgctgttttggttactgtagccttatagtatagtttgaagtcaggtaccatgatgcttccagctttgttctttttgcttaggattgtcttagctatatgggctcttttttggttccatatgaaatttaaagtagttttttctaattctatgaagaatgtcaatggtagttttgttgttgttgttgttgttgttgttgtttttgatgggttcttgctctgttgctcagactggagtgcagtggtgtgatctcggctcaccacgtcctctgcctcctgggttcaagtgattctcttgtttcagcctcccgagtggggattacaggcatgtgccaccatgcctgggtaatttttgtatttttagtagagatggatttttgacatgttggccaggctagttagtctcgaactcctgacctcaagtgatctgctggcctcggcctcccaacatactgtgattacaggcatgaaccactgtgctaaatatgtatctaagatggcatgagtatatgtgttgttgttgttgttgttgttttgtttctttgagacggagttttgctcttgttgcccaggctggagtgcaatggtacaatcttggctcaccgcaacctccgtctcccaggttcaagccattctcctgcctcagcctccggagtagctgggattacaggcatgcgccaccaccccagctaattttgtatttttagtagagatggggttttgccatgttggtcaggctggtcttgaactcccgacctcaggtgatccacccgcctcggcctcccaaagtgctgggattacaggcgtgagccaccacgcccggcctagagtgtgtgtttttaacaaaggccttccttgccacatcctcattccagtcctagtttagttaatgtgacaatagtagtcttttgcaagataaagattataagtaggtaaccattttagcatttgatgcactttacagattgcaagcaataatatgctataaatttagtttttataataagatcatggtgtgttaatagatcatattctgtaggatagttatagaaagtttttaagtactcttttaaggccaagattcatcaaccatttgcttatcctctcactatttgctgtaatttgtcagtatccttcacaataaaaatagattatgacataccttgggggttcagtgaaggttaggacaagttagggatccaggtaaagcttcagagaggtgatgtaatccccttgatgagattccagtagattaagatcttagtatggcttgtgggggctaggcatgataggaggaagagaagaggttggaattctaggtagaaaaaaacaattaaactgagatataaggtaaagaaagtacagagtaaagtacagagtaaatttgaggagcaataagtagtccatcttggctgaagcataggatatgtgtatagtactgagagaaatcctgtggtggaagaagtttgagactatatcataatggcctcgaatgccatgttaaggattttcaattttatttagaaggctgaggggagaggattgaagaattttgagtagcagaggaattttatcaagaggttgttttgtgatgattgataggaatcatcatcatcatgatatgaataaaatggatagagtaaaaattgaaggtggaccccacttattattaggttactgcagtagtccatgaaagaagaacctaaaccagagtagatgcaactgacattaggaagaaagactcaacagtaatttatatttttatgtggccaggatatgatcaaagacaattctgagcctgaataacttgctgaatagggatgcattttttgccttttttaaaaagaggagagcagtagattcagagaaaggttcctggcttggggagaaattatttttgaacttctctggtttgaagtatacattgagtatatagctagagttgcttaatagggagatgaacatatggtactagaattagaagaagggtgggtatcagtaattacctatttttgcaactgtatctacaaagataataattaaaatgatgagattaaaagagatcactagggcagagagtataagaaaggaagaaagataaggaaagaactttggtgaatacctcatttaaatatagaaataagagttatcagagaagctgggtggggtatttatgccgaagcagtgtttagaaaacttatggaagagaaaatttcaggaaagaaagggttaatcagcaatctaagtttttaaaaacttttgcgaatttgtttttattggggtataagacatgggttggaaaatgtcagtttggggtatgcacttgtctccaggaaatatctatcctcatcttcccgggatgatttttggaactttttctctttaatggagctgctcttgctgccagcacaagttcactgctggctggctcctccttggaagataattttctcctttgttttggagacacttaacaagtggattaaggatttaaaagtaggttatttgatttgttggcctaggttatattgctgatgctgcaagaataattttaataaagtggaaaggacaaagttcatattgtaaggggttaagtagttcctaggtgataattaaatgtagtcaaatttgtatagattgcagtcttttcaaaagtttaacattgcttatttttgtcttcataatattaaaccaggtctatctaaaattttaatatcacatgcaagaagcattatcattttgtagcagatttttaaagctgttatttcagattttgaactgatcagcatgagacagattttctttagaaccatttttgttctggacaaaattcaagctggatattactgattactctgaaatgcaaatagtgctattttgttttacagctatcatttaaaaagccatgtactcattaagataaatatgtgcagcatgaacaacaaaaaaatgagaaagaaaatggacattatttgtattttgtaggctctctgatatggaactgaatgcactaatcttcaaatactaatgagcagcaaaaagcaatttgccagtgcacaattaacttctgactggcttctgttgatatgtagtgctataaccccacaccaggtgaacttcccattttttgagattttatttgaccagtatttataattgtggccaaataatgagatgattattatgaaataatgttatgttggagtaaatcatacttacatggagctcttattatagtttctctatttaattgtctgccaccagggccttgagcttttattttcctctttccccttctgctcttcttgccttttcccatcattgaagaaacaagggcctccctctcaattctcaatttggaaacctgctagtggcatgtcttagttacaaacactgtgttttatatcatgtggttatgttcgtcacttatctcttctttctgttaacttttattctattactgtgtcatgtcatttatatgtatgtacgtgtagatacatatacatgcatatatatttacattcagatatatatgcatcccccatgcatgcatacatatcatacagtagtggagaggaggttgtaaagcataaagtttacctgttttgctcatggtttattgaggcagattttgtcccttagctcagatgagaaaatccctactccacagtcataagctgaaattctcaatccagccagatattttgcaaatgtgcctctggtgcctggggagattgagttaaagcatatatggctcagtgagaccaatcattgtgattggcaaatgaactcaaaacactatcttagtaatgttaaggcagttgggaattttatttccacaacatgcaaactaatactctgaatgagtagcagattggaatatggtaggaaactttgaaattgtgattctcaaataatttagcctaatgcttgtttcatagaattatgaaatcttgtttattgtaaggaaccttagaggatcatctaatttaatcactttttctaatgcagcggcacgttgtataatacccctgagaggtaaatgtccaatgacatggaattccttactttgtctgggctcctgctgcattgaaaatatattctttgtacttggctggatgcggtggctcacgcatgtaatcccagcactttgggaggccgaggcaggtggatcatttgaggtcagaaatttgagaccagcctgaccaacatggtgaaaccctgtctctactaaaaatatttaaaaaaacaaaaaaaaagaaaaaatgacccaggattataggcacccgtcaccaatcccagctactcatgaggctgaggcacgagaatcgcctgaacccaagagacagagattgcagtgagccaaaattgcaccactgcactctgggagacagagtgagaccctgtctcaaaaaaaaaaaaaaatatatatatatatatgtgtatatatatatatgtatatatatatgtgtgtatatatatatgtatatatatatgtatatatatatgtgtatatatatatatatgtatatannnnnnnnnnnnnnnnnnnnnnnnnnnnnnnnnnnnnnnnnnnnnnnnnnnnnnnnnnnnnnnnnnnnnnnnnntatgtgtatatatatatgtgtgtgtatatatatatatatacacatatatatatatatatatatatatatatatatatatatatatatatctcacttcttcatactgaattgagatctgtcctcctgtcagctctcactcagttccaccatgggggcaatacagaatctgagatttatctcttcctcatgacagttatttaaatatttgaagcactttccattttgtttacttttctaaagtacttttctatggtacctatgcatactttgttaaccatttcttgattgctgactcctccagaatgttggttattctctcttacttattataatttgtcaatgccccttctaaaatgtcatatgttatttaacctaatgcttcaaataaagttttacctttgcatgatacaattgaacaatgccttatacattgtaggttcaaaggtcaaatctttgaagtataggttcccatcctaaattattgatgacagttttttagcttttatagtaattgcatcttgctgtgaatgcatgttgactctgtggtcaacgaaaaacctcattcctttttttcttttatttttataaacacaaactgcagtcaagttagattatcccaaatcccggacctatataaatgatttaaaaaaaactaattgtaagattttcatttatccctgataaatttaatttttgtttggtttcagttcagcactgctacccattacaaaattttgaatcctgactctatcatctagcatattcgcagtccctttgggttttgtgtcatttgtaaatttaacaagtataccttcaaacagcttcttttaagtcactgatttttttgaaaaaggaacaagaaatgcctgcaactaactaccataaacctcctactggttgacaccaatctaattattaatagccttttaatttaatttttaaaccaaattaaaatctacccacctgtactaatatccagttcttatgcgtgttcctttcccacaatggtatccacagagaatttacccaaaataaaaatatgttatgcatttactttccagttgattttctctaagaaacagttgccagtagtttggcatcagttattttacataatccatgctacttcttgatttttagcatgatgatttataaatttatgaagactttgggcatacccaagcatgaggcagagttgggagtgcttcattttctttaacacaattgagaaaagttgatatttttatcaagacatttgttaaggaagaaacagggaaggtataagaaatctaaataaactggcttgcatactacaggattctaatctccctctagctaatgcagcctacagggcctagcccattccacatagagacctatggaaagtgaggggctttgccttgactcctcatttccactattttggtctgcttccatgttttgagtgtcatttgatacacatcatccaagataatcagtctggattttatgactgttgaatatagtacaagaaaagttatgtccttttgcctgtttacgtaaggaccactctcttaattcctgtttctagaatgaaagaaatgccttttctcaagttgattgttaccaggaatgacttcatattgtttgcgagattccactctatccatatgcttgtggccttttcccatacagagtcaatagtatagtaacttaatacaacctactatcatggaattcatttagtaggaattatcagtttgtaataacagggaatatgggcacaaattgccacttattctggagaaagtgatgagaatgtattagaggaaggagtagggatttagggattgaagactaattaagtagcctttttttttttttttttttttttgcaactgtctctctctgttgcccaggctggagtgcagtggtgctcactgcaacctctgtctcccgggttcaagtgattctccaacctcaacctccctagtagctgagacaacaggagtacaccaccatgcccagctaatttttgtatttttagtagagacaaggtttcaccatgtttgtcagactggtcttgaactcctggcctcaagtgatctgcctgcctcggcctcccaaagtgctgggattacaggcgtgagccaccatgcctggcctaagtacctatattatcttccatatgaaatgtgatgagtaccttaactagtttgtagcaatgtgattgaattatagacagttcgctggtaaaaataggcaaatgataaaatataagagactggggaatataataatcaatataagtaaggagtttttggaaatcaaaaattaagagaactaaagtgtttgtgttacacttgggatcatataaacagaatgctaatgaatgaattgtaggtttttaagggttattttccaaacttagcaaggtaattaacatatcatgctaatacaaatattaatagaaatatagatatactttgagcagcctgcagcctacacctactttcctagagctattgaggttggagagcaaggtgaaaatgatgggtttagatttagttctggattactctgggtgaagattttaagcatgtagttagaagttttacctggagagatatttggaagttgccaaaaagataataggtaaattcaaagaaaagtctttggagtagaagacgaagattgcagataaaatcttagagaataatgcctacctttaggatggaggttgaaaagaacttgccaagaaagagttacaaaagaaaaggaggataaccaaaatctgtgctttatctcaggagccaagagaagaaagcatttttagaatactagggagtaaaacaacaccatcagtgtccacagagaaattgagaagaataagctgctatcaggcctttaagtttggtggtgacatagttatggagatatttcatagaagaggttgaggagactgggaaaggtagattggaagggctcacttaatagaagcagtagtggaggaagcagaagcaatggaccgtccaatacgaatagtcatgaaggtaaggaaagagctttactgtttcttcttcccatttaactgatagctcagtagataaaaaaggagaacaagataaacttatttgttgaaaaattactagaagtttgttatattgtttaaattgatttcaacttcagactgtttaataataagtacatagtttaaccaccataggaatgaatttgagttctttgctctgtataactttaataacagacagatgttagtctttcagcaaagaaacaaaggttgttccctaaattactttagatttacaatgcaatagagcattttaattacattcatatgtgcagacttttaaaaaataatttttaaatggtttattatggtaatagaagcacatttatgccacatcatgcaacacggaaagcatattctctctgttgagtggtgtaaaatgtttgtggcttttgcatctcacatttcttgctttagaagtgctactgtcatttacattctctagtaatccaattgtgaattttatggatatatatgagcatgtgaggacagggtgccagtggaaagctaagaaaaggagaaaggtaaataacagccagagaagttggcaagattactttttcttcaccgtgccaagacagctattttagctgaaaatgaggaggatgggaggtgcacaggaatttagttagatatagaaagagaaaagctgggcaaataattcaggtatgtaagcaagttcaagagatgaatgaagacattattctgatgtctgaagagcggaggttaaaggaaaggttgactaaccaaaaagccttatgtgaacccagggtaatcaataactgcgcttgattagaggtcttgtagcagtggtatatagaagaacagaagaaagatgtggcccccaaggtcgtatttaccagagagaacagtctgagaaacaagccacaaaagaattggtctatgaagcttttctcagaatcagtcgtccccccccctccctccctcccaccctccctcttcccttgctaagtaatggctggacactacagaagtactgtatattcctgggtttatcttaggatatggatagtgaattacaaatgatattttaacccatctattgccattgatatgtaaaaccattttctttattaaaaattgccaatccctatgtccaatattataaaattaatgtctctactaaatgaagaaaaaggttaaaaaataagaagcaatttttaaaaaatccctctttttgcctagccaaaaagaaaaagaaaacaaaaagtgagtaggatttattgtgagaaaatgtaacctttaaagctggcatgctgtttgagttacctgcctctgaagggcaaggccctagagagatgcttaactaggcaggtatgatgattgcagtgcccttagggcaagagcaaaggcagagattgtcaacacataggcaataaaggctgcctactcaaactctgggcactcttacttggcttgttaagttgtatcctacgtgcatgagtgttttggctcaggagaaaaactctagtgctattagaaaatgtctctttcacatagacagtatcaaaacggctttattagtcttaaataatgaaaaagtagcagaaacagatttagaatttaatctcttggtttctaggtttctcgtcacttgcttcaccactgatgatctgctctgtttttcaaccaaattctttgtgaattcatggcattggtagccccattctttgtgtttgtacaatgcactagtctccagagtgtgcattccttgaatgatagaggtttttagttatagtggcatgggccatcactagggtagatgaacagatttgtgattctaggatattacgccagtccagattgggaaaagttttcaaaggtttaaaggtttttctgcgggctgcctttgtttcagcagagtggagagaatttaaaaacatgtacccttaataggaccaatagagtttaaactatatattgtgtaacttttagaaacttttcaaagtacatatcttagcaacttcagaaggatgacataagggtcagcctcactggggatgctgtcccatgttgctccttagttagcaagacattgtaaatcggccaggcatggtggctcacgcctgtaatcccggcactttgggaggctgaggtgggtggatcacgagttcaggagttcaagaccagcctggccaacatggtgaaaccccatctctactgaaaatacaaaaattagccaggtatggtgtcaggcgcctgtaatccctgctgaggcagagaatttcttgaacccgggaggcggaggttgcagtgagctgagatcatgccactgtactctagcctgggtgacagagtgagactccatttcaaaaaaaaaaaaaaaaaaaattcataggtactggactctagaaggtgaatcactgccagtccttcccccagttcattatctgaagtcacaaggcaaagttctttctcctaatcccataaagtcctcgtcctttccccacctaattctgtgtgcagtagccccctctttcaaatgctaagtggacctgactctcatacagagaaataaaaacgggctgggtgcagtggttcacgcctgtaatcccagcactttgagaggcccaggcaggcggatcacctgaggtcaggagttcaagaccattctgaccaacctggtgaaaccctgtcgttactaaaaatacaaaattagctgggcttggtggctcatgactgtaatcccagctacttgggaggctgaggcaggagaatcgcttgaacctgggaggcagaggttgccgtgagccaagatcatgccattgcactccagcctgggcaacaagagggaaactctctcaaaaaaaaaaagaaaaaaaaaagaaaaatgtattgcttcttggccttttggctaagatcaagtgtagaaataaaaaattacacatttgttggatttgttccttcagagttcttccttttaaaatctctagtgggatagatactgagaaagcattttgtatcttccctgggaagcaggcttaaggagagtagtctcactcttctctcagctctaggaaagtaggtgtaggctgcaggctgctcaaagtatatctatatttctattaatatttgtattagcatgatatgttaattaccttgctaagtttggaaaataacccttaaaaacctacaatgcattcattagcattctgtttatatgatccaaagtataacacaaacaagatactttttatactttagttcgcttaatttttgatttccataatatcgtcagtttatacttaaatcttagggagacaaggtagaagaaagaaaagtgactggatagcagcatgagctttgctgccctccaaataagtgctgaaaagatgagtatgagtctactctaatcatctcaaaaggaagcagtgaaaaactgaacattagcatgttcatgaacctaatagtaaaatggccacactgaaacaagaatttatcccagacaagactctttgccttaccacaatgaaaaataagtacttttgctgagtgcagtggctcacacctgtaatcccagcactttgggaggccaaggtgggcagatcacgaggtcaggagtttgagactagcctggccaacatagtgaaaccccttctctactaaaaatacaaaaattacctgggcatggtggctcgcacctgtaggtgctcgcagctacttgggaggctgaggcaggagaatcacttgaacccgtgaggcagaggttttggtgagccaagattgtgccactgcactccagcctgggcaagagagtgagactccgtctcaaaaaaaaaaaaaaaaaaaaagaaaagaaaagaaaagtactttttcaaaagtagaagttctctttatctctacccctaatgcccagtaatacccttaacactaatacctgctttttaaatccgtgcatatacctattttgtaaagcaagagagtatctaaataggagttgagccatagaatgtaagagctagatgcgcccttagattccatttgctaaaacactgttctgtgaaccagtgttaacctgtgaagttttcatcagcctgtaaatgataatttaaaacacacagaaatttaagctcaatgtattcagtataaagaactactcctttattctgagattatttcttttacatattttttcatgataaaatatcctacttttatgagatgacggtgatgatagatggtaggaattttcctcttaaaataatagcctaatttggcagtataaaaagtgcctcccgattttttgcagtttctgaaaccctaacacctgagaacaactggtctagtttgatctccttatttcatatttgagaaaagtaaggcctaggagaagttaagagagttacttaagactcactactaagaaatcatggaattaaaactagaacctacacattcatattcctagtccacagctctgaataaagcaacaaattccctctctttttcctaaataatacattatttctttctttttctttttcttttcttttttttttttttttttgagacagggtctctctctgtcgcccaggctggagtgcagtggtgccatcttggcccactgcagcctcgacctcctgggctcaagcgattctcccacctcagcctccttagtagctgggaccacaggtgctcgccaccatgcctggctaattttttgcattttttgtagagattgggtttcaccatgttggccaggctggcctcaaactcctgagctcaagcaatcctcccgcctcagtctcccagtatattgggattacaggcataagccaccgtgcccagcccacatttctattcttaaattaacttgaactttgtcaattttatttttcttcttttaccagatttatacttcctatattttgatgtgccagtacttcattgggttaccttcattatgcagttaatttagtttctcaagcacattttaattattgatttctcttattttattaaagtgaattaaaggtacatttgtcttgccaaaaatttaaggccttttattgtccttgtactaagactaagttatctcccagttggtatcatttaataaagacattgattgcattctacttggttgcattctactggtgctggaaaagcgatttcattttctggtgaagtttatgctgacaagttgaatggaaaatatacttgtataatacttttaattacatgttatatgcatttatttattttgctctttagcaggattttagcatcctcacaaaatattatatgactcaaggaactacctactcactttgctttctctgctggaagtaggcaatcaagccaattggaaaatttaaatccgtggattatgggttctaatttctggcctataaataagttagttttgtcataatattatatatttgtataatactttatataataaacacttctttatttctttttggtattcagtgtatcttttacatacattgtcaggctttgttttttctgaaaacactgtgaggacatatttgctcactctcattttgtggatgacagactgaagctcagatgccttaagtaatgtgcccaaaacagcagaactagctaataagtcgcagagtcagatttagaacctcaggtcatatgactacaagtcttgcatttgctccatatctctgctctacggtaatgtttctctttgcatattagtattaaaaatggcttctcccttccctaccagataatggtatgattcttagtaaaacatcccatttccattttaatatcctagaaatttttttttttttttttgacggagtcttgctctgttgcccaggctggagtgcagtggcgtgatcttggctcactgcacgctccgcctcccgggttcaagccattctcctgcctcagcctcccgagtagctgggactacaggcacccgccaccaagcccggctaatttctttttgtatttttagtagagacggggtttcactgtgttagccaggatggtcttaatctcccgacctcgtgatccgcccaccttggcctcccaaagtgctgggattacaggcgtgaaccactgcacccggcccctagaaatattttcaaattgttgaatttgttttagtgatttcacctgtccagataacctaccttaaacatcatgatgagaggggaggggagaaaataaatagtattgttatagagtttaagctagaattaagtataaaatcataaacaattaaatgtgattaaatgaaccattttatagcttaacagtatacaggcacatattatttatgtcagcaagagaaagagcccacattattaggaaagcctattttttagatcattcaaaattgtttcctaaactgtataactaccttcctcaaggatggatttacttaatcaacagttctgtaataattggttaaaccatttggttggggagtatggtcccaaccttaccatattctaaaataaattttgtaatgattaaaaaagcaaaagctaataaaatgaatcaataaaggacaacaaaacctaggtggctattgtttagtcttaggatagggctgggcttactgagcatgaaagtttaggagaaaacctcatgtaaattttgatagatatgtgtcacttgatcaattccgtaatttaaaaaaagttataaacaaaattaaaaagtaaatgatatcttctaggagatagctgaaatatatataacatcaaaatatattgtataatcatacatttggggcatcataatgaatttttaattaaatattaaagtgtaacttcagcattgtcccttgaagtataattggaaattgccattgactagtctcactggtaaaatgagaaatgattaaaagtggatagattaggccaggcgcagtggctcatgcctgtaatcccagcactttgggaggctgaagcgggtagatcacttgaggtcaggagttcaagaccagcctggccaacatggtgaaaccccgtctctactaaaaatacaaaaattagctgggcatggtagtgcacacctgtaatctcagctactcaggaggctgagacaggagaatcgcttgaacctggggggtggaggttgcagtgagctgagatctcgccactgcactccagcctgggcgatagagcaagactccgtctcaaaaaaaaaaaaaaaaaaagtggatagattgctaataaatggaaagtaatacaaaaagtctaagcccgcactggcctaccatgttacaaatttttaatgttgaaatattctgttcgacatattaaaaaaataaaagggaagcaaataacattatgttgttaaaaaaaaaaaaagaagagtaagcatccatggggcagtagtaaacgtgattgttcatagagcagaaaagcttatcagtagctgggtagttaacttagaagcaaataaataaaaatgtgtgtgtaaagagaacacaagttaattatttgacatgatgccattgtttttcaaaataaaagcattctttgcaagatttaattgcaataaatgactaaaatcataactgtattttcaaatatgagaaaaatatgaaagaatatgacaatgatatcttcagaagctactaattattggaaacacatggggacaattacacaggctagcaaagctcggtagcttatcactggatccagaactcagaatcagagttgtagtgatacacatacacacacacatacatacacacacacacacacacacacacatgcacatacgtgtgtatagttttgttgtattgcagtatatagagaaagaacaataaaaagggatttttggtattatatcttacctttgctcattcagttccatgttactgccttcttatctgctctgaagccaagcaggatataacagaagattgtaggcattaggacatcatcagatgctaacagaaatttgttgatagaaaatatggttctagtggtataaaatccacaaaactaataacgggatttgtcatcaaatgttagtaaacacagaaatggtagagataccaggaaagaaataacatgaaatgcttcaattatgagctagtactggaagtttgttaaagaaaaaaagggaaaatgttcactctgacctttaccaacaatttctttctagattgaaatataggaaatgagccaggtatcactgtatagttattttaaacgcaatttctatattgagagtgtatatttgcagctggtacatatctgattttcgtttggaaaatgtaaatgaaaaagggtttttatttcttttttttcagttttttttttttttgagatggagttttgcttttgttgcccaggctggagtgcagtggtgtgattttggctcactgcaacctccgcctgccgggttcaagcgattttcctgcctcagcctcccaaatagctgagattacagacatgtgccaccacgcctgactaattttgtatttttagtggaaatggggtttcaccatgttggtcagactggtcttgaattcctgacctcaagtgatccacccgcctcagcctcccaaaatgctgggattacaggtgttaggaagttttgaggaaatacataaaaaacaataatgtgtaactggtaaaagaaaattaaatgaaaggtaaatacaagtgaaggccagttcttgttctgccattgcctggctgctgtactcactatactcatatactatctctattccctctcatgtgccaaaagaaaaatggtaacttaattcataaatttatagtgaggactaattgtgttccccatgagatgtgttctgagtcacatggaaggttatctgtacattcatgtacataagtatatacacatatagacacaaatcataaacagaacttcctaatactaaagaaattatgtgcttacattttctatatatgcctcattttaagaatagtgcaaattcgaatatcttaggaccataagaaggagaaacactgtgtgattcttcatctcatataaggtagagtgtaagttattcttataaacttccttcagacatctaacaatcgatcacatatgtaagaaatttagttagcctattttactggaagataattctatagtagttcctgagctatatctgcattttaaagtatatttactgtgccttgcttactatagatgacatttgtttcagttctcttgtttaccaggggcatggtagggtgatatttatatatttgatttgcagaattagtagcttcagcttaacaaatggctgctcttcagccttttcccaaggttaagtttgaagtgttcaggtcattttatgattttccttgaccacaaccacgttggctgtcaagggctaagattttactaatttgaccaggttgttctttaaaaaccagttattttaattcttttctctatttccccagccttgtgtatttccagttgagtaaaaataaatagaaaatgctattcagtattctaaagcaagccagttatgtttgcatcacttagacagctttataggactcagaaagagagactgtcagattcatgagagtcagctgaaaactatttgtttctttcaaaagacaaggggaatgaatgattctggtgcatgtctcatgaatgttgagaagctcatcttatggttaaaaagaaaaactcattagacgactctagagagatatataagaaacctaaggattctgttttatttacctaaaacgttcctggtcaaatcagtgaggtatactaacaacaacaacaaaatacacacacacacacacacacacacacacacacacacacatatgtgtatatacatatatatatacacgcatatgtgtgtatatatatattaatataaggaccatcagattttaatataccctttaagctaaacttgtccattgttacacgtggtcacagaagtttttctatgaaaacttacgaagtggatgaaactaggacttatttaatttgaatatgcatattatacatatataggcacaaatgtattttaatttgtacttaatgtatttgcaattataataaataaaagttcattcctatgtaaaatattatgaatttacagaattaccaacaatgccttaagtatattatttcttctgatcttttattccattaaaattataacatctttaagctaatgatccatgccagctactgcattttttatcagttagcacagtgctgactatagacaagtaagtacctgatgggtttaatcacatatattgaacttcaactacatagtttaagtagtgtggtcttctgttatcgtaaagtcacagtgattttccagcacattcatttgatattttcatccctgtcagctcacaaatcccctcatactttgacagcattatactttgttaagaaaggaaagcaggagatatcctttatatttcaaatatattaggttgacatgtgagccatggccaaacttgattaaaggtgaggggaagtgaatgtagaaagaagaattcacaagcagagaagtaagtgctttgggagggtggggtcagggcaggcagtggatgggaggaaaagcacctagccataagctaaggcatgtttcagaggaaggcagtgctgagtttttctcttaccctattttttataatctccccttataatagttagccaccctcaatctaagtaatcttcccataaggtggtttttttgaggattatattaacatatgtatatgtgtgtgtgtgtgtgtacgtgtgtgtatctgaacataaaaactgataatacatttcttataaaataacttgctttatcatgttgtatagcttaaattgcttttattccatatatgtgtatggaatatgtgtatacatgcatatgtacatgtacacatgtatatgtatatgtgtgtatctgtatctttttattaatatttgccaatggcataattctacactccagtctctcaagcaagcatttatgtaaagcttgatccagggatatttctttctttacatcatgttccttgcttctttgttgaagcaatttctatttttccttcttttctgatctcccgcaatgttctagttcttgtgaaatattagttttctcagcactgaagttgaaaactttccatataccaactgctgttttcagttctgatttcaaccagggcttggtggaggagtagggtagggaaacttcctgaaaccttgttgatattaatagcaacttaatcctttggcttctactcagatttcgatggactgtacattcatgctcttatctttgaatcatctgacactttttcagccatgaagaaatcagaatatttggtctgttgtatttcctttctaagtactttttaaaggttacctacttttaaaagagctagaccaagtatagtaaaagtatacaccttttcattttggggatggaggagccaagatggccaaatagaaacagctccagtctgcagctcccaacgagacaaatgcagaagggaggtacctagttgatctcattgggactgattagacagtgggtgcaacccaaagagagtgagcacaagcaggatggggcgtcgcttctcccaggaaggccaaggagccagggacctccctcccccagccaagggaagcagtgaggggctgtgctacccgccccagatactacgcttttcccacgaatttttgcaatctgcagatcaggagattccctcgtatgcctgcactaccagggccctgggtctcaagcacaaaactgggcagctgtttgggcaggcacccagctagctgcgggagttgtttttgtaccccggcggtgcctggaacaccagcgaaacaggagaaccatctactcccctggaaatgtggctgaagccagggagccaagtggtctcgctcagcaggtcccattcccacggagctcagcaagctaagaaccactggcttgacattctcgctgccagcacagcagtctggagtcgagctgggatgatcaagcttggtgatagggagggtcatccgccattactgaggttttagtaggtggttttcccctgacagtgctgagactgacaggtttggactgggcggaattcatcacagcgtggcaaagcggctgtggccagaatgcttctctagattcctactcaggggcggggcctctctgaaggaaatgccacagccccagtcaggggcttacagataaaactctcatcttcctgggacagagcacctgtggggaggggcagctgcaggcgcagcttcagtggacttaatctttcctgcctgccggcttcgaaggcagcagctgatcctgataagggggattcttccagcacagcgcaccagctctggtaaggctcagtctgcctcctcaggtgggtccatgacccccatgcctcctgactgggagagacctcccaacagggcttgacaaatatctcatacaggagagctccagctggcatcaggccggtgcccctctgggatgaaaattccagaggaaggagcagataacagtctttgctgttctgcagcctccactggtgatacccaggtgaacagggtctggagtggatctccagcaaactccagcagaactgcagaagagaggcctgttagaagaaaaactaacagaaagcaacaacagcatcaacaagaaagaccccccccccaaaaaaaaccccatccaaaggtcatcagcctcaaagatcaaaggtagataaatccatgaagatgaggaaaaaccagcgcaaaaactctgaaaattccaaacaccagaatgcctcttctcctccaaatgaacgcaacacctctccagccagggcacaaaactggacggaggatgagactgacgaattgacagaagtagactgcagaaggtgggcaataacaaacttctctgagctaaaggatcatgttctaacccaatgcagggaagctaagaaccttgataaaaggttagaggaactgctaactagaataaccagtttagagatgaacataaatgacctgatggagctgaaaaacacagcacaaaatctttatgaagcatacacaaggatcaatagctgaatcgatcaagcagaagaaaggatatcagagattgaagaccaccttgctgaaattaggtgtgcagacaagattggagaacatagaatgaaaaggaatgaacaaaccctccaagaaatgtggcattatgtgaaaagaccaactatgattgtttggtatacctgaaagtgatggggagaatggaaccaagttggaaaacacacttcaggatattatccaggagaacgtccccaacctagcaagacaggccaacattcaaattcaggaaatacagagaacaccactaagatactccatgagaaggtcaaccccaagacaaataatcatcagattctccaaggttgaaatgaaagaaaaactgttaagggcagccagagagaaaggttaggtcacctacaaagggaagcccatcagactaacagcagatctctctacaggaaccctacaagccagaaaagagtgggagccaatattcaacattcttaaagaattttcatcccagaatttcatatccagccaaactaagcttcataagcgaagtggaaataaaatcctttccagacaagcaaatgctgaggcattttgtcaccatcaggcctgcttttcaagagctcctgaaggaagcactaaatatagaaagggaaaactggtaccagccactacaaaaacgtaccaaaatataaagaccaatgacactatgaagaaactgcatcaactaatgtgcaaaataaccagctagcatcatgatgacaggatcaaattcacacaaaacagtattaaccttaaatgtaaatgggctaaatgccgcaattaaaagacacagacgggcaaattggataaagagtgaagacacatcagtgtgctgtattcaggagacccatctcacatgcaaagacacacataggctcaaaataaagggatggaggagtatttaccaagtaaatggaaagcaaaaaaataaaaaataaaaaataaatagcagggattgcaatcctagtctctgataaaacagacttttaaaccaacaaaggttaaaaaaggtaaaggagggtactacctaatggtatagagatcaatgcaacaagaagagctaactgtcctaaatacatatgcactcaatacaggagcaaccggactcatcaaacaagttctcagagacctataaagaaacttagactcacacacaatgatagtgggagactttaacaccccactgtcaatgtttgacagattaacaagacagaaaattaacaaggatattcaggactcaaactcagctctggatcaagtggacctaatagacatctacagaactcttgacaccaaatcaacagaatatacattcttctcagcacttattctaaaatggaccacataattggaagtaaaacactcctcagcaaatgcaaaacaatggaaatcataacaagtctctcagaccacagtgcaatcaaattagaactcaggattaagaaactcactcaaagtcacacgactacgtggaaatcgtacaacctcctcctgaatgacccctgggtatataacaaaatgaaggcagaaatcaagaagttctttgaaaccaatgagaacaaggagacagtgtaccagaatctctgggacacagctaaagcagtgttaatagggaactttatagcactaagtgcccacatcagaaagatgggaagatcccaaatcaaaaccctaacatcacaattaaaagaactagagaagcaagagcaaacaaattgaaaagctagcagaagacaagaaataactaagatgagagcagaaatgaaggagatagagacacgaaaaacccttcaaaaaaatcaatgaatccaggagctgattttttgaaaagattaacaaaatagatggactgctagccagactaataaagaagaaaagagagaagaatcaaatagacacaataaaaaaagataaaggcgatatcaccactggtcccacagaaatacaaactaccatcagagaatactgtaaacacctctacacaaataaactagaaaatctagaagaaatagataagttcctggacacatacaccctcccaagactaaaccaggaagaagtcgaatccctgaatagaccaataccaagttctgaaattgaggcagtaattaatagcataccaaccaaaaaagccccaaaccagatggattcacagctgaattctaccagaggtacaaagaggagccggtaccattccttctgaaactattccagacaactgaaaaagagggactcctccctaactcatattatgaggccagcacgatcctgataccaaaatgtggcagagacacaacaaaaaaaaggaaacttcaggccaatatccctaatgaacatcaatgcagaaatcctcaataacatattggtaaactgaatccagcagcacatgaaaaagcttatctaccacgatcaagttggcttcatccctgggatgcaaggctggttcaatatatgcaaatcaataaacataatccatcacaaaaatagaaccaatgacaaaagccacatgatcatctcaatagatgcagaaaaggccttcaataaaattcaacgtcatttcatgttaaaaactctcaataaactaggcattgattgaacatatcacaaaatagtaagagctaattatgacaaacccatagccaatatcatactgaatgggcaatagctggaagcattctttttgaaaacctgcacaagacaaggatggcctctctcaccactcctattcgacatagtattggaagttctggccagggcaatcaggcaggagaaagaaataaagggtattcacataggaagagaggaagtcaaattgtctttgtttgcagatgacatgattctatttagaaaaccccatcgtctcagccccaaaactccttaagctgataaacaacttcagcaaagtctcaggatacaaaatcaatgtgcaaaaatcacaagcatttctatacagcaataatagacacacagagagccaaatcatgaatgaactcatattcacaattgctacaaagataataaaatacccaggaatacaacttacaaggaatgtgaaagacgtcttcaaggagaactacaaaccactgctcaaggaaatgagagaagacacaaacaaatgggaaaacagcccatgctcatggataggaagaatcaatattgtcaaaatggccatactgcccaaagtaatgtatggattcagtgctattcccatcaagctaccattgactttcttcacagagttggaaaaaaactactttaaatttcatatggaaccaaaaaagatcctgtatagccaagacaatcctgagcaaaaagaacaaagctggaggcatcacactacctgactttaaactatactacaaggctgtagtaaccaaaacagcatggtacttgtaccaaaacagacatatagaccaatggagcagaacagagacctcacagtgtaaccccacacatctaaaaccatctgatcttcaacaaaactgacaaaaaaaaagcaatggggaaatgattccctatttaataaatgatgcttggaaaactggctagccatatgcagaaaacagaaactggaccccttccttacaccttatacaaaaattaactcaagatgtattaaagacttaaatgtaaatcccaaaaccataaaaactgtagaagaaaacctaagcaataccattcaggacataggcatgggcaaagacttcctgactaaactgccaaaagcgatggcaacaaaagccaaaattgacaaatgggatctaattaaacaaagagcttctgcacagcaaaagaaactagcatcagagtgaataggcaacctacagaatggaagaatatttttgcattctacccatctgacaaaggtctaatatccagaatctacaaggaacttaagcatatttacaagaaaaaaaaaatcaaaaagtaggcaaaggatatgaacagacctttctcaaaagaaatgtggccaacagatacatgaaataaagctcatcataactggtcattagagaaatgcaaaaccacaatgagataccatctcatgccagtcagaatgatgattatttaaaagtcagcaaacaatagatgctggtgaggctgtggagaaataggaattattttacactattggtgggagtgtaaattagttcaaccattgtggaagacagtgtggcgattcctcaaggatccagaaccagaaataccatttgacccagcaatctcattactgggtatacacccaaaggattataaatcattctattataaagacacatgcacaggtatgtttattgcagcactatttacaatagcaaagacctggaaccaacccaaatgcccatcaatgatagaatggataaagaaaatgtgacacatttccaccacagaatactatacagccataaaaaagaatgagatcatgtcctttgcagggacatgaatgaagctgtaagccatcattctcagcaaactaacacaggaacagaaaaccaaacaccacatgttctcactcataagtgagagttgaacaatgagaacacatggatacagggaggggaccaacacacactaggacctgtcatggggtcggagtcaaggggagggagagcattaggacaaatacctaatgcatgcagggcataaaacctagatgatgggttgatgagtgcagcaaaccaccatggcacatgtatacctatgtgacaaacctgcacattctgcacatgtatcctggaacttaaagtaaaaacaaaaataaaaaaaattaaaaatgaaagtatacacctttttatcagcattctttaactctgtctcttccaagctacttctaaaaatgacatgttgtaaaaagaccaatttatttaaatattggaatgattgtgaatatagttatcatgaggtcctaaaatgctgtttcattttgattgtggaggttagtagggaaaatggatacttatgtcataggatcttttacgttgaaagacttggatcatacatgaaaacatatatagaggcatacataatgcatataatcagatgatcaatttataatatccttatatcttagccatatctattgtaatgctgaatgataattaaacattcatttagcatttgacacatcttacgctctgctgaggttatgctaaaagaaattttttttaaattgatgaagatagtatgtttgacagaaaaaaatcaatatgagtgtacctatcaaggggcaggcaatgcttttaaaatgctgtgggtcaggaacactcaggcgtatatacttgtgacatattaaaagcatcctttccagtaataatatcgtttggcagaattattttaatggcctgtgatcctgattctataattctattaccaattaccttgactctgctttcaaaagatgctttaagttttagattctggtattctgatctcagtatctcgtagtgacctcctgttatctactcacttgctactgccagtgtcatggaccatgaattgaacctactgttatcttatggaattttggcactctttctaatcaatcctttgtcatgctaacagtatctttattgttgtttttggctaaattaatagctaaactaggtatttgcatgttttgtctaatcgcttatgaagaaagtactttaccaatattgtgaaaaatgttaccagtcgtatagctttaatgccatgtaacaatgtttacagcgttcaattgaagcactttaatattttaaaaccaagttagattgaaagtactcattcagcaagcattttagggattttatggacatcttttaagatcgtctgtgggacgtttgtaacaacagtaatcgcaagaatggcgatgatgatgatgatgatggcagctcacatttattaagctcatagtatatgtcagactctattctaaggactttatatgaattaattcatttaatctttaccagaaccttatgaggtaagaaccatccaattttagagatgtaaatactgaggtactaagcagttaagtgacacgcccaaagttagaaaactaggaagtgtcagagccaaaattggacccccactttttttcatgcctctgattgagatagtaagattttgtcttaccttctgcccagtatttgattaataaaccttatggagcttcacaaaagtaatattttcattaagtgttgcttgtcagtcatgatccatatatgcagaggactaaagagtgtgcaatgatgattgatttttgtactgaaattctttcttttattttgtcaaatgaagaaatttgtcacaagagtgaaccggggccaggtgcagcagctcgcgcctataatcccagcactttggaatgccatggtgggtggatcacgaggtcaggagttcgagaccagcctggccaacatggtgaaaccctgtctctactaaaaatagaaaaatttcccaggcatggtggagcacatctcaggaggctgaggcaagagagtcacttgaacctgggaggcagaggttgcagtgagctgagatcatgccattgcactccagcttcagtgacatagtgagactctgtctcccccctgcaagaaagaaaagtgaatcagcatggaaatgaaaacgttctagtgtcttttcttgtaattattttttatatccatccatccatctggaattcactgtgtgtccaatactgtaataagtgataagaatataatagtaaacaagacatggtccctttttcaaaaaacataattgaactcaggaagagaatagaaacccatttatccttgttgattatatattcacctacctgaaggcagattaactctgaaggagtcaaccagttctgcaatttagattgtaagaataaattttgcttcaaaatagaatttaatttgcttaatttgtttcagtctgttttcagattaacttggatctaattaatgcattagctactattagataaggagtgcttttctgtgttcgctacttttgccaaaagggaatgactgacaaaatcctatataaatttaaggtagaaaatagtctattttctgtggcaatatatatttagaaaggaatgtatagactttctgggtgttttgagataataaaatattctaacaaatgttcttacaaaaaatatcttttgagtaggatgctcattctgttggcccagaattaagtggactattatgtaagcctttgcattatttcaatttttatcacttattttttaaacaacattaaggcaacaaaaggatgtttctgatatccctctcccagtaatgtaaggcagcggtgaggggtttttttttggtcattattttaaggttcttttccccagtctttatcaataggtaatgtttataggtcttcatttgcatttattacccttaactttttaaagtatgatactctttctatgttgctacccttactacataatcatttctaattattatgtaatcctgactcaaattgatgtaccaaaatcatcaatcagtcttctatagagcacagagacctcaaacctttcattattaaacataacttaacattttctgtcttcatgtatctttttatctcctccctttgattatttccttttagatgtaccaagatctgtaaacatttttctactcttcaattttctagaaaaattgttttccaggaagattgtatcaatgtatacaatcatcaggaataaataagcatatgagtttcatcacagcctcaaaaacagtagttttatgtattttatgttactttgacttccaaagagggatagcaagaactgctcataaaaacaagcaaatgcccaaattcaataaaatataaaagtaaaaatgagacattttaaaaaattgtgccaatacatataaagtggtaagctttttgttataacttaaattcctatgactctgaatgaaaaatattttccttttttaattaactttgtcacttcatttgtgaatcgacttcatatgtccttcgtctattgattaagatcaaattttaaccctttatgtagcttgaattctttatataacaaatatttgttgcaaatgttttcctattctgtttattttaattacagttaattataattatcaagaattataactatgacttgatatgtttgtatgttgaaatagtaaggtacttattctcacttaatttttaagtgaactaattgttttggaatcatatatattaattgagtctatcagaactgatactctatactaactgcattttattgttaggaccatttataatcctcttcttaatgattttaacggaaatcacttcttttttttatatttataagcatttagtatattaatctgaatgatgaatacaaattctttattattctgtataccttttgcacatctgaaacatagtattataaaataaaaccttagctttcaaagtcattgtctctgttaagggcttgacaatccaaatttggaggtcaacaaataagcattgacttttcactcttctttgtaattatactataataatctcaatttatgtcaaggaagtgtggatgactctaacttttggaaaaacaaattaccaggtagtataaagtgtgcaaaagaaaaacagattaatgtttcaagatattatttgacctcttttacacatcccttactactgttgacacacttgactttgatatatttcttaaatctttctttcagaagtaatcaagttatttaagaggaaacctttcgatgatagtgtttgttatctctgtgttcatctatttatcaggaaatcacttcttaattagtatagcttttagtatatcttttggacatgtcacctttattttcatttctgttataggaaaatgtcttgagttaagtacatacccgaagctagaaatgtctccatttaaaaaatgtattctctattttgttttatccagcattgtattttccctggctttgttcattctgctgtttcacaaacactgtgtgtttttatgtggttataacaatgatgagacattgacttatggaattaacatagacacatggaaaatattttatggtactgacataaaaagaaaccagttctgggccatgattgagaccgggagctactgaggttcaacagtttctattccacagagtgccattttgtcccaaatgattgatgacattctcttgccctattctccacagattataagaacactgttgcaatctagagcttctgtagatacccgcttcattaagcatgatcccaaaatgtcatttaatttatttcttagattgaatgtctcattaaactttgatgaggccaggagctactttgggctggacttgttatgaagcactcttatcttaaaattttgttctgtccctgttggcaaaggaaatggacatgacagtgaaatcaatgcacagtgcactttatctttgacaaactgaaatattgttttgctaaaataggcccatggggtagggagattaaaatcacacataaagtagatcagcataaagagtaaatatacaaacttatacagtctttggtgtaattttattttgtttaaactgactttgccccatttggacaaacataacacatctacttgattaaacaaggtactgatctccctcagcctcatttgaaaagaaacattttcttctttttagttataagaagtgaatatatataagatgaagtcagggcatgagtaatgttctatcagtttttagtaagaggtatgtctcaatagttgtgttactcaccttgtggaataggttgtgtcaaaacaagaaaaaaaaaactaatagtatttgtattttccctttggtgtccattgtagaatcaggagcatagtcatagattggtataggcgggaggtggagaaaagcaggtgattccttcagtagaccaaagtgaaaacaacattccttgcaaaaaaggaatttagacattggccagccctaggtcatgctgggcattggagtataattttttgatgcttccttaggtttggaatcaccatcttgcaactgatttttctctcatggctcctgcatcctgccatgttgccacactgcacacttagaacatgagttccacccctgtgtatgcttcccttgattccacaccagaatttgccagctcttctttgatctttcctgagtctttatacagcatattaaagagctgctctgcagtctaactctgaaaatcagtagtgtcatctagcatattttatactgttgcctaagatgtcttgggttcgaaggttctcactttgttaactgccagtttgctacctaatcaaatttgcaactttgaagattgcccttgtgtacagggttaatgtcagatttttagtattaaaaagaaacgactaagaaaatcacaaaacagatacctataataaaacaattgtcctaaaggattatcagcctacctccatgtctgataacagggcaagaaaagaaaatctgagaccatttcaatatgtattttgctaatatcttgagattccacctttccatggaatgataaattttagttctaaaatcatttagaattattaatgttatttgagacaatatggtatgctcttctttattgtgccttctattgaaaataaaatatcccttcagcatctaaaatgtcacttgaattaacactgtgcaatagcaataggagtagataaaactgtcagaaaatgactgggcaatgagacaattattgcagtttattttatcaatctttatttcagagcatgtaaaagtaagtaatgattttgagtctccattttgtgggttatttgagaaaaagatatgttagaacctttcggtttgtgtttttggtataatcataagctgcatgatttgcaatgcctgattttggttctaccttgtttaaatagcttagtttatattatattaattttaatgtagcctcaaccaagatcctattcttacctttctcactaaaaaactgtatagtattaaataatgtgaatcttagggttttttgttttttttttttttttttcaaattgtggttgctaaaagatacaagcagtgttgggtgagtcaggtcatccatgggatttagtcatagaaggacctgatttttatttcttcctctgcaagtaaccagttatgtgatattagacatgtttataacttcttgagacattagtctcctcccataaaataactgtaattgtcaaaattgttctatttagggtgttgctaaaattaaatgaggcaatctgcataaaaaccgtgctttttgcatactcaggagtatgtgatttatcacatttatgtagcttttaaaatttgtatgtaagaagtcattggttaaatagttgaagttttggatatttttatcattatacaatcattattatggtttaattttgtatatatgctttaaaggaatggatgatatgtgtagaaaatgcagtttcagtttgtggaacttagaattgtttttaaaatgtggaattcacatgaagatttgataatagatcaatgttctgttctctgtagaaattacatcattatagggaaaggaattgcacttgtttttgttgtttgagtatatgaactttaacaaggcaacctgagactaatttctaagatatgagatgaaaatgtgttaaaataatagacatatttcagactctgacttcagttgaaaacatagatcccatttttatttctccaaaccagaggaggaaagactgcttctttcctatttttttccctttctatgctattcatcatagcctcttaaaaatgcttctgttttcacttgttcccagattaagaaatgtgttttcattgaaatgttaaaatatgcagtgtgtcacattttgggttaatatcatcaagacaaacaactaagccagttctttatttcctgtcaaattgctgttagttaccaaagccaactaaatactattatatgtcatgttttagaattgtgctttgctttatcagatactaagatgcagcatactggtttgcatctcttagcaatgtttccaaaaccgtaactgtattaaatattagtaaagggctgaatgtacttaagcaatatacaaatgtactcttgatttactgtagagaataattttgttaaaatggttgtattttcatttttatagattcaatagataaacagttattaagcatctatatatcagacactttgagagtacagataattttgtgtagtacctgccattcagtatcctacacatagtaagggaaacagaaatctgaagaagtaaattaccatatagcatattcactcatattaatattaacctcagtgctatggagtacagtggacatagcaaccacctctgcctgttcaagtccaggaaatctttactgagcagctggttttaatcttgatctttgaggatgagtaggaaattgcccagtaaaaaagaaagtgtaagggcggggaattgcatgtgcagaaaattggagtaatgaaaggaccctaacatccatatactagggagtagctagttataggggcataaaatcaaatcgctgctacttgataacttgaagaccaatcttctgttctgacattccatagatcaaacttatataattgtctaatttgaaattgtacaattgtataatttgaaaacgacatgttttcagtgaaaagtaagaacaaaaactatttgttttatctgtgtgtgcatgtgtgtatagtgttaaaagttgtaatgtcaacaggtcatggtggcacgcacctctactcccacctactcaggaggctaaggcaggaagactgcctgcgcccaggagtttgaggccacagtgagctacaattgtgacactgtactctagcctggacaagagatctcatctctaaaaattaaagaaaaaaaaaaaagttgtaatgtcttcatatttaaaattttcttagaaatttcctttaaaaaaaaaatgggtcctggctgggcacggtggctcatgccctgtaatcccagcacttttggaggccgaagtgggtggatcacctgaggtcgggagttcaagaccaacctgaccaacatggagaaaccctgtctctactaaaaatacaaaattaggcgggcagggttgcgcatgcctgtaatcccagctactcaggaggctgaggcaggagaattgcttaaacccaggaagcggaggttggggtaagctgagatcgcaccattgtgctccagcctgggcaacaagagcaaaactccgtctcaaattaaaaaaaaaaaaaaaaaaaaaaaaatcctaaattttaaaatgacgattataaacttgagtattgattttctgttttccttgagttagacagagtttttttctgacaataataggtacagtttagataagaaatgcttaacttagtcaaattttagtaatttcagtaatgaaaatgatggagttggtttagtctcctataatcttgcttaagaaaaaaatcccctggtattcagtttatatatagcatgcaatctagatgaataggtttaggttttgtttggtttttaataacaacatgcataaaggaaatataatgatctcatcaaatctgtctccttctgagagacagtagcctactggtctgcctctcaggatccttctaatatagttttcttggatattaggtggttttgtttcattgaatctcagcagtttattgctttagaggctttttactgagttgggtcaacattccacattgaggagatttttctttctaatgcaagaattcaactgttattaacagtggtatgaatcattcatgtacactaagaaggaaataggttccagttgtttcaaaaactgttaatttctagttctaaccatcggtagctttgtgaagtgaatcatatcactgtctgtggaaaagagaaatgggaattaagttatttgctcaccatcagccatgtcattattgaagatgaaagctaaggagataaatcctccactcagttttctgtcatttatccaataggtcttcatatgcccctttagccatgagactgcaaggtggtgtgggaacctccgtactttatattaaagtctgttagagaaataatgggagtttggctacttgtttgtgccattaagacactgctaccctctgctgcctaagttaattacattccagtagtgggaaaaaaatgcatttgcctatatagacaccaatggaaataaacatatcgttcatacacttacagagaatgtacgtgtactgttgagagtgaggaaaaattgtagtttatagctgacatactttaaaatgctttgtttctaaagatgcaagtgcgaaattgatccaatatgttcagcaatcaaatattgagatcaaaattgctctatttcctttattcgtgtgtccgttaacaaccctttctgataatgtcagagacttattcaccggcctcaactgccgaaagaattttaaactaacagccgatgtatcagtctaaggactggtagatttacttgagaaatgttatgtatggtgtttcttagctataaaaaactatgtatcctgttatgtaaatacagatactattgaggcctttgaggcctcaattaatgaatcttctgtgggaaacatcttttaaaatgatggtgactgttgaagatatttcttatacaaaggagtgtcatatggattatacgtaaaattgttaactcatactacacattttcttcgtttttattcttcattatttttgagacagtgtctctgtctgttgcccaggctggagtacagtggtgtgatcacagctcactgtagcctcaacctcctggactcaagggatcctcccacctcaacctcctgagtagctaggaccagagatgtgcaccaccatgcctggctaatttttttttttttttgtagaaactgggtctccctatgttgcccaggctggtctcgagttcctgggctcaagtgatcttcccgccttggcctcccaaagtgttgagattacaggcatgagccacagcactgggccatattttctttaagaaagcagtatatttttgttaagagaagaagggggtatataggaaagaagaatcagcatgtaacatttgtatgatcctgacagaagaattacgtgatataggtaaaatatacccatccattaagccccttctcaaatgctggcccttcattggcaatactcctagtgggggcaacagtattttcttttgaaatgtcaaacacttttattgtaattctgctgtggcacttatcgattttccgccttgaactatttgtttgcttgccttgtctcaactactgtattagagtctaatttcaggaaggaggaatgtggagagatgtaggacagaaacttctgccatacctaacatagtatttctgtcacatagtaaacacttagtactatgtatggaattgaatttaataatattaattggtttagcatgaaaaaaattatgctatagtgtgagttaaagaagctaagaaggacagaaataaaatagaaggagaaatatatttgatgctggtcttccaagttgcaataaaaagagctgaaattatgcccatcaccattaccttccctgtgccactcttgtgtttatcagtacagagggtcaaggccacatttaaaactatgggactgttgcgtctcacttcaaattcatctggtttccttgggccgaatgggaaagattggtagtttaactcactgtcatacaaactccaacccctacttaattccgttggtcccctgctttggaagctcacctgctgcagtaagaaaggaaaaactgtgcctctgttccccagttttttgtagatacttaacctgccaccctcatgatcacattctaaagctgttctgctggcagtcctcatgttctgctctgaatctgccagcttcatcactcccattacactctcccatgtttcagaaagccactattctgtccatgccctgagggaaggagagtttttttcccatcattttattcttgtccccaaataatcaaatatttcctcacaatttcacataggtattcattcatacattttagaaatttaaaggccgggcgtgttggctcacgcctgtaatcccagaactttgggaggcagaggcaggcggatcacgaggtcaagagttcaagaccagcctgaccaatatggtgaaaccccgtctctaccaaaaatacaaaaattagctaggcatggtggcaagcgcctgtagtcccagctactcgggaggctgaggcagaagaatcgcttgaacccaggaagcagaggttgcagtgagccgagatcgtgccactgcattccagcctgggcaacagagcgatatgccatctcagaaagaaaaagaaagaaagtaacaacgcaaacttattttttgaaaaagaaatttagaatttcttaaaatttaaagccaagacatgctctaggaatacaaagaagagaactcctaatttctcctgtgaaaatttaggacatgcttttctttttttttttttgagacaagagtctcgctctgtcacccaggctggagtgcaatggagcaatctcgtctcactgcaacctccgcctcccaggttcaagctattctcctgcctcagcctcccaggtggctgggattacaggtgcctgccaccacacacagctaatatttgtatttttagtagagacagggtttcaccatgttgaccagactggtcccaaactcctgacctcaggtgatctgcctgcctcggcctcccaaagtgctgggattataggcatgagccaccgcgcccagccaggacatgcttttcatgtgagatgacatttgagctggttttggaaagtaacactataaaatgcacatgtaatgaacacatatgtaacaagttattggaatgatcttagttgttactgagaaatctcaattatatgcattttattcaactgatttttattaattttagcatcttgatctagtaggaaaaatcaaatactgcctgctaatacaagaaaaaaaaaatcaaaccaaatacagttgtccttttgtatccttggaggaactggttctataactgctggagataccaaaatttgcagatgctcaagtcctgatataaaatggcctaatatttgcatacaatctaagcatatcctcctgtatactttcgacatctgtaggttacttatgatacctaatgcaatgtaaatgccatgtaaatagttgttatattgagttttaaaaatgtgtattattttttattgttttgttatttttattgattttcaaaaatatttttgatctgcagttgtttgaatccatggatatggaacccatggatacagaggcctgaatgtagatattctaacagtaaattttcttatctgtgagatactataactcatacttaaaacaataagttatctgggcccttacaaatacagacctctggtagagagtctttagagaaattattaaaccttcatataatttgttgagtgtaccatgaatatgttttgtgtgtatgaaattagcagagtagcataggctacgttgtggatgaaaaatgttttatgtgcttagcacattcctctgaaagcaagtcatggagaaagaaatataattatttcaatagaaaaaatttaaaactctgctatattttaatattttagtgatttatatgatataagcatacatgcacttacgattttgcttttttatttcttttcacaagattgagaaaatggagcaacacttcactatttttcttatagggataatatgggcaaattaaatgtaaattgttgactctgaagtgaggggattatttttgttgctgtttcagggaaaacataaataaaagaaagtgaatagatgttatttcctactttagaaagtttgaaaagtaaagataaaaaaggaaaattgtacctatatccattaagttttataagtgctataatgttgccatttttttcagaaaatcatattttaaagccacatcttaattcttaggaattctcaggtaaaattataataaaattcattgaataaatatgattaaatacactagcttcacatgttcctttcttcaggactatcaataataaaatagatggaagtacagcgctgaagagaaactaccctggcaaaagtatatgcttacccatagttgtagctttattgttttcccaagatagacttttcatatttctgcaccttcatttttcatcttactcaccaattgcatatcttttatagatgtcagaatgattagatttagcgtctgcaaaatactcatcgttgagaattatagaccacttagaagattggcaaggacaagttaaaactgaaaataggcatctcaacaggcatgcaaaatcatagcagtgattcagtaaattctcagagatatttcccttttgtgataggaatggggggatagtttatattttgagattctttgcagaataaacactgggagcagaaaattacacctatatttattgccaagctgcatttgttatataatgcattttcctcctccctagatgtaccccaccttctgtcaaaatgttatttctttggctattctttgttgcatgtagttcagttcaggcctgactcctaggattctgcaggtttttttgtttgttttttttaacttcccacccagggaagtgaaagttctgttttaaaaattcctgaatgtgtataaatttcattctgacaagcccactttttcagtatgattttatcagtgcttacaagttttagaaaaaaaaaaaaaagaaaaagaaatctcagatgacctttaatgtcataactgaacttgggttttgaggagagcaaagagagcaacaatttgaagatgtaggtttactagtaaacacttctgttccaccatctgctcccccaccaccccatcgcagattacagtggaatgagataccagggtggggccagaggggccgtggtaaaatggggatgaggtgagagcagggaaggtgatgtgggagcagatggcagctggtgaaagaggcactccatggcactgttggcatggttacagagaagtagatgtcctaacatgctgtgccaattttggaatgtttcaaactctactttgtaacttgtggcctcaaactaaactcattggctgtgtagagcttctcctgtgacaagcagttcctataaaagcattagtttagttatattgtctaacggctgcttaaaatatattcgtgtgtgtttgtgcgtgtgttgtaattaatctatggaaatgtaaaaataaagtatttactgtccttggtctccaggtgaataataattactacatattaacaaccctgataataatatatatgtaataatgaaacagttttgctgtaccatctatttgtgtaacaggagcaaatattgttaaaaacagttcattggattttgttgttgttgttgttgctttacatcagtttataaaagtcatatgagcatttgcctgtctcatctttagatgaatttttgttttccattaaacaaaaaaaaaccgaaatggcctaatttaagttgaactaggtcattgactaaagtcttatttttgtctaaaaatgcatccattgcaaatgttactgccatttctagtgtctacagtgtccttagaggatatgcatagtgagttgatttgaaaagtttttggccatatggcatggttgaagcaaaaacgtattgtgttaggtcaaaccatgtgtaattgctgatgccacacaatttttttaaatataaaatataaaatagcatttttttgtggttcaacctgatatatacatttttaaattccttattctgaatttgggtaaaaataaataataacttataaaacacgtgtatgtatatttggtcttgcagctaaataagattatatataattttccaaatcttcggagagtccagcttaattaaaaatactatttgcacaaatgttgcggtttgtctctgtagaagctctgagagcattcatttaatttattaacccaagtttctcttgctaatacatttactcagaagtaactctgctgtacataaaaatagttgattcaatagagaagtagctaaacaattttttgttgttgttgttaagtaaagggattaattcatgttagtcactggaatgtcttgcttaaaatttcctccaaaattttttgttcaagttttcattacacttttcccgcaatttaacaaaaatgattttgctccttctttttttttttcctgaaactgtttttagaatggaattaactgattctataaagtacacaaatgattggtattaaatgtctgtctctttagtccacaagtgtttagttttttgaacagagatgaaaattgaattgggctttgtaccaaagatttatatttagataaagttattccaatggtattcaaagtgttaattgtatttctacagcaaacttcatcgtattacaccaaagcaaataccatatttgagatgcatctctaccacatttagtcttgttccttcattttgtttatttcattatttgaagtataaagggagggtctagatgatgatgatgatgatgatgatgatgatgatgatgatgatgatgattgagatggagtttcgctcttgttgcccaggctggagtgcagtggcatgatctcagctcgctgcaacctccgcctcccaggttcaagcaattctcctgcctcagcctcccgagtagctgggtttacaggcatgtgccatcatgccaggctaattttgtatttttagtagagacggggtttcaccatggtggccaggctggcctcaaattcctgacctcaggtgatccaccctccttggcctcccaaagtgctgggattacaggcatgagccaccatgcctggcccaagtctagattattgaatagaaaaacatgatcctgaatgacaaaatgtgtctgaccaaagtagatttacccatgcacagaaatcgaagtcaatttttagtgataagaccccatattaaatatgaatcatgtcttggatttctcctaaattcgctttaacatataatgtgacataattgttaaaggaaggtctgaaagtcatataatccgtctttattcattttcatgcttaaactaacacacaatgctagtataatgtgaccctttaattctgagataattttctggagattatagtttggtttgtggtttttgttttgtgttttatttgttttggggatgggatctcacactgttaccaaggctggcatgcagtgggattatcaccactcactgcagcctcaacatgattggatcaagggatcctcctatctcagtctcctcagtagctgggaccatagacctgtgccaccatgcccttaagctaacattttatttatttatttgtagagatggagtctccctatcttgtctaggctggtctcaaactccttggctcaagcaatcctcccaacccagcctcccaaattgttggtattacaggcttgagccactgagcccagcttgttttgtcttaaagtacaaaaggatctcttgtccttaagtgttccttagatctgagtccaaagcaaattttccttttttcataatgtttattttaaatgaagaaatttgactgttatatatatggctcaaatttttactctaatttctagattgtttacctaagtatcctatcactatttgcagattcacttctaactctccctaaatttcaggccactagtagtgtttttcatgttttttcaaataggaatgattcaaatcgacttatatcagcttatggttttttgactgtttttaaccccccaccagtttttgggtagaaaatggtagatcattctataccatttaaattcaaacatttttaatttatcttagtttctgatatgttttcatttactcgattacatatttctgcaaatataattgaatataagtcaaaatatcatttttcataccttttatacttcctgtctctattttttgccttatattttctaattttctatatttctaatttctagggcaattgatatttaataaacattctctattgtgtagtaaagcttgtatttctaccgatttaaattagtaatatcctattagtttaaacaactttaaaccatatctcaacttttcatagttagttgttttggggtcaactatgaatgaatagaagaatctttgtattagcaattcaagaagcagcaattatgtatttctgagttttttgtttttgtttgagtctagttcaaagtagagaaaggtattgtttactgtttttttagtttaaaattaaatgaaaaagatggatatgtcttgaatatcaagtggagtagcatgtactcagaaaaagcaaccatttcctgaccaaattagacccttattaacgatagcacatgatgctgtttaatttgtttggggtatgctcttaccccaattgttaattgtcagtttctgaaaataatcagttttcaacatttcacggtttttcaattaggctatggcaacaaatgccattgttgctaattgccagagtttagtcagtaaaattatgatatggtctttctttaactattatcaggtcacttagtatctgcttcatctttttacgctttaataaactaagcagaagattgagatcattagatatccaactgtaatttagcactgtcaagattaaggaggggattatggtcattaggagcaaaatggtttcatttatggactgagaacaatgaggcccatcaataaaccactttctgcctctaatgatcttacttctctctaattgtgtgctaatctaacaacaaactcattttcttctttcattcttgagggaaagattgctaaacagaaatgctttgcatatatgttgcttttacttccttaagttttggtgtgtgttcatgaatgcagtaaattatttctaggtgaacagatatgtctcttaagggaaatatgctatgttctcttctagtttatcaacatatttttgacagaggaatagattttctgtgattagatgtgctttattattagtaccatcttaatccttatttgagtcattcattgtagaaagagatctgtcttataaaattaccaactcaaaatatctaagtgtgctaagaatcgaaaatgatctcagtaaagtgggtcataagggatatatctcttattgggctgtctgccattctatcacctttatgatagaagttctctaaacccacctctttgtagccacattccttgagaaatcaatgcttgcacttcactgaatttaacatgttgactgaggcccaaggcactctgactgtttgcagctagtagaggatccttgagtacaccctggtacttctgctctcaacatttgagattttggcttatcatgaatcaattgtgcttattctccaaacctcccttatgtggcagttgtactttttggtgcagttatttactctaattaaatattatgtgaaccaagaaatggtgcttaaaaaaaaaaccttgccatttatgcaaaaatgatgttgactgcttgaaaaatacttgctaaagtcattttaaatttactctctaattaggtgtgcgtaaacaaacttaaatgataggaactcattccaaaagccttctctaattagatttcttcatgaatgtttaaattctagaaacttaattctagaaatcaatctagaaactggtttagagggtacccttcgtgtatgggttatatgcaaggaaggctctgcagatacccaactggagcctaactcacataggatacctcagctctacatcaaaaagggtagcaagtgaatattatttatactttttcatttaagattttaacatgtatatcatgtcttctggatacctactttaactgacctctttgattaattgaccttgcgtgattttctaattatatttattagtcatgcttagtgtattaaaaactttactgctgctcactcatatccactagaaatgttaacttcatgttctgagtccatcatttctctcctttctacaacatagaaatggacctattgggtgtttatatattgaaattttttttctcaacatgacctcaactcccataagctattgtcattttacccaattaatgtatttttaagaaaaaaacctaaataattgaaagcatctgtcttgtttctgttgtaaatattatgttatcaatagtacacagactatctgcaaaagagaatctgatgatgacctgcacataattttgttggcaatcttaattttaacatcagagataaatatggagggcttctggtggtgcctaagcatagtaggtcctatgagaaaaaatattacacagctgctctagaggaacttacatgcttattgaatagataggattaacagataagatgtacttagcaggataagagactcagatccttatggtgcagggcagactatagattttttaggcactaagagaaagaagagctaaaacgtgtcattatagtaccacctcccaaatgttacccatatctaatgagtgaatgaaagaatggcccaggaagacttggaagtctgtagttgttattaatggaatgttccttccactgtaaactggagtgtaagattgtaaaaaataaatacggcattaggaattacataatatgacttgaaacatgccaggacttgtttctgaagattgaggaatgagtatacgttttttgttttttgttttttgttttattttgttttgttttgttttgttttgtttgagatggagtctcaccttgttgcccaggctgggtgcaatggcgcgatctcggctcactgcaacctccacctcccaggttcaagtgactctcctgcctcagcctcccgagtagctgggattacaggtgtctgccaccaggcccggccaattttttgtatttctagtagagacaggatttcatcatgttggccaggctggtcttgaactcctgacctcaggtgatccacccgcctcggcctcccacagtgctgggattacaagcatgagccacctcacccagccgagtatatgttttaaagtatgtaatgtaaatactcaggcagtcagtggagtcacaggaaaattccctcaaggactttaatcagcagaaatgtttgtgtatttgtgtgtgtgtatatatatgtatatatgtgtgtatatgtgtatattccagtagttacagttaatgtatatgtcataacaatacagaaaatgttaatattaaaatttatgtcacctttattcattcacctaatataatcagaattgacaaaacatgttagctattcatggcactgaatggagtattctgagcacagtaggaaactcacaaaattggccaggtgcggttgctcatgcctgtaatcccagcagtttgggaggccgaggcaggtggattgcctgaggtcaggagtttaagaccagcctggccaacatggtgaaaccctgtctctactaaaagtatttttaaaaatgagccgggcatggtggcaggtgctggtaatcccagctactcgggaggctgaggcaggagaattgcttgagccgggaggcagaggttacagtgagccgagatcacgccactgcactccagcctgggtgacaaagcaagacttcgtctaaaaaaaaaactcacaaaatcaataaagcaatgtgggtcaacaggatatgtgaatattataaggatatttccctattctattcatttattatttagtacttcacatagtttattcttagctgattagtgattaaaccattagatagtaatatgtttgttcatttcacccaatatatatttactcctactttgtgcaacacaatatactaggcccattgagaagtacaaaatgtaccccttaccttcaaggacgtgacagaaatataacttttttgataaaatgattgcaaaagatttaatcagggtgacactaagagaatgcttttgaagacttatctcaaacaggtcttagtttattccaagtcttacaaagtcaaagttgcataagtcttacaaagtcaaagttgcataagtcttataaagtcagagttgcaaagtgaatagtgaagcaaatcaagaagatttttttagatcatataagaaaaggtaataatcaaaaagtaaaatccagttgctgaatttaggttagttaatataaggcatgattatgtaaaactgactgtaaaattgagatccagtttttaaaaatccaagttatttgtaggcaaatgttaaacaattaaaaaaattttttttcaatatttttgagacaggatcttgctctgtcacccaggttggagtgcagtggcactatatgagctcactgcagcctccacctcccaggttcaagtgatcatctcacctcagcctcccaagtagctgggaccacacgcatgtgccattatgctatgctaatttttaaatttttcatagagccgagctctcactatattggccaggctggtctcgagtttgtgggctcaagcgatccccccgcctcagcctcccaaagtgttgggattacaggcatgagccactgtttctggcccttaaactatatatataattaaatcctgcccctgattttatattagaaaattcagcaggtgcacgcagcaaatcttagggggaaaatggtagttttcctaatacttaaactttagctgcaaatacatgaggccctggatcctaaaatcattggggtcatatgctagattctgtgtgtatggtagaaaatttgaaaatactatttttgtggggagagaattcatatagaaaatgaagtctgttgacgtatggtaagtaagacaggcgaaaaaagtgttttgcaacttcgcttgttgctctgatactactcattagtgtatgctcacttttttctttctaagatcataccctttattaggcagcaatattcttctaatggagaaaagaaaatgagcagtttacaattatgtaaataagacatagttttttctatttctgaaaagtaatagaacttttttcccctaaatgaataaaatctcaaataaaattagaatccctgtacctcactactcattaaagggtgacactagtaacaatttgtaaagaggaaactgtagaaatgcaataaaagaagattatcttagcaaaattgagatttctctctgtatgtcatgctaaaaatgtagctgagagctggtctttgcaagatcaatgtgggatctatgcatgaaatgtgatttgcatatttaaagaaacagtttaaatcatagcttataacccatgccacagagagaaagaagtaatgtaatgctgttgtacccttgtccatctatgtatagctgagtccatgtgtgtgccaaaagggcacaggtgcacttttaattccccagagacaataaggctggtatgtggggtttataaaagcttttccttttcatgttcaccatggcgattgtgactattttttatatttgggatagcactgccatttcccactaatttgtattagttaaatgtgttcaattctaaaaacctcttgattcatgttcaggatgttagtcatattcattagtttctaattgcattctgtaacctatggtagctctggggacttcaaatgtaattgaaggttttaattttaactcattgaatcaagtagtgatatggtgacatcagtgtcttaagaattttttttttctggaagcattatgtgatatggattgaatgcatgtagaacagttgcagtgttccaacctttaggtgagatgcacttcctaaaagtggcaattgcaatgcacagacaaaggtggatgccaaaggcattttgaaaatgattgatgagacttggtgactggctggttatggttaatacaaaagataaagagtaaaagctaactctgtggttttaagcagtgacagctggaagagtagtaatgccactggggaaaacaggataatcagaaacagatctggtttctgggagaaggtggtctgctcaggtttggatatgatgcttatgaagacatgggacactcaattacatgtttaattttatgtgagactagaagaccattcctcaaataaaagattggggtttgggtatagagatttgggcttatatataataacaatataagatttcagcttatatataataagatataatatattgttattatatataataacaatattacatcttattatatataacatattatatattatatataataagatgtaatattgttattatatatgataacaatatataagatttcagcttatatataatagcaaaagccttgatgtaagagcaatgcattaagacagggtttatagagaaaaaaacgcgtttatagagatcttggggaatgcttccatctgaatggtgggaaggagaatagaatgcagcaaatgaaacaaaggaagagctgtcatcttgctctataaaagtatttagcatgaaagagatctctatttggagttaaagcagtattatggtattggcctcaaacaatttttccatgtgtcaagtagtaatttcttttcaaatattgataagaaatcttcacagatattacaataaatgtattcagaattcttatatactgtgggtctgaaatcaaccataattatttttatgagttgacaaaattataataaatgcaaatatcctttgctgtagattagaggcatttttggaaagtttcctatgaaaaatattttccatttactggggttttctttctaaatattccctttatatgtagaaacttaaaaggaaagagccagagatctcttttggctccatcctcctgccaagcacaattttcttattgcagcatttataataccatcaactaaagatttttatattaaaaacattttacaaagagtcacagacccatttgtatgttttgttttgtttttaaacggagtttggctcttgttgcctaggctggagtgcaatggtgcagtctcagctaactgcaacctctgcttcccgggttctagagattctcagcctcccaagtagctgggatgacaggcgcgtgcctccactcctggataattttttgtatttagtagagaaagggtttcaccatgttgatcaggctggtctcaaactcctgacctcaggcgatccacccgccttggcctcccaacgtgctgggattacaggtgtgagccaccaagcctggccagtttgtatctttataatgaccccaccagatcagagaggcaggtgatattattcctgttctacaggtatgaaaactgagactcaaagtggtttaggtgtcttgcccaaaggcatatgtaaaggaagcgggaattgggtcttctgactccaagaccagctttctttttgctgttactgtgctgtctcacatttgttatacattccctgaagactcctgtgagggaaactttagaatttcatcaaagcaaatcctaaaggtacatgataaatttgttgtctgttttattgagtaaaaatctgtctagtcagcagtccatacgttaggtcagaggtctaaagtaattgtttactgggcttttttggatacattctgaggcatattaattctttcaggcttttttttttttttttttgagtaaattactcttgaaagggttcttattggtaccctctagaggttcagaagagttaattggcttacaaaacatatgtggatcgaacttggggaatagttcagtcatctcttaacatctggatttactgttttattattttaccattatgtatttgtatctgaaaactgcagccatttaaaaataaatatggtaagtaaacagtatgtatataattaagaataattcactgtagctcttcaagtttacagcactgttaaaaataacctggtgtatccatgtaacttatgaattcaatgaaatttaaataactgaaaaacaatttttacagtaacatgccattcacattttgaaaatattaccaattattttaatattatctactttgaaaatatgggaaacaaaattgttcatgatgtttgtgtgcacatcattcaaagaaccaaaacaaaatttttatcaatctgcattccctcagagagataaaatattgctctgtgaaaatctgattttcaccatatgctaatcataccctcttccacagacctcttctcttacttcctcctgaacataaccttccatcaaaacaagaaacaacacaaaaacatcctccaagaaaaaaagaaattacaaaatacaaaagcaattcacaaagccagaaataaatgtttatttagttaaaaaaaaataaaaagatgaatgttgatgacttcaccattgaaaatgatgcctcaatatacaacttggcttcaaagatccttagccttgatttggtcatcacgagttattctctccatttcagcttcccccatagcatgtaaacatcagactttgtcatcacatatgacagtgtagctaccaccaagatctcaagctctgaatgtgtccttgtacccacaaccatcctcacatagcccttgcctctggcgcctgtttttctgttgccctcattatgaccttacccttacccttcctcatcttatttatttattgttaagacagagtctcgctctgtcacccaggctggagtgtagtggcgtgatctcagctcactgcagcctccttctcccgggttcaagcgattctcctgtctcagcctcgcaagtagctgggattacaggcgtgtgccgtcacacccggctaatttttgtatttttagtagcgacgggatttcaccatgttggccaggctggtctcgaactcaggtgatctgcctgccttggcttcccaaagtactgagattacaggtgtgagccatcgcacccggcccctctttcttttctcccaaactatttgctcccctcaagctgcatttgccatataacctacacactgtctagcactgtagaatcctcatacttgcttcaagctcccctcctttagccttctgccgtccacaccctgatattcctgttgctctgatccaatcccaactcccgcatacatgacagaagtcacacagtctacctgatgggatccgttgttccatcatttctaaccttagcctcctaatggagttggggtagcttttcatttaactctaattctgtctttttccccacaacagcaattccaaactaggtttgttctcctcaaatccctgagtctagctaccatattcccagataaacatctcttctcattcttgactgaagatgaaaaaatattcttttcatttactgccacatatctcaaagaagacattacatctcctcctgtttacaaattattttcttcctactaactcttcagtgtgttatcatctgactgatactcccatcaatttatacgtctttgtatttggttgtcttaacctccctacaataaagctccatgggggcaaagacagtggtttgttcccctcacttccttgtttgctattgcagtgctatgccattagcagaactatgtgttaactttcagggcctaaaagaacttcagataccaggttcaccttgtacttcccatacttggaaatactgctgaactaaatcttgccttattctcagcaggcagtagagcatgttggttaagaacacacatgagacttcataacttcaaatattgtctctgccacttactagttacatgactttgaagaaattatttaatctctctttgtctcaggtttttcatatgtaaaactggcataataacaagatacgttttataggatgaaatgagtatgtgcatgtgtgtgtgtttgtgtgtctgtttatacaacactgggatttgtaacttggcaacttcctggaatgtactggagtatcattttaaagcccatggtaatgacaaagagatcagttatttaggatgcgttttggtcaattctaaaaggaagctataagatgggataatggagaatttcatttggactcctccgtgttattttcagaagtgataatttggccattgagattgaatttcatgttgctttatagtggctgatttttccttttatactgactgggatacaggacctggctttgagtttctgcatgtgtctgttgcttttatattttatttatttaatttggggatttacaaaataaattttgccagcctgctttgatcatagctgtctgtggcattgtgctaactcaattaaaaagtttttttttctgtcctgttaaattaacattctattgatacattcaacagaataaacttatataatcaattccacattatagaattcacaatatacattttaccctcagaaggatgcaaagaatcgttgtaaggagactcagttgcattatggttatagaggcatcaagaaatccagaggcacagtggctcacgcctgtaatcccagcacttagggaggctgaggccggtagatcacatgagatcgggagttcgagaccagcctgaccaacatggagaaaccccgtctctactaaaaatacaaaaaaaaaaaaattagccagacatggtggtgcatgcctgtaatcccagctactcgggaggctgaggcaggagaatcgtttgaacctgggaggcggaggttgtgttgagccgagatctcgccattgcactccagcctaggcaacaagagcgaaactccatctcaaaaaaaaaaaaaaaaagaaaaaaagaaatccagaggcctggtggtgtatacctaggcaatccacttttgttttctctctgtttccatatcctcatgagagatctggactaggaaattgctgatatccctccccaagggggcatttttgttaatctagaacatggatcaacaaactttttctgcagagagcaagatattaaatattttagggcttacggaccacacacagtccctgtcacaaggactcaggactgcctttatagtccaaaagcagccataggcaatatgtaaacgatggacctggctgtttttcaataaaactttatttatggacactgaaatttaaatttcatatacttttcatgtgtcacaaaatgctatccttcttttgatttttttttcagccacttaaaaatgtaaaaagcattcttagttcacaggccatacgaaaacaggcagccagctagatatggcctgcagacagtagttcaccaatcccttatctagtctagccaagcaatgtatacatatgtctatttgaggaacttctatattgaagacattatctcatagtacttgtattagtgaacattttcactttcctttcccttgtttcataaatgatcactaggcatttgaatatttcagagcctttagccagattgcatgtgtatttgtgcttgtatatatttttgccagaacacttgaaagtctctgggccttttattcatctttgctttgccaaatattttcccacctgtatagatgaattaaaattttcaacagcctttctttgaacatgacttttgagaccagttgctatttaaattacacaaaagtatatttagcccttctttgtgttttattccctttttgccagggtggaaggacttttcaggaacatatttgaatagatggagaattctgaaaaacataacccagatatttatttgggtctcagagaagaagacgttttgaaaacaacctttgtggctgggcacagtggctcatgcctgtaatcccaacactttgggaggccacggtgggtggatcatgaggtcaggagatggagaccatcctggccaacatggtgaaaccccatctctactcaaaatacaaaaattagccaggcgtggtggcacatgcctgtaatcccagctactcaggaggctgaggcaggagaatggcttgaacctgggaggcagaggttgtggtgagccaagatcgcaccaatgcactccagcctgtgggatagggcgagactacgtcaaaaaaaaaaaaaaaaaaaaagaaagaaattttatcaatttatcctgcttgaagtctttcagcgctttctcactacacttaaggtgaaacccaaattccttacggtgtcctacaagaccctacctacctctcaaacttcatctcaaatttttttttaaaatccattattttgttagtagacaaaactacataaagtataataaatttatgacatgataatgcccagataactaatcaagacttgctttatttagggactgctttcagtagtgaggaacttaaaaacatagtacaattatattatctaattgctttagtttgtattgccaatttcttatttcagggcatatagtaatcctattaatatccacagttaatgaataaggaaaatacaaccataggcttactatatcctttgaagcatcttttgtctgacctataaccctattacccaggagaaatattgctaatccaggcaacactaatgtggaatggactctaatggcttcaggactatgacctcagcactgatctcaacaacctgcattcagtttgggtgaaaattcgtggctttgtatatgttacatacctgtggacttcctgcattaaacttgttcctcaaaaactctgtgaagtgcaagaatctgcatatagtcctattaatttccctgaagagttcaggaataaagttaatgaaaaatttacccatgatcacaaaaattacactcaacaaggctaacattattttaatacagcattatagctttatggaaacactatttatgtgtacttaattcttgccaaatagtaatgtggaagacagtatctattcaaatggttcatcaatctgtatgatcttttcacaacttattgaagataccatttaccagaagtaagggtatatattagtaaagttttctttttcctttttttttcattttcatttttttttttttttttgagatggagtctcgctctatcgcccaggctggagtgcagtggcacaatctcggctccctgcaagctccacctcccgggttcacgccattctcctgcctcagcctcccgagtagctgggactacaggtgcccgcaaccacgcccggctaattttttgtatttttagtagagatggggtttcaccatgttagccaggatggtctcgatctcctgacctcgtgatccacccgcctcggcctcccaaagtgctgggattacaggcgtgaaccaccgcgcccggcgtgtaaagttttcattaagtgattgctcagataaaagcatttgtgaatgcttattcaagaagcaggtagtcgtcttgttgtgaaacagtgttcatttatcgcatctagtttgtcaaaacattgtttgacagtattgaatataaattgttttctacctgtttgttcttcgtgacctttttgcagtactatttactcaattattgtagttcacaactaaacacacctataaacatatactcaaaattccaaattttacagactagtaatttcagatttcttaaactaggattttcttctttctagttttagtcaacacgtctacattcttcatagcccttgcttttccatgattttactaatttattttaagcctttctattgttatattaagtagcctcctttgacaacctacacttttatcattagtgttctagttccaaggttaaagaagaatgcattacatagattggacaagtgaagacattagtatgggattgtcataaaggatttatcagcatttgaagctcctgacaagcttttttttttttaatttagaagaatgccattccagccatttaaataaaatctccaggagaagactattcaggttagaccaatatcaagtcgaaaagacttgacctattaaaattattccagtttgagttgtaggtgggtggggcatcttttattacaaaacaaccaaatgagtttttaaaaagatttttctttttcttttttctatttttttttttgagacaagagtctctctcgctctgtcgcccaggctggactgcagtggcgccatcttggctcactgcaagctccacctcccgggttcgcgccattctcttgcctcagcctccccagtagctggtaccacaggcgcctgccaccgcgcctggctaattttttgtatttttagtagagacggagtttcaccttgttagccaggatggtctccatctcctgacctcgtgatccacccgcctcggcctcccaaagtgttgggattacaggcgtgagccaccgcgcccggcccgcaaaaaaagatttttcttgacgagaacaaaccattccaccaagactttatccagcattgctttattacttcctagtcctggccttgagctaagactgtcaagaaaggtaggagatttcagtttgttttttagcctttgatttaaaaaatcacgcatagtatttgctgcaggcagaataacacttgcagaagagacagcaggggaagggactgggattcttcaaggggcagcttgactgtctgtccactactgttggtttggtgctcaggcttcagaattttcttattgcaaattattacttagacagtttcaaactttcccttcctccttgttttctttttgttagaagtctctctttattttttcaaacatgcagtcagactgaggttttcaggctgagaacttgtgcaaatgtatgaactcagacattgaagtgtacttagcgaagttttaagagttaaatcatagaatgcagctttcatgttttcttactggatttcctctgctatcagcatcagttcagaccacattatgaatccagttgagaaaaactgcactttcttcccaagggcacatgttagaggagtaaatgatggtacttaagaacacatatttagaatgcacatttttaagttttatggaataagaattctagttgtgttttctgtgaaggtgactttttaacaggttttttttttttttccccctaagaatgagtcattttctcacatttttcttcattatagggattttttatttgggtaccatttaccgtttattttctttaaaggccaaagaagctcacagtgatgagcttttgctattgttactgtataaacacatttgcttcatttccaggtacagcgttcatgtaaaatgaaactaccttataaatgcacttgagaaagaatgcaacagtgtctattgttcaggatgcttgtaatgttccttttcttttttacatatgctttccggatgagtcactttaatggtatgccgttccgctgatagtaattcttcaactaaatatattcagttaaggaaaattacagggtacttatataatcatgtttgggcctattcacatatagacttgcaagagtaaattcttacttggtctttcttagagcaaagatgtaagaagtgctccgttaatttgtcaatggttacaatgaatagaaacatttaattcagaaaaaaatccacaaattcctggaaatgcttttatatttacatagaattacacattcttaatatggtctagacagtgtcactggaatactgtgattttttttcttgcatgcatatctgttctcttatatactgtgtaattgaagagtccttccgttcaaactcttgcttaaaatatgtatcttatactttaccttaggattatgtattagagaaagtctgtcatttaaaatgttttgaatgaggatcaggccactatcatatatttgcttgaagccagggaaaaagtatatgtatatttttcaactgaagcaagtagataaataagatatgtgaggaaagtttctcctacatataactcaagagagtacactaagcttaaaaggttatttatggagtacaaggaagaaagctataataaagaacccgatagctataatttaattttttagtgttataattcagattcagtaattcagtagcagatttaaaaaatgaaatgagagaaaaaaaattaaagtgctaccagactgactaatcagtcattgaaaatgcctgtagtgggaatttactcagatagaaaatgtttgcactgtcattaaagaccccctagtttatattagtgaactaatataatgacaggcacaaaaatataccctgaggctgaggctgtgcaaaggcaagcatttctaacccactctggtacttaaatattcttggcactacaggtaccatcatcaccctgcaacctctagtaaaaatctctctctctctctctctctctctttctctctctctctttctcacacacacacacgcacacgcacatgcaccccctacctgagaaatattagaagtagtgtaggcaaagacctagttaaatatttaaataatcataatattaattgattgccaactcttaagattgaggcaaatgtgttcaaggcaattaatgaggcaggtaaacacatattaattcttttctaatactttttttttgtctgttaccttttagacaagtctagaaagccaaagtgatgaacttttaaatgccaaggaaatacagactattgcatgggttttaatttccagaaatattatttaaatttggaacttgctaataagtctgataaattggctgttagttagtgtaattgtcactagttcccaaacctaaaattccatgtaccctgtaaaatctaaacacagaaaacacaatctaaatttagttctctttattaaaaaaagaccagctgggcgctgtggctcgcgcctgtaatcccagcactttgggaggccgaggagggtggatcacgaggtcaggagatcgagaccatcctggctaacacagtgaaaccccgtctctactaaaaatacaaaaagttagccgggcgtggtggcgggcgcctgtagtcccagctactcaggaggctgaggcaggagaatggcgtgaacctgggaagcagagcttgtagtgagccgagattgtaccactgcattccagcctgggcaacagagcaagactgcatctcaaaaaaaaaaaaaaagaccaatattacgttaaattaggccatagtagggatagcaggttggaaatgtctgcatttttttcccgtagattacatctaaatagttgtttaattcgtggtagcatgtatacagtgggaatgtgtatgttggaaggtagggtgtaggaaagaggatagtgaaatataaaatgaatatttatgtactaggtataataataagtactttatcaaatcatttaacctaaatgactaccctttaaggaagatattatcatcatcattttgcaaatcaggaaatgaaggcctagagaagctaagtcattggcttaagataacctaactagtaatatgtatggctgagattagaacctaggtctgtctgattcctaaaaccattcctaccccatccaattctgccacagcagcatatataagtaacatgaccttgtgccaatgaatgataaagagtacaggttttatttcatgatgctggccttccaggctccagaaatactgctttacatttacaatttcctgagatgacatcacttatacccctccttaagagtagtgcataccttatagaatttttgtattagataagttaatacataaaactacttagaataatgtctagcacatagtaagtactcagtaaatgttggttattacttaagaacttaagtaatgactaattctttttttttttttcccgagacggagtctcgctctgtcgccatgctggagtgcagtggtgcgatcttagctcactgccacctccgcctcttgggttcaagcaattctcctgcctcagcctcccgagtagctgggactacaggtgcctgccaccgcgccctgctaatttttttgtatttttagtagagatggggtttcaccatgttggccaggatggtctcgatctcctgacctcgtgatccgaccgcctcagcctcccaaagtgctgggattacaggcatgagccaccacgcctggccagtaatggctaattcttacaccacagaaggactagttgaaggaactgggtatgtataggctgggtagattaagaagattcaactgatacatttcttgtaaaataggtagtagacttgatcagtgctactatgaggcaaaattaggagtaatagataagagtttaagtaggctgatttttttttttttttttttttgagacggagtctcactcttttgccaggctagagtgcagtggcgcgatctaggctcactgcaacctttgcctcccggattccagcgattctcctgcctcagcctcctgagtagctgggattacaggcgcccaccaccacgcctggctaatttttgtatttttagtagagacggggtttcaccaagttggccaggatggtctcgatctcttgaccttgtgatccgcccgcctcggcctcccaaagtgctgagataacaggcgtgagccgccacacctggctaagtaggctgatttttcttatgagtaaataaaaaaattctagtgatatcaactgtcaacaattgaataaggcacttaggatgtagggagtactctgttttagatctaatatatgcaacaccccagatttactgggcactcctttgccatctcccacctccaaacccaggctactcatttcccagccatagtgggaagttaacattgctagaaacaatttcaccaatgaaggaacaggagatgctaaggagtaagcaggtaaatgaattgctcattgtctcctctaagcagctcttttttttttttcttgagacagagtttcactctgtcgcccaggctggagtgcagtggcacgatctcggctcactgcaacctctgtctcccaagttcaagtgattttcctgtctcagtctcccgagtatctgggattacaggcgggcaccaccatgcccagctaatttttttgtatttttagtggagacggggtttcaccatgttggccatgctggtctcaaactcctgacctcaaacgatccacccgcctcagcctcccaaagtgctgggattacaggcatgagccatggcacctggcctctaacctacttttctaagttacatttgttttatctggagaccaggactgactagataatttttgggtccgggtgcagaatgaaatgtggcaccccactgcaaatttttattttattttatttatttatttatttttttgaggtggagtcttgttctgttgcccaggctggagtgcagtggtgggatctcagctcactacaagctccgcctcccaggttcatgccattctcctgcctcagcctcccgagtagctgggactacaggcgcccgcccccacgcctggctaattttttgtatttttagtagagatggggtttcactgtgttagccaggatggtctcgatctcctgacctcgtgatctgcccacctcagcctcccaaagtgctgggattacaggcttgagccaccgcacctggccaaaaagttattaagaatttcaaaatgacaacaaagtattaaacaaaatgcagggccctttgcagcatgggatcttgtacaactgcacaggttgcatatccatgaagtcagccctgacggagacaacctgagacactaaacaaccagcatttttttttttttttttgtaaagctatgacaagttctggaacttaccctcttgtatttgctgtctttccctcatgcctgcttctctgggattatatcccgctcaccccaacaaggccttaagaagtaagctctaacttaggctatgttttgcagggactcagactgtgatactctgtaacctgagtttttcaaatttaagaggctggtccaaatctcctttaatgtcacttttacctcaaaggtaacataattcccccatgcaaagataaacactttacataatggcattgtttaatgcagccataaatttctgtataagctagaattctcagattattacatctccaatattttattctcttttgttcaggcataatataaataatccattagaggggaagaatggaggagcctaagaaagaaaggtgccctttacttttttttactttatccgctttcctcacattcccatttgtctaagcatctcccgaaccacgtctatatattgttaggcagatttcaagtccctgctctctttctctacttatataataattggtatggtaacttcaaatcattatgattatatctaacctctccctgtactttcagttgtggaagtagacataaatttaaatgtgaaccaaaacttcttgaaatgtacatattcatcaataaatatttattgagtgataaatactgagcacagtgataagtactgagggaaaagcaaaaaatcaaatatagatcttaccattaggcagcttggagttttataaaggaaactgttgtttatgtatatgagataaaagacaattattattcaaagcagaaggtgataggtcgaagatcacttaaacaaacaaaaagtacatatgaaatggtagagaatttggagtagagctctggagagatttatagaggactaaagattatacatgtgaaattcgggaggacagatgttcagaaaaatattgatttattcagaatgcaactttagagtaaaagtaatttccctgggttaaaaatattctcacttattacttgacatatgtagactgctgtgtgcatagcaatttgattaggctagttttgtattgaatgattggaagatgaagtcattatcatcatcatcccctttttactagtgccattactattgtgacctaaacctggccttttagcacattttatttattacagaaagttagggaggaaaaataacttttccttttccccattttaggttcattggccacggtctctataccaaaaggcagattagcaaaagaaaataatgcagatttatttaggttttacataacttgagaggggagcattcataaggaaatgaagatccaaagaaacagttaaacctgaggttttctatagtatgtttgatgaaaaatggagaggtgtggaaaaatatgatagggagaaggaaaagtatgtgctaagtataataaactgggagaaatttaacaagacctatttgttcagatttctatgtccctttattttcagagataaggatgttggtttcctcagggtgcatatagcaaagttagctctcaggccggacatggtggctcatgcctgtaatcccaacactttgggaggccgaggcgggtggatcacaaggtcaggagatcgagaccatcctgaccaacatggtgaaaccccgtctctactaaaaatataaaaattagctgggcgtggtggcacatgcctgtagtcccagctacttgggatgctgaggcaggagaatcacttgaaccagggaatcggaggttgcagtgagccgagatatcatgccactacactccagcctggcgacagagtgagactccgtctaaaaaaaaaaaaaagccacatgagtttttgtttgtttgtttgcttttgttttttgtttttttctttaagagaaaggatcaatctgtgttgccctgtctggagaagagtggcatgatcatgactcactgtggcctcgagctcccaggctcaagcgatcctcctaactcagcctcttgagtagctgggactaggcacataaccaccgcacccagcttgcttatttatttatttatttatttatttaaggcagggtctcactctgtcacctaggcaggaatacagtgatgccatcataactcattgcagcctcaactttctgtgctcaagcaatcctcccatctcattttcttttttttaaattttttgtagagacgaggtctagctatgttgcttaggctgctctcgaactcctgggcccacgtgatcctcctgcctcagcctcctaaagagctgggattacaggtgtgagccaccacacccagcagagcttatttttgtattttttgtagagatggggttttgccatattgtccaggctggccttgagctcctgagtccaagcaatccatccactttggcctccacaagtgctcggattacaggcatgagcccccatgtggggcctacatgagggtcttaagacctgtgcccaggaaagatcagatagtccttcctgcaggtgtcatttctaaaagttcttcagcttaaaatactcaatatgccaaggcaccatatttttgggtaatgtgccctgaacttcaccatgtccgtgtaacctaaataacataagtgactggtcaatgttttgtcttcacttttttttttttttttgagacggaatttcattcttgttgcccaggctagagtgcagtggcgggatcttggctcactgcaacctccacctcctgggtttgagtgattctcctgccttagcctcccgagtagctgggattacaggcacccaccaccaggcctggctaatttttgtattttttttttttttttggtagagacagggtttcaccatgttggccaggctggcctcaaactcataacctcaggtaatccacccacctcagcctcccaaagtgctgggattacaggtgtgagccaccgcgctcggcctgtcttcactttttcaatcaaccaagtggggaaggagaaaccttttgaataattggaatacagcagagaaacctaagtgaaaaaattcaattttaaaatcagagagaattatttcttccatagcaaactcatcctttaaataaagcaagcaatgattggtgaaccattagcaaatttttggcaaaactttcttctgcaataaagaataatttccaagcttgtcagatctaaacaaatggaactaaattggacagagctatttaaactgacagattaatagaaaaaaaatagtctttagtgttagtgtttgatttttagtctcttgaacttccatgtatatttaaggtgatttctcctcattgagttataaagatgtgcccatcaacatgatgaatttgtatctgaacagtttggctgaaatttgccaaggggttgattttggcagtctcttaaatttttcattgtaatgctgatatgtctctgcataagactaactttgcttaaaaataagaaagaatcatagtatttttctatttgtgtttcatggtcctttaatgaaaataacagtatttcagaggcctggatttaaaaaccaatgtcacaggctgtccatcaaattataacacttacctcatctttgcaactagaatcttgccaaatgctgttgatattgatagaagtgttttcatacataattggcagttatgcagcaatagagtatctataaaatagttgaaagttaaaaaaaaattacctggtaaaaagaaggtctcctgacagatctgaaaaatgtgcatgtatttaggagcagtttgaatacaatacataaaattattagttgtcaatgagagcaaaaggaaggtgcagagaatgttaggggtaattacagcaactaatgatagtgtttgagggcaggctgaatctttgtgggtatgtacgttcatttgtgtttgctggggtttgctctaaattatctttctgtatcaacagttatttttcacatctctttgaaaaatactagagatgggaacttttaccatagatattggtttataaaaatcaggatattccaacaaaagaaaaatatttgatccttttacataatttaaccttaaatcatttatagagctactaacgtgcattaataacatctctttgaaccttagtttttctttaatcttcaaattagattttaaagaatgaaatgttaggaattccgtcaataaatttaaattgaaatggattcatttgaactaatggctgagtaaaatggtgacattcccatattaaacatgataatttggtatactgtattacacattttcatttatttcatggagagtagaatttttataagcagtaattcagaaaaatgtgagttgacttcatggaactatttcccacatttaaaaaaaaagactttaactgataatgtctccttttagatgttttgtggaacacttggtaaaatattctaaatcctttgcacactgttctttagtttcagctcaaattctcaagagcaaccttgcatcaatggaacaacaaattgttcatctggaacgtgacatcaagaaattcccccaagcagaaaatcaacacgataagtttgtggaaaagatgaccatatcctttatttatttaagcattttgtctagtttttagtctctatgtctgtctgtttactaactgtgtggttagttctagatttactagtcttttcacaccatctggatgaatttgtgtatatgctgtttttctattagtagcataaattttgtttcatgatgttttcaaccagtaggcaagggaacaattagattttttttgaaggctatttctcaaagaagaattccatttgaaagcccacaggatatgcaaggtaagtcttaagaggtttgatgaaacctaaacaaaacaaaacagaatgttcttatataaccaaatgtttaaagtaaattatcaacagaaggtttttttttgtctgagattttgtgtgtgtgtgcatacattttctgagggcatgtgtgcattttcaaggacaataagaggataactaatatcactagacagaaaggactgtgaaggataaatggatacatggttggatggatagacgaattgattagtagattatatatttaaataaattgtagtagatatctgtataacattaagcatttcttgctaaataaacattttttgaaacttctagtttatagcagtatattcatataaatcataaaaatatataaaaggaaaacttgagaaatagcatttagcttgaattgtttaatgttaaatctggtgtctaaagataaactacattagacctgatttttttataattttctattttagttttcaaaagttaaagccatatcctcctcctctgggtttaaataagtatcttgaactgcagattgattcaccattttatatctttagagggaataaatactgtaaattctttatctgataataagtaaattccttcaacaactatttggcagtcaccttgtttcaaggttaaatctattgcctttttcttctgtgatatgctttattttttgcccaacttggaagttacagtgctgaactcgaattacttaagaatggcaatttagatttatgttaaaaaaaattttaactctcagtgttttggttcattaatgaatactgtgttttgtatggtactttagtgattctgagtaccttcatgaatacaaatattggcaaaataagtttgtgattgattggaggcagggaatccacaaaaataaccttgggttgcattactggccacgttaggatacctaatgtgaaggtttcactttattgctgattacattttttttttttttcaaatatgttatattgtcctgtgcctggaaacaccacctcctttttcaccttttgattttggttcttgcctcatatatttgaatttaattccttatcccctttttcttttgaacattttcttctactgttggcttatagccacacaacagcttgcaacattgagtctttgttgctcatttagaaaaagaaaagtaatttcaaaccctcatgaacttggcctggactccttattttatttctctctttatgcaggtaattaagcactttaaaatgaaaatccagagccttctgtatctgtatgttacagatgaatggttattcttcatttaagtggcactaaagtgtgactatttgtccacaaggggattgaaaactgtattaaaatgtatggggctgttactttgcatatcatattttttaaagaaacaaaataaaatacacagcaatttatttcagagaaaaaattagaatattgagttgggttggttaaaaactatgaattaatggattataaagataaaactgtggctcaagttattcttcctttgaaagacttcttggtcacccattgagagtttctatcttctagaaagagacgaacgaaatgcgtaatcattatatgtatgtatatgagttctggtgcctacctaatatatatattttttacccttctggcaatgctaaaagagaaagatattttattgtgggatacttgatcctgttttaaaaatagaaccatgagccaggggtggtgactcacgcctgtaatcccagcactttgggaggctgaggcgggcggatcacctgaggtcaggagttcgagaccagcctcaacatggagaaaccccgtctctactaaaaatacaaaattagccaggcatagtggtgcatgcctgtaatctcagctactcgggaggctgaggcaggagaattgcttgaacctgggaggcagaggttgcggtgagccgagatcgcgccattgcactccagcctgggcaacaagagcgaaactccgtctcaaaaaaaaacaaaaaacaacaaaaaataggaccatgattccatttctagtataggatcctttgtactagatgatctttccaatatttccatccagtgccaataaattgttttgcttcaagtcactggccctttaaattgaataattagggtcacaagtattggagtagtttccatggaaagtaactttagctacttaaacagtaatctgtctgtgaggactgagttcacaagctgaaaagcattcgtatgcctctggacttcagaacagcaacaatgctgtagttagcagcaatggcatgatggcttcagggcaactgaatatgcaggttggatcttcaagtcaggctatgtcctggagcaccctatatttacccttactctttcccaattttgattgaacacttaaagtatgctagacattgccaggcatgaaaattgaacagtacacaagatgatagaaaacttgacctcaggctgctgacagtctgacatttgtatgttctctgtcttgctgttcccatggcagagattatgtatggtttgttaattactatatgcctaccacctagcacagtgtaggcactcagtaaatatgtgttgaatcacacggtattatagctagagacagtgaagatcatctagtccaagcccctgcctttacttagcacttcaaaacgatactgtcagtgttaggctgtgcttatatttataaaaattttcttcatatatctctcacaaatgtatcattgaatcacctttatagagcatgctgtaatgtataatcagttttaagagagaggatccacagcttttaaagtaaacatcagaaaaaacatagacaaaaaacaaaaacaaaaacaaaaaaacctctcctttgaatggagtttccaaggctatttctagcctgctggggccaatggctttagaaggaaactcatcacctctttcttcctttctctacccaaaataggttgcttgttctgactcagaaaaaattagatggtataggagagaaaaatcagtcgttcttgacccattcgaaggttcatggctgacaccctataataccatattaacaagagcaaagcatacaaatttatttaatgtgagttttatgtgacacaggaaactccataaatgaagactcaaagaaacagggaaaaaccatgtattttatgggcagttgtgcagaagtatgactggtggataaaaggatatgatctaatggtaataagctgggggcaacccatgaaggctggttcagattattttctgtatctctgtatgacagtcttcccccaggtatggggaaaagacacctgtcatgtgaaggtctcttttttttttttttggagacggagcctcactctgtaacccaggttggagtgcagtggcgcgatcccggctcactgcaacctgggttcaaacgattatcctgcctccgcctcccgagtagctgggaatacaggcacacgccaccacgcccagctaattttgtatttttagtaaagaaggggtttcaccatgttagccaggctggtctcgaactcctgacctcaggtgaccagcccacctcagcctcccaaagtgctgggattacaggcacgagccacagcgcccggcctatgtgaaagtctttggtgaggaaggacagagctcagaaagtgatcttcctaggttttatggcttctttcaagggagaggaattctagtttctttgacttgcttcaggagacaaaggaaggtacgaaggagggagggataagttcagagacaccttcttgcttctgtggtcctcctggtgtccttcagctcaaagtattcagcatgccaaggtagcgtacttccagatattgtgttctgaaccccaacactttacttttttaaaaaagtcaaagcatcatttttacttaccaatccttgcttcttctgtcagaaaagaaacccattcttaaaagaggacttcttagacttttaaatatgtgttgtggtccattcttaacatcttaaactatctaaaaaagcacatcaaccacgatgtcgaccttactgcttatatccagttgacaaattccttaccacatttacttgcagagattttgtcaatggcagggttttctgttgcccaaaatcagcttagctttttgattgactgctggttaaatcatttccccaaccggaggacagagagtgactgagcagcaggggcaccattaacacattgacaagaagagctgacagaatgttaatgacattaacaccctgtcaactaactatcaacacttgggatttcctcatagtatgagggaagtcatttgaagtggttacaaatcaagttactgagaaggcacattatcctttccagataattcaaaacagatttggggtcttcactgcactgccattatgttaattgtattccacctttatttattaagataataatttttaagtagatgaaaaaactcacagaaccaccagtgacattgatcacctttgagaacatgccagtaacaggtttcagggagatgataatccacactttgtaaagcaaatgtcatataaaattgacaaaatagaaatgaaagcaaaaacaaccctcaagagcaaagctgttgtgttttgttttgttttgttttgttttgtttttaatgaacatagtaattcaggtcattttctggtgcctaaagaaaaattgagaacttcagattaggctggaggggggaagttcatcacctctgactctctccttaccctcactgtctgctcctctcaaatgcagaaaattagaaagttcaatgcaaacatttatgagactgttcagggagaggagggtacaggatttaaaagggggcattgtcagtaatacagataatgcatacattgagaagcaaattgttttagaaaaccacaaggggggccgggtgcaatggctcacacttgtaatctcagcactttgggaggccaaggcaggtggatcacctgaggtcaggagttcaagaccagcctggccaacatggtaaaaccccgtctctactaaaaatacaaaattagccgggcatggtggcacaagcctataatcccagctactcaggaggctgaggcaggagaatcacttgaacctggcaggcggaggttgcaatgagcagagattgcatcattgcactccagcctgggcggcaaaaagagtaggactccgtaaaaaaaaataaaataaaataaaataaaataaaataaaataaaaaaagaggaaaagagtgctttttaaaaaagtaagattcttagcattttttgaaatatactctcttgacaatggtactggtcaatggaatttttagtttaattgaatttaaatagaaagtataatcatttatgataataataaagtagtaggccgggcacagtggctcatgcctgtaattccagcactttgggaggccgaggcgggtggatgactaggtgaggagttcgagaccagcctggccaacatggcgagaccccgtctctactaaaactacaaaaaaaaattagccaggcatggtggtgcacgcctgtaatcccagctactcaggaggctgaggcagaagaatcacttgaacccgggcagcagaggttgcagtgagccgagattgtgccactgcactccaacctgggcaacagagtgagactctgtctcaaaatgaataaataaataataataaaaaaaacagtaataatagtaataaactgttatgaaagaaaatcaaagccagaaagaagttaaagtggtaaaggccaattttattcagcaactattgcaataggagagagaccttactatacaacgaggctgcattctgatacaacaaaggcaagtggggatttatagccaagaagcagggtggaagtcaggcaatggaacattactagaaggagatatcaaagataaggggattccccctaaaccaacttgataggattcttgctgaaggcaggcaaggctaataagatatgaagagtggaggatgaggaatttgaccatatatgaagggtggaggatttttgctaaacagacccagtaggattcttgctaaaactggactgtcagggccaaggactgagcctaagaatgaggcctagtcaaaaagaggactcaaggctgggcgcggtggctcacgcctgtaatcccagcactttgggaggccaaggtgggtagatcacctgaggtcagaagttcgagaccagcctagccaacatgttgaaaccccatctctactaaaaatacgaaaattagctgggtgtgatggcaggcgcctgtaatcccagctacttgagaggctgaactaggagaatcacatgaacccaggaggcgaaggttgcagtgagctgagatcacaccattgcactccagcctgggcaacaagagcaaaactctgtctcaaaaaaaaaaaaaaaaaaaaaaggactcagaggaacctgactaaaatttggttcaagagagagtctttgtcactgtttagttaatgtcatatgccagccattatgctaggaatatctatatctatatatctgtctatatattttcctaagtgaccgccaaagcaatactatgaagtaggtactattactaactttattttattttatttattttattttattttattttatttattttattttatttttgagacagagtctcgctctgttggccaggctggagtgcagtggtacagtcccgagttcaagccattctcctgcctcagctgcccaagtagctgggactacaggtgctggccaccacacctgactaatttttgtatttgtatttttagtagagacggggtttcaccatattggccaggctggtctcgaactcctgaccttgtgacccacccgcctcagcctcccaaagtgctgggattacaggcatgagccactgcacccagccttaactttattttaaatgtgataaaattgaggctatagaggttcaaccatgtacaggagatcacataggtaatatgtgtggttcatgagggtcagaattccaattttggtctttccgacattaaaccttgtgcttctaaccatggtattgtgctgcctccgaggttagacctgtttgaaaatctgagataagttctacatttgttccctgtgaaactgtttttttgcttccttttcaatctctctcaaatgggaaaaaaaatgttctttttgaaaggattgtaaactgatttaaaaattagctgctcacttataccatctcctccagaaagccttccctaatcatagcaatcaaaattaatttccctattccctgtatttttataacattttaatactttgattattgtacttgctggtttgcctgtactctgttcatgtacatgtacatatctattttgcatactggtttatgtactcttttcagatacagattctgattcatattttgagtacttcacaacaagcctgtaacaatgctttatagaaagtcaagtgcttaataaatgtttatttaaataggttagagtttattatataattaatataaaacttaacattatggccagtaaacagaacattagcttgtttttctggcatagcctcagtttaacagaagaaaggagtctaacatgtttcaaatgttattcttttatcatgtcttgatttaaaatgcagctattgaaaattatgtcttaacagattttaagatagaaatcacattctaagaccctgtctgaatggagcatatttttaagggtccgttagcacaaaaattttctctttgaagagttttgcttgcttgaaattcaccctgaaattacgtacactatgagctacatttttcaaactttgttcagggaattgatagacatttggtgcatgatgctaatggtgagaagagaatatattgctcagttaaaggatacataaaccctttcaggccacaagagactcatctgggaaatcatctttttcagaacataaaacggaacttaatttgtctgaaagagttaatgtaccctcaacctgacaaattctaatcgctctcaccagaagctaagttttaaaagatgtaaaaacctttctgtgggatttattcatattgagtagaaataacacaaaaaagaagcttgaaagaataaattacccaatatgaatgtggttttttgtgtgtgtatgcacataaggaacatgtagcatgtgcacatgtctattcgtagatgtaaagccattttggtatttataagactataaattggatatcataccaatgaatctgtgaatttgttttctttgctttgatttaaaatgtggtaaaagttttcaattatgaaacacgtggtatcttaagcatacatagtttacaggtaataatagtgatgttagtataattcctcaagtaatatactctggtgcaaaatctcaatcatgtactgttttcataatgcagaaaaatatatcagtatgtttttgtataataaaagtgtgtttacttatttctagttaggatgtgtttgacatatagcttatgaaaagtatggcaagtaaacttggcttttcattcagtaatccctgctcttttcttctgtttttgtttgtttgtttgtttgtttgtttgagatggagattctttctgtcacccaggctggagtgcagtggcgccatctcggctcactgcaacctccgcctccaaggttcaagtgattcttctgcctcagcctcccgagtagctgggactacaggtgcataccaacatgcctggctaatttttgtatttttagtagagacggagtttcaccatattagccaggctggccttgaactcctgaccttttgatccgcctgcctcagcctcccaaagtgttgggattacaggtgtgagccaccacacccagcctttcttctggttttaaattgctttacaagatgaagactgaaaaaaaaaaaaatacaagaaagtataggaaatcattgtttaataatcatgtaatcatgctgtcttttatgttgcaaatgtaagataggataataatgtagtacattgtctgaattaattaatgaagtgaggaatggaaaaaaatatatgacattactgaaaattatctaattgaattttaataataggattgtatgtatacctagtaagacatatatttatagaactataatcaatttgagaggatcatatctcagctacttatttaaggctaagggattcactaatggtaagaatggaaaaatcaatgaaaaatttaaaaaggccgtgtggacaagctttgcaaagatcatcagtgaggagaataggacctagtcacaaactgatgatgtctgaggagacaaagggcatgagtaactgagttgacaatggttctgagaggtaacggtaacaaaccctctttatcgtatcgaaagcaaatatctagtaagtggcttttcatatctgctaagacattatcaaatttgtgcacagcaactctgttcaattactgatctctagatgcctttatcataggcctgactcagaacctatatataaaagtaccttcaaactttagtgttctttcagatgccaagtattttacttaatccatgtgaatgaaaagatatttggactgggtatccattgagttaagctctagccttggtatttgtgaacttaggaaagactgtttacccagtcataaaattgaaaaaatcatacttggcttgcctacttcatataaattgttattaaaattaggtataatagagtgacttttaacatgccttgcaaaatggaaaatgctttgtaaaatagaataaccatttaaaattgtcatttatgtatcattctcccctaaaccgcacaaataggaaataattctatcccccaaggaaaatgttctttgtttaaaaaaaaaggcctcttttttccaatttcattttatctaactttaaaaacatttttaagttctagctaactttgctttttgtatgtagaccagtaaagggcacatttttcaaaatgtagtgaatgcttgtagagtaagcaggatgctaacacctcattattcaaggaatatccagatgttcagtgttaaactttgattccttacttttttcactttggtaggaaagaggaagatggagcaatagagtttgaaaattcttgcatactttatgaatgatgacattctatatgctatgacacctataaaataaagattaagggggccaggtgcagtggctcatacctgtaatcccagcactttgggaggccaaggtgggtggatcacctgaggtcaggtgttcgagaccagcctggacaacatggtgaaaccccgtctctactaaaaatacaaaaattagccaggcgcgtggcacgcgcctgtagtcccagctactcgggaggctgaggcaggagaaccgcctgaacccaggaggtggaggttgcagtgagccgagatcatgccactgcactctagcctgggagacagagcgagactccgcctcaaaaaaaataataagagccagtcacggtggctcacgcctgtaatcccagcactttgggagactgaggcgggtggatcacggggtcaggagatctagaccatcctggctaacacagtgaaaccccgtctatactaaaaatacaaaaaaaattagccggtcgtggtggcgggcgcctgtagtcccagctactcgggaggctgaggcaggagaatggcgtgaacccgggaggcggagcttgctgtgagccgagatcacgccactgcactccagcctgggcgacagagcgagactccgtctcaaaaaaaaaaaaaaaaaaaaacaacaacaacaacaacagaaacaaaacaaaacaaagaaagaaatgatcttccttccactgctccaaacttctaagacaatgtatgtgaacgctcaacacagacagaaaacctctactgatatctgcctgaggcaggcaaatcacctgaggtcaggagttcgagaccagcctggtgaacatggtgaaaacccgtctctactaaaaatacaaaaattacccaggcatggtggcacgtgccaccatgagtagtcccatgagtagtcccagctatgagtagtcccaccatgagtagtcccttgagtagtctcatgagtagtcccagctactcaagaggctgaggcaggagaatcacttgaacccaggaggcggaggttgcagtgagccaagatcctgccactgcagtccagcctgtgtgacagcatgggactccgtctcaaaaaaaaagatcaaaaatgttctgagaaaacatcaagtagacctctttggctggaagtagtgagagctgttactaagaaagagggtaaaaatcaaattctaaataattaataatattggtctaaggagtttgaacagtatttggtgggttataaattgctgaaaggcaagaaactcttgttccgtcttctccctgcttccagccaccacatggtatttgcctgagagtgatacttgctacctgccaactactgatccaagtaagtactaaagtcagaattgtttccagtattagaaaggtatgtgtgtgcacccagactcatgtgtctgatggggcaaatggttatttctttgtcttcaataatgcatttaactgttctgtggttgaatttgtaatacagttataataacttgcatttatatagtgttttaaagcttgaaaagatcttttatcttctcatgtctaaccctaaatgttctgtagcaaaaattatcatattaagttttgttttgttttgtttgagacggagtctcactctgtcgtccaggctggagtgcagtggagtggtctcggctcactacaacctctgcctccttggttcaagcagttctccctgcctcagcctcccagatagctggattacaggcgcccgtcaccactccgagctaatttttgtatttttagtagagatgggctttcaccatgtaggccaggctggtctggaactcctgacttcaggtgatccacccgccttggcctcccaaaatgctgggattacaggcctgagccaccacacccagccacatattaagtcttgcacctacttgatgttgttgaggattcatccatttcacaaatatttattggttgattactcactgtgtgccaggcactgtgtcagatagttggaacacagtggtgaacaaaaaagatacaatgcttactgtcaaggagattttactttgctaaaagagatagacattcagcaactacataagcaactatggcaggtgataaggaagagatttataatgccatgccagtcaacaacctagttacaaggactgccctccagagagaataatacttgagctgagatctgaaagatgagtaagaattaattcagggaaaaggtgaagaggaatctttacctcagcctgtttatctacaggtgtttcaaatgtttgacagtttggtaccttggcgatgatttggttagtttcttgtttatggtcttactggatttacaatcctagtggagttttaaagttggagttagaaatctctcaaattgagccaaatcctgaggacattttatgtttaaaaaaccctcttaacttttctcccccaaaagttgcttttttactattggctagggattgagtatggatatttttgaaaagctatgtcagattccgtggaaaacctaaagctctgtgaaccttgtgggagctggaatttttcagctaagaggttcgaatagatttaggtatttatccaaaccgaacttttaaaccaccagagatttgcccattactagtttacatagagcttaactacagtggtttcctctttcaacatttactttttttatttaaacagcttaatcgagagctataaaaacactggatcagtcttttcaaataaaaatgaaatgcaactgccatgcgttagtcttttagaagaagcccttctgcctgtaggcagtttaggtgttaaaatgatggctttttcaataccaaaagatctagtttttgtttgcaaggtcatatctttgaattattagtttataaaaacctggcatatcttcgaattataagtttataaaaacctggcagttcttttgattttagttacaagtgcacacgtgtgtgtgtgcacgtgtgtgtgcatgtgtgtgaaacaccaagagtcatgagatttacattattggcttgttaattaagggaagaattccataattgttttaaatcaatcacactgcacaggggacattttgcctatttgtttttctgcacatattttatatgtcattgtttatgtttgcttaaaatgccaagatgtgcttaagttagtaatgctaatattgatccaaaactctcaatttatgactgattcttcatttttttcttttgtaagtcattgctttgctttaactcttaatgttatcgggaataaggtattttaatactcatttcctttagaggaaataaaaatatcaactttctttttttattttttatttactttatttttatttttagagatgaggtctggctatgttgaccaggctgctctcaaacttctggcctcaagcagtcctcccatcttggcctctcaaagtgctggaattacaggtgtgagccaccacgcctggcctcaacttttcagtaaattaacctggaacacagaaagtcagagaaatgaaataataattccaagttatgcaaataagtacatttatgtacaaagggattgtattaggtgatcttgagcatcactttcagctctaaaaagttcttatattgccaaagctaggtagtacgttcatccttgttctgctcaaacattaaatgcttaaatgttgaattaatttcttctctgattcatcacaccagtattgatattataatattgtgacatcattcctactggtcacaaattcatctattcattcaacaaatatttatcaaaaaaaagtttatcagatacctacaatgtgccaaaccctgtttttttcagtggagattcagtgatgagaaactaaaaaaaaaaaaaaaaaaaaagaaaggcctttgagcatatattcacatatattctagtgttgtagagcatcaaaataaatatgtagtataatatcatacaatgataagtgataaggaaaataaaggtgagtaaaataattcattaaagaatgatagagacacttgtttttaaagttggccagggcaggacccctccaagggagtaacatttaggcagctgtttgaatcaagtgaggagacgatttgcgtgagtaactgagggaagagctttccatgaaggaggaacaactagtgcagaggctgtaaggaatgagcatgagtacaaacacacgtaaggtataacaggaagagcaagaccagtggctggattgcagcaagtgagggagaacgtagaaggagcaaggatagttctgatgtgaaatcatggaagacattgtataagggaaagtcattagagaattgaaaagagataatgacacaggggtgaggatgactggatgaggaagaagggaggttgtcggggtgatgaatcaagagtttggtttgagaggtgggaagtttgagacgcctattaggcatccaagtggagatgtagatatgtgagcctagagtataaggggaaggtacacattaaagacagaaatctaggagccatcgccatggaaattgtgtttaaagccattagactggttaaggtgacctaaaacacatgaacagacggagaagagagaggtccaaggactcaggtctggagtactccaacgtttaaaagtttggaagatgagaagaattttaacgaaggtgtaggggaacttaaaaggtacagcctatgtggtaggaggaagccagaaaattctgttggcctgagagccaaatgacaaaaatgtttgaagaaggatcttttgactaggctctgtgcattgattaaaaaggtattatatgtaaggcattgaacacagacagcagagaggagctagtgacttcagaaccctctaagtattttattgagaaaatgtagactcatatcatgcatctattcttttactttgttatttgttaggatagcacatgcattagatttttttcctctatcatagctgactatttccagatcaatcaaaatgtccctattaagttgtcagttacatcacagataattgccataagccattcatttcatgtttttagtatcctgtgcaataaaacgctatgaaacactttgaacagttattcagtgaaatctcaattatctggaattctagtaagcatatatctgtttatagataaccaggattttccaaatttgagcattaaccatttgaatgctagaatatttttttaaggaaaagccttctaaagtgcattattatattgagcaccagccatgtgctaggcgttttattaggcactataactatacattcttatagcttatggacctttgtaaataggatgttccaactgttatttatttatttatttatttatttatttatttatttatttatttttgagacagagtcttgctctgtcagccaggctggagtgcagtggcacaatctcagctcactgcaacctccgcctcctgggctaaagcgattttcctgcctcagcctcctgtgtagctgggattacaagcatgtgccaccacgcccggctaatttttgtatttttagtagagacggggtttcaccatgttggccaggctggtctcgaactcctgacctcaggtaatccgcccacctaggcctcccaaagtgctaggattaccggcgtgagccactgcgcccagctccaactgttagttttttatttatttatttatttatttatttatttatttatttgagatggggactcactctgttaccccagctggagtgcaatggtatgatcacagcttactgcagcctcgacctcctgggctcaggtgatcatcccaccccaccctcctgaatagctgggactacaggcacattgctaccacgcccagctaaattttgtattttttgtaaagatggggtttcgccatgttgcccaggctggccaactgtaattcaactacatcttaatgatcttagattatcatcaattcctctcagctgctgtagagatatttatctgataatgcagtatcatatgcctagaaggctttttttctctatccttctgaaactttatttcattttttgctttaagaaggtcacataggtgctctataggcacagatgattgtttggccccttgtgtgtgaataaatgcacatatgcctctttctcatcgttttcagtcattctgtgtacatatatgtctcacagaaatactcatgcatagacacacagacacacacacacacacacatgctatacatttcagggcactatattgaagcaaatatgactattcattttcttgctcacacatacacacacatgtacacatgtctctgatgccactgaggcacctggccaagtggttaattaacctttgcacaaatatattttagaaaagttatgtggcatcaagggctacattactgttggtcctcacaacttcttaccctcaaggaattcagggatggtcaatcttctccttagaaatgactttattcggctgggcgcagtggctcacgcctgtaatgccagaactttgggaggctgagatgggtggatcacgaggtcaagagttcaataccagcctggccaagatggtgaaacctcatctctactaaaaatacaaaaattagccgggcatggtggcgggcacctgtaatcccagctacttgcgaggctgaggcagaaaattgcttgaacccgggaggcggaggttgcagtgagccaagatcacaccactgcattccagcctgggtgacagaggaagactgtctcaaaaaaaaacaacaacaaaaaaaagactttattctctgttgtcagtgtatgttaacccttttattgcatttaatttctacaggtgttagtctactattatttttgttccagtatctcatcaagtcaaataagcacagagtaagaatttcaaagctagagagggctgacaataatagaaaacagaaacatactcaatatatactcctctctcactatgaagctggggcattgcatgaccagaggagtggtactttagtaagattgctctgccaatctagtcattgcatgcagaatgaataaaaaaagggagagactgaaaacaggaaaatcagttaagagagtcaaatatttcctatgtgccgctcagtgttctgggccttcagtctcagagagtaatgaaacggatgaggtgcctgctctcatggagctaaaatttacttgggcatggaatggggtttgggattcagtgctatgttgtgctaagtgctatggaaggaaataaaaccaggttatgtgatggtgactggggagccactttaggttaggagggcctttttgtcgtggtgacgtttgagctgaggcctgaaatatagaaagattccagacatgtaaagatctagttaaaagcattttaggcagggagaatagcttgttcaaaattgtatggaaatggacataaacttagcatattcaagaaacaaaaagaaggccaatatggctggttgtgtggttaacaaaggggagattagtataagatgaaaactgagaaaaaggtagggacaaatcatgtaggtccttgttggccaggataaggagtttggagataactatactaatccaagtgttcagtaaatattattatcactattgagttgagttttaactagacagttctctaaatgagttagtcagtgtttaggaataacccatgctcacagcatcattaaatgtttactgttaattctcactgctctttctcggtttcttgcaaggcattgttgcaaaactaatttatcacatacgttcctagttggggttcttaaaagaacatttctttttctagtatgacagtacagaacatgtgtgtgtatatatgtatatgtctgtgtgtatacttgcatatactatgtctgaaaaatacttttattctgattgaccctttgtacatttctcaaataatatagtttaactacccttgagccagaaactgtgtcagatgctagagatctaatggcgaataagtcatagtacttgtcctaaagattacagtataaataatgtattcttttgatcacaagaaagcttcgtccacaactttgaaggaacaagtactggctattctcctttattattttatgcaaattattatgtttcataaggactcattgccagcatttattttgtttatggactttgaaagtaggagtttcattaactctcagtttggacagtattatctttacatgcagttagtgcagtgactgtcatcatccttattagaataccaccaggacatctggcaagatgtctaatataaagcagctatgttatctatttccaatcaaatgattctttggtgcttcgatgtcctgtaacttctccacttatgtaattctctgccataatctaatttgtaaagtggggtgggagtaaaagaaaatttagaaagaaacacagagcacaaaccctttatcctggtaaagcatctcatgtttcaatttgcagttgttttggtaaagtataaaacaagaaatatgattataaatatagtttttattttttactgtgggtaggatgttttttgactaacacatgcttttaattgcctaatctattttggctttacctttagagaaaaattactgcactttgctgcatctgtcaaaaatgacacgataattctttgagtcaaaacagggtacatgaaatgtgatttttgtttattttctgaagaatagcagaactcattttttgacacatcctttactgtggttaagactccatggcatagaacagactgcttattttgaggttgcaaagtacagctaacctacaagaataagctctctaatatcttctatcaaaccaagaaatgatctgtttcacatgcacatagaaaagaattgattttcttacacaggatgctgccacttggactgtacatagagttgatttgtaatataaattaactcaccaattatcgattgttccatctgactttgaacacattaagaatctgcaaaaagtttctgagttatcaataataagaaagctgtgtatgaaatgtaatggggtgcgtcagctggatccgagttagatattgctgtaaatgttgcttagctttgccatctgtcacatactctttttgcataatattttaatccattaaaatgtgtctttttcttttaaaaaacattagcttacttaggttacaatgaaaaccctttaagaaacagtcagtgaccactgacctttccatgtcttaagttactttgtaactgtttttgcctttgtgccccctcattaagatgaataatgacaatccttagaaacaggaaatgccaagctcccagttgcaatgctaacaagtaggaagtcccattaacttttcaacttctcagacaagaaataaatttggacatgagacattatttctgaaactacttgtcctcaggagcagtgattgaatgaactaaggacttgctttcactaagtggaatggaaaactcatgtcacagcatgtcagtttctgcttaatgaatgagatattccctggggaataaattaggcgcctcacgtacataactcttttagggtacccagacctcattgatttccttttgtagaatagtacccacgtgacttataagactcactgtacaactaaactgactgactttgaccctcatgaatagttttgtcacctgggagggtttggttagaaatggtctccaccccttaataagaaagtcagctctttgctccctgttggctcactgctctcaggccactaaatgaaaggcacttgggtgtcatttagagccatttaccaaatgaactatcttggcctgagaaagttaagcactgttgggcctggcaatttaccataatcaaagagctagagcagaaaatatgcaagatctgatttctggccaatttgtgtttttcccgtgttgctcttggcagatctctgttttgagtagcccactcttctacttctctccatgttattaatttgtaaagtgaaacaaattactgacccttgaattgtgctattacacatgcttgagtaattttatttcatttgcagagaatttcatttcatttatgtattatttatactctacctacttccgaaacaatgtgtactggcttattttaattgtaattcaaatcatctgagtatttttccaagtcctgtcctgaagaagacttgtgtcatcacacatcatttcacatttactgtgctatggtgatatattggttatgatgcaatttctctggccacctaaaaacgactgtattaacaaaacatcatgcctgcagtctaatgtaacttcttttgttgtggtgtggtctattgggaaagaacatgcaacttacagttatgtgcttagttctaccatttatgtgacctagggaaagtcatttgccacatcttgctcaagtttactcagttttaaatgtagttgttaatgcttactccccaaacctttcaaggttatggaaatcaatgcagtaaatactgcatataaaatgtctgtgaattcccatatttctccagttaacaccaggaagaataattgtcagctgaactgaaatgatcaagcagcgttcttgtattcaggcactgttcttttttttttcttttctttcttttttttttttttttttgagacagagtctcactctgttgtccaggctggagtgcagtggtgcaatctcggctcactgcaacctccgcctcccaggttccagcgattctcctgccccagcctcctgagtagctgggattacgggcactcaccaccacgcccggctaatttttgtatttttagtagagatggggtttcaccatgttggtcaagctggcctcgatctcctgaccttgtgatccacccgcatccgcctcccagagtgctgggattacaggcgtgagccaccgtgcccggcctcaggcactgttcagacaaatgagggatggagatgtgacaagagagagttcctattttgaggagccacagtgttgtggtgaaaaaggcccagcacacaaacaattataaaattcccaatgggataagtggcacaagtgaggtatgcaaaagtgtcatagctgacaggaagaggaagcaatgaactctggccaggaaaatgggaactaagtgaaaaattagggtaaaacaagataacgtgtgggaaattccttcagaaacactctgtggatactaagacacaatcttatcaatgtcatttatttaacaagcatttatgtattatttacaatttgccagacaatgttctaaatgtcttacaataggaaatcatttaatcctgttcattcaggtctgtttgctgcgaaaaggaattctagaagcactaaggaaatcctagatacagagattcctttgtcttctagtaaggaggaagcatactgggtcagttaacatccacatgtctgtgaggcaaatggttagaaaagtatataccaaaaataaatgaatgaatgaacaaactaaggaataaagacacaatgaaggagatactatttttattttatttttttttttttgagacagagtttcagtcttattgcccaggatgtagtgcaatggcactaccttgactcactgcaacctctgcctcccgagttcaagcgattctcctgcctcagcctcccgagtagctggaattacaggcatgtgccaccatgcctggctaattttgcgttttgttttgttttgttttttgaaatggagttcctctcttgttgcccaggctggagtgcagtggcgtgatctcggctcaccacaacctccgcttcccaggttcaagcaattctcctgcctcagcctcctgagtagctggcattataggcacccgccaccatgccccactaatttgtatttttaatagagacggggtttttccatgttggtcaggctggtcttgaactcccagtctcaggtgatctgcccgtctcggcctcccaaagtgctgagattacaggtgtgagccactgtgcctggcctaattttgcatttttagtagaaatagggtttctccatgttggtcaggctggtctcgaactcctgacctcaggtgatccgcccgcctcggcctcccaaagtgctgggattacaggcgtgagccaccatgctcggccttgaaggagatactattaacctcattttacatgataggaaaactgtggtacagagggactaagttgcccaaggtcacacagctactaagtggcagacctgagtttgaaccaaatgagtcaggctctagaggtggcagccttaacaaggatgctatactgcttctcccatcacccatcaacacagaagtggacatctttattgctggaatccagcactggaatcccttggtggtccttttgatctctgtttcagtacctatagaaacgacaaggacttaaccagctcttgaaacagctgactacatttttggacagttgtaattactagagagttctgaatttgagccaagatctacttttcctggaacttccacccattgatcctatgtctgctttctgacactacatagactaaaccttcttccacataactgtaaaagtattggaaaacatctcccatgcctcctgcttgaattccacattcccatgtaaaaagaaagtgacatttgagagcaattagatttcattattccattgagcatttatttatggggtgcctattgtgtgcaaattgttatacagtgtgctagcaatcgcagagaaaatgaatagcaccagattcgcatgtacaaagtatgtactctgcactaagctattccactgctacccaaaatgtgcaattatcatttaagatacaaactaatgaatagaattattgcctgcacttatttaaatcagggtttaaataagcagtgtcttgctgggtgcacctgtatacatgccttaattaccccacaggattacaaacctgtgggcagaaactgctaatacagccttgtatttcctaccacacctagcacaggttctttggcagagtaaatgagcaataaatatttttgaatgagtgagagaaatgctgtattcattaatgctgtccttcagataattgctctaaatgatgttcacatgtgatcataacaataacaaatacaattttactttgctgtttgaatttcttcaagttttgtgtgccacattaaatagcactagagaagcaaattttcccagaagaaatgtcgtagtaaaatgtttgaaagacagcaaggtaattcaacagccagaaatacagagctttatagtactgatcagtcttcaactctttttgaaaagattcactgttatcaactgagaacctctccaccaccatgtgagcccagtaaaggcattttctaggttaccatcctggggtgctcctttggtaccaattgttctaatattattattatagtggaaaatgcaacaacatcattgaacctgtaccctgacctttcagttggccttggtgtagagcatcacacagtcaaagaatcaagttcagatcagattttaatcccactacattactgtttgctctgctttttgaggagattgcaatgactatatatatatgcacacacacacacacacacacacacacacacacatgcgtacagacatacatatatacacatatatgtatacacactgtattttatatatctatggaaaatatgtatttccattctgtagtctatgaaaacttgtatgaatggggcaaggtacaatacacaataaaataataatgcccatgttaaaaacttttttttttctttaagatggagtttcgctcttgttgcccaggctggagtgcaatggcatgatcttggctcactgcaacctccacctcccgggttcaagcgattctcctgcctcagcctcccaagtagctgggactacaggcatgcaccaccacgcctggctaatttttgtatttttagtagagacggggtttcactatcttggccaggttggtctcgaactcctgacctcatgatccacccgcctcggcctcccaaagtgctgggattacaggtgtgagcccccacgcccagcctgttaaaaactttttgagtgcctatttgtgaacaagaaacctttctgctgtctcatctggcataaccttaacatcacgcatttatttgtgctacctaacataattagccatgatagaaaactttaatgtaaaagaaaagaaaagaaaactttaatgtagcatcaaatcttgaaaaatcattttaagattcagttgattattttattagccaggacctctgtgaaatgactctaggatgagaactaaaatataatggaatgggagaggttcattcattatgttagagatttggatagtgctaggcctttaattaattaacatttcattaataatctgtaaggagtaccagtaaacagcactttaattaagttcatgggtaatacattaataggtatagaaaataccaatgaagacaggaaaataattcaaatagaccagataatttataagatataggaaaataacaggaattccactggccgcatgcagttccctactcaagcaaataaaaggcagtattcactgcatacattggggtatagaaaataaacaagtacaataagtaaatatccttgttggctgagcgcagtggctcatgtgtgtaatcccagcactttgggaggccgaggcaggcagatcacctaaggttgggagttcgagaccagcctgaccaacatggagaaacccagtctgtactaaaaatacaaaattagctgggcatggtggcacatgtctgtaatcccagctactcgggaggctgaggaaggagaatcgctcaaacccgggaggtggaggttgtggtgagccaagatcgtgccattgcactccagcctgggcaacaagagcgaaactccatctcaaaaaataataataataaataataaataaatatccttgtcaacaatataatggctacaagaagcaaaaacttttgtttctggtggggcctctgaatatatttctacatatagaaatgtaagaatacaagaaatacatacaagaaatatgaataaatttttatatattttggctttatgcatcttagaaacaaaatgattgtatcatctgaatgacagggctagtaaagaacctacatttactgaatgcaaactactggccagttcctgtatttaggcatgataaatacattgtgttttctttaatcttgtctctttttataagttcagatacatgaaaattaacaaggtttcatatccattaagtggtagagcttggttttaaccccgatctttctatggtacttccaataatgatatggacgattgcatgattttatgtgtgagcacatgtgtgtaaaacaggtttggatacatttaccgtcaactaaatggtatactaatcagtgatactcagatatttttcagtaagtttcagtttaggggggatttgtacatgtaaaatggctccaggagtctgtttgactaattaggccacctggggtctcatataatagttattttaggtttccactgagtcagtacccagttatacatgttgtttgacattggtcattttaatgaatacttgagccttaggaaactttatccattatggcaataattttatatatttactcttggccttgacatcattcccaggcagaagtagaagtggtcatcatcattttccttctaatgacttaaaccaagtcatttgctgttgaaactttaacagcaaataaaactagcggtgtgtgtgtgtgtgtgtgtgtgtgtgtgtgtgtgtgtgtgtgtgtgtatagagagagagacagactggaatccgttttgtttttcctatctctaaagtgcatgaattaaaaagatactaaacatacatctttgagtttatcagttcatcaggaacacatttttgaaaaccagaaggactctggataagtacaacttgttttggttataagaaacataactagccaggcacggtggctcatgcctgtaatcccagcaatttgggaggctgaggcaggcagatcacgaggtcaggagttcaagaccagcctgggcagcatggtgaaaccctgtctctactaaaaatacaaaaattagcctggcatggtggcacgtgcctgtaatcccagctactcaggaggctgaggcaggagaattgcttgaacctgggaggcggaggttgcagtgagccgagatcaccccactgcactccagcctcggcaacagagcgagactccatctcaaaaaaaaaaaagaaaagaaacataactaaaagtcatatatcttgttggcagtgaatcagtagaatcatgtcaacatataaaggactattttttactgtcatttttcagcacaagttttttttttgttttttttttgtttttttgtttgtttttattgatcattcttgggtgtttctcgtatagggggatttggcagggtcataggacaatagtggagggaaggtcagcagataaacaagtgaacaaaagtctctggttttcctaggcaaaggaccctgtggcctaccgcagtgtttgtgtccctgggtacttgagattagggagtggtgatgactcttaacgagcatgctgccttcaagcatctgtttaacaaagcccatcttgcaccgcccttaatccaattaaccctgagtggacacagcacatgtttcagagagcaccgggttgggggtaaggtcatagatcaacagcatcccaaggcagaagaatctttcttagtacagaacaaaatggagtctcccatgtccacttctttctacacagacacagcaacaatctgatttctctatcttttccccacatttcccccttttctactcgacaaaactgccatcgtcatcatggcccgttctcaatgagctgctgggtacaccctgcccagacggggtggcggccgggcagaggggctcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggctgggaggtggaggttgtagctagccgagatcacgccactgcactcagcctgggcaacattgagcactgagtgaacgaagactccgtctgcaatcccggcacctcgggaggccgaggctggcagatcactcgcggttaagagctggagaccagcccggccaacacagcgaaaccccgtctccaccaaaaaaatacgaaaaccagtcaggcgtggcggcgcgtgcctgcagtcgcaggcactcggcaggctgaggcaggagaatcaggcagggaggttgcagtgagccgagatggcagcagtacagtccagcttcggctcggcatctgagggagaccgtggggagagggacagggacagggacagggagagggagagggagaacaagtttttaaaataacttttttttaatttttattttatttgagttcattcctaaaactatatgtggtagtaaatttgtaaacaaagtcaggacttattttgctaagtcaccgcagtgagttccttacataaataaggaagacacctgtttattagtcacaaagttccaaccacatcttgttttgcacttctaagagatggaatacccccaatgagtttcctttgctaagcacagagaaggaaacaatgctgatttctagactttatagctaagcaacatttatgctttcagaaatgacctcagaatcctcctcaacacagcattctaggcagcatttatcaattgctttgagttgtaatgcaagccgaaacatacttatctcctccagagtttaccacttaaatggctcatcatgaatgagaattgcctttagtcatgactcagtgtgacattaagtagtttggacataaattatttggaatatgatagatagcctttatatgagaattgtacctgatatatataaattttgctagctgcattccatagaataagagaataaggtgactagatcttcaaggtactgaagttagaaaaactgattgaaatgaaactgtaagaaatgcctaagtggtacaatctatgatcatctagaactgtttctgctagtcaatgttagatactttatcatgtgattaactgaaaatgttctttaaaaaatgccacaactaaagaggcatgtggggctgggagcggtggctcacacctgtaatcccagcactttgggaggccaaggtaggtggatcacctgaggtcaggagtttgagaccagtctggccaacatggggataaccccgtctcttctaaaaattcaaaaagtagccaggcatggtggcgtggacctctaatcccagctacttgggaggctgaggcaggagaattacttgaacccaggaggcggaggtggtagtgagcagagattgcgccactacactccagcctgggcgacagagtgaaacactgtcgcaaaaaaagaaaaaattaaaaataaaaaaaaagacactgcaacggggtgcctttcaaatattagctgaaatgctagaggaatatatcagaggagagaaagctcacccctagaagaaaatgttaggtatggcttcatagagaaggttgcattaatttcaggccttgaaagatgggtaagatggtaggcagaaactggaacagggtccacattccagctgtacagactgtatagagtttcttgagccaggataatgaatctcaaggtatgttccctgaagacctagctgagttaagagtacctggtaagtccagctaaatcctctcccaacaccccttcctactggatttgggagctatccttatgcctcccattcttaccctgttcctcaatctgaatgttgattgtcagggaacttcagtataatccacgctattacttagcccaagtgggaatagtttgtagaaatgactatagccggttgaacatttccattccaaaaatatggattaagggccatgtttctttattgttagcattctcgctctgttgccaggctggagtgcaggggcgcgatctcggctcactgtaacctctgagtccctggttcaagcgattttcctgcctaagcctccggagtagctgggattacaggcacgcgccaccacgcctagttaatttttgtatttttagtagagacagggtttcaccatgttggctagggtggtctcaatctcttgacctcgtgatccgcgtgcctcggcctcccaaagtgctgggactacaggcgtgagccaccacgcccaatcaagaagagctttttaactagagattttaaaacaaatagactttaatttttagagaagttttacatttacagaaaacatgagcacatagtacagagttcttatatcccttctctacctttcagtttccctattattaatatcttgcattagtatggtacttctgttgcagttgatgaacaaatattgatatgttaacaaaagactatagtttatatttgggttcactctatatgttatacatatatgggttttgacaaatgtatgtcatgtatccaccattatagcattatacagaatagtttactgccctaaaaatcccctatgctctaccttttaatccctccttccctccccctaacccctggcaaccactgacctttttgatgtctccataattttgccttcttcaaaatgtcatacaagttggaattctgtaaaagaagattgccttcttttacttagcaatatgcatttaaggctcttccatgtcattttgaggcttgatggttcattgcttgttattgcttaataatattccgttatctggatgcctagaaacagccatgtatttttgaaaatagctccaagacatgtttctatttggctttgcctctggcacaggttgcagcatatcagtgtagtacaatacactgttataagaatcacagacactgagataaggaagggtctgcaccactggttcttccaacagcatgtgtgtagaaggatgcgagacaggcaggctttcaggcacctgaaggacatgtctgtggtttgcagcttactgcgtgcctttaacaaagcagttcacctctctagactttggtttcttcatcttgcaaacaaagggatgtgctagatgagttctgaagtttctctgaattctgaaatttgatcatctgctctcatctccttgtttaaaagttgagaaaagaaagcctggggaaattaactgatctgaataagaggaaatagcaaattattagcattacttggactagaaatctagtctctagatttggtctagcattttttctatcatttcaacctttatgtcctgatttttcatgtaagaacttatttttcttaagaactcctgattaaactaaattgattttttaaaaaaagaaacatagattgaaagtcactgaaatttttttttgagacttttttttttttttttgagtcttgctctgtcacccacgctggagtgcagtggcgcaatctcggctcactgcaacctccacctcccgagagtggggcgattcttctgcctcagcctcctgagtagctgggattacaggtgcccaccaccatacctggctaatttttgtatttttggtagagacgggatttcaccatgttggccaggctggtcttgaactcttgacttcaagtgatccaccagccttgacctcccaaaacatgaatctttttttttttaatttgagctttgactgcatagaaaatgtccatccagtctctgtttctaaaacatgaaattctttaacgttcttaaggcaaacaatttttgtaaaacttttcaccactgatggggttgctcccccttaccacaccagatttaagaggatagtgaatatttatgtctataatagcatgtgaagaatgtggctggtgaaaataagtggaagaatatacatctcgggctgtttcttcagtttccgggcaggctgcaacacttttaacactgctagtgagaagaaaggtgagagagttagctttcctcttggcttggttgcagttaaagtggattcccgaatctcccattttctacattataaatattgagagggacataaatatagatatatggatatgtttgtttgtttttctccctcctgtacttaacaagtgtaaaatcctggaattttctttttccttacttatcacaagttttcttagtctcaatcctttgtagtatttaaccttttagataggagaggtaaataagcccacaccagataagagttacatcacagtagctataattaaggaccggcatggagacatttttaataatagacttgcagccgggcgcggtggctcacgcctgtaatcctagcactttgggaggccgaggtgggtggatcacgaggtcaggagatagagagcatcctggctaacacggtgaaacctcgtctctactaaaaatacaaaaaaaaaattagcccaccgtggtggcgggtgcctgtggtcccaactactcgggaagctgaggcagaagaacgaacccgggaagtggagcttgcagtgagccgagatcgtgccactgcactccagcctgggagacagcgagtctccgtctcaaaataataataataataatgaaataatagacttgctaaatctgaggttaaagtgaacatttttaataatcagtcaaggttaaaatatttgtttaatatggtagtcaatgaaaaaatgttctaaatgaaaacctggtactaaaattattatgtcttcaggttgcctagagaagctggtgaggcactagatattacactgtttctcctctttggaatcatatagttttgatttaattaacagagaaagtctgcatatacaataggggatagagtgtggattttacttctttaatggtttgacaagcagattgcaacaaacaaggtatttggaagcctgctagggtcccagaggccttataaatatgcagtgcacttctctgcatttccccgggtccctgaggtagagatttgatgaataaaattaaaaccaccagatctttttgtatagcttttagctatcactaatttaaactgagtaatgactattttacaggtgtaccttcagcagtttaaaaagcaaaggaagtgaaatgtgaatgtgttttgactttgtattaatttcctcttaaactgaaagattttctactttttgcatcatgatacgttttctttaaacctaatttcaagagtaaaactctttacgcccctgtaggattgttttatatttaatagtgctattgagactggcatgggacaaaacatgcagacaaagaaagtatttcttgaaaagtgatgtgtatttatatataaacacaacgttggaatagcatactccatttggaacaaggtctttagaattagattttaatagattaaaactcttcttatttactgtatttgtagctcttaatgattgaatagatctctgtggttccttttcaaggatttcttgaaacatactgaaattcatgggtagatcatttaaggctcctgcgccctttaatatattacctagaaatggtagaatattttagaacacatacaaagaaggaggccgggcgcagtggctcacacctgtaatcccagcactttgggaggccgaggtgggtggatcacgaggtcaggagatcgagaccatcctggctaacatggtgaaatcccgtctctactaaaaatacaaaaaattagccgggcgtggcaacggccgcctgtagtcccagctactcgggaggctgaggcaggagaatcgcttgaacccaggaggcggaggttgcagtgagccaagaccgcaccactgcactccagcctgggcaacaaagtgagactccgtctcaaaaaaaaaaaaaacacatacgtaaaaggttaaggtaaaacacaattcattgtatatacatttgcaacaaagttcattaaagtctggggaaaaattgtataatgtaaagctccttagcttgatgtataatgaaaaaatgtagatattacgttaataataaatagcgtgaataatattggcactgggtatacacttactgaaaaggctgggcttttctaatgttaatcctgaggaagaggagagtctcttgcttaaaagtcaacactggtatgttgctttcaagaaaaaaagaaaaaaaaagcattgatgagggtatgaaatttatttactaagtattcagttgtgaagtttgaggagtggaaaaactaatttgtcaaattataccctcagagttcaacagtaaactagatgaagtctcccaggcttataactagcagaaggcacctatgttttgtctttgtgtgcctatggcttcacagcggcaactgaatctcacccagaagtgctaagttgtaattcccagtagccacttttagtgctttttgttttgcgttgttttgttttgtttgagacggagtttcgcactgtcgcttgggctggagtgcagtggcgcgaaattggctcactgcaacctcggctcactgcaacctccgccacccaggttcaagcgattctcctgcctcagcctcccgagtagctgggattacaggcacctgccaccacgcccagctaattttttgtatttttcatagagatggggttttaccatgttggccaggctggtctcgaacccctgacctcatgattcgcctgccttggcctcccaaagtgctgggattacaggcatgagccaccatgcctggcctttagtgcattttttaaagaatgtatccaaataacagacaattgaattaagaaaagcacattgtcatctttaatcctttccatttatttgcctcttgatagatgacctttatatttttgctttttgacaatttctacctgaggcatgatgtaactaaaatttctaacatgatagtggtagttctctggattaatttatgctcatggttttgctttgtttctcccttaccaaaatgctcttttcagtattacacaagaaaaagatcatgatttgcatcatgatgtacatagcaaatttcatgtatgatcgtgtttcctgttccatcacatttctggcattttttttaacccactgggacattaggatgtcataacataattggatgttagacataggttgagaaatcaagggtagtggtagatggaggctgacagacaccttccagatccactttagaggtactgagtattcctaaaccagttatgtaatttgcatgtggtcatatagctagttggtggccaaatcagggatacaacatgtatgtgagtatcattctatcatctatctatctacttattgacagataagaatatacttgctttgtgtaaatgattaccctttgattttgtggttgtcacaaacacatgaaactattcatggatggacctacctgtctgatgatggtggtagtgatgatgatgatgatgttatcctaggatataaccactattctttaacccttgaaactgaggtgcataaggtacaataattcgcccaagctcacatagataacaagtttgcagggctagaaatcttactgagtttcatctgaaatgcagactttcagagagagagagagaggatgcttagtgtgccatatcttacgtctaacaatggctaatgaatctttaaagagaggactactccctagacatgagcgtgttaggactctgttcccatttctacacatttatgcttatatgagggccattgattggccaattttagcatttctttgtactcgtgggatgatatttaaaatatttaacaactgccaggcacggtggctcacgcctgtaatcccagcactttgggaggccaaggcgggcggaacacctgaggtcgggagtttgagaccagcctgaccaacatggagaaaccctgtctctactaaaaatacaaaattagccagatgtggtggcccatgcctgtaattccagctactcggaaggctgaggcaggagaatcacttgaacctgggaggtggaggttgcagtgagtcgagatcgcaccattgcactccagcctgggctacaagagtgaaactccatctcaaaaaaaataataaaataaaataaaatatttaacaactaatatgtcatgagcattgaccaatcaaaatagatgcaatcgtaggctgaactggagtctaagaggcccttgctttgccaggtaccttttagctaacaggtcacgagtatgtctggggagttctgggatgaggggctagtgcagctaggacagaagttatttaccaacttgtatgaaaatatttttttagtattttaataaccaatgcagctatcctaatgtaatctgactaaatattagcacagcatcttgcccagcaagccaagacaacagtggttgttgtgatgttcataaggacatctcttcttggtgtttatgcatgcaatacatgagagttacaagattcctgggctaggcacagtggcccatgcctgtaatcccagcactttgggaggctgaggtgggtggatcacctgaggtcggaagttcgagaccagcctgaccaacatggagaaaccctgtctttactaaaattacaaaattagccgagcatagtggtgcatgcctgtaatcccagctactcgggaggctaaggtaagagaatcgcttgaacccgggaggcggaggttgtggtgagccgagatcgcgccattgtacttcagcgtgggcaacaagactaaagctccgtctcaaaaaaaaaaaaaaaacaaagagttacaagattcccgataagtgaatgaacatgttattgagtcatggtgcaaaggcaaactatatgcatcaggcacatttttttctctcgccagcctcccaggaagttctcaaattgtgaatatttggagttagagagagagagagaatgcttagtgtgccatatcttacttgtgtatctatctcttttctaagctatgaatacctagaaggcaagggctataacctcatttctatcccagtcccctagcacagtatgtggcacagagcactcaatagttattgaacaaataaaagcattcaaccccactgatgaaaagccattctatttgtaatctagagacataaattaaagatatcagtttcctaatcttgcagaagtcattaacctagctgcaagattacttctttataaaacaatgaaaaacagtacagtgtcaccattacaccaagtgtgaggccaactggaaaatgtttataacaatcagatttgcaatgaaagaaacctggaagcaaacccagttatttgaatgaattattccccttccacctttcttgtattttatgcataatgacatgaacctttcaaattcagctttctagaatgcctgtaagattcagttatggggccgggcgcggtggctcatgcctgtaatcccagcactttgggaggctgaggcgggtggatcatgaggtcaggagttcaagaccagcctgaccaacatggtgaaaccccgtctctactaaaaatacaaaaaaaaaaaaaaaaaaaaaaaaagattcagttatggtcaggctggcagtctgtataattgtttcaaatgctatgttgcatctttttgcaatagtacatcaatatgtcaggatggatactacaaacttggttattgctataatcctgaacttttaacctatatgtaggatgagcataacccgtagactaggatcaatacacaattgtgtctcctgttactttttttttttgaaacggagtctcactctgttgcccaggctggagtgcagtggcagtgatcttggctcactgcaacctccgcttcctgggttcaagtggttctcccacctcggcctcccgagtagctgggactacaggtgtgtgccaccatgcccagctaatttttgtatttttagtagagacgaggttttaccatgttggccaggctggtctcaaactcctgaccttaagtgatctgcctgccttggcctcccaaagtgctgggattacaggcgtgagccactgtgcccagcctcctgttacttctttaatatttattttgtggggattaccttgtcctacacctagatgaaaatctaggccgtttccatgacttttctgcttgcttttaggtctctaaagtttctgtgagttgctaatacaatctcagcccagaaactttttttttttttttttgagatggagtctggttctgtcgcccaggctggagtgcagtggtgcgatctcggctcactgcaacttctgcctcccgggttcaagcaattctcccgcctcagcctcccaagtaggattacaggtgggattacaggcacacaccaccatgcccagttaatttttgtatttttttagtagatacggggttttaccatgttggccacgctggtctcaaacttctgaccttgtgatctgcccgcctcagcctcccaaagtgctgggattacaggcatgagccaccgcgcctggcccagaaactattaatagaatgctaccctctagcatgctagcaatagtagcaatctaaactctcgggttttaagttaaaagtaaactgttttctgcttccaagctgggctgttgcaatgctagagggggcaaggtacttttctgctttgagaccctcctctgcaattcccttaatgtgggtaatatatttccttcagcttgccacttgcatgttgtcccagtcttctcagagctccatgccacacatattttaacaaggattctctggcggagtacgcctgaactcccagatgttcctcttggataggactgaaatacgggcacctctcactcccacgtggctcacttctagtccatggaaaacactcatgcaggtctttgccctgaaaaactctgagactacagagatcgaatcctgtctgtataccactggcatggggcaccttggcctcttcaggaatgacccagatacccctcttctgggtcccgcaacttcaaggaacacattccttttctgaatagcctgatcaatgtcccttcacttcgctcaacttgaagaatgtagcatctctgtccacatacttggcagtggggtaaggagcaagatggagcaggtgttatcatggcaacaacttcttccaaagaatgtctttcaaaatcctcttttcctccactacatttaccctttcatatttgtgaaatggatgagcaagcttccaacaaagggaatatgagaattataaaaatgattttaagaattttttggagcctggacaacatggtgaaaccccgtctctactaaaaggacaaaaattagctgggtgtggccatgcgtgcctgtaatcccggctatttattctctggcataaaaatcacttgaacctggaggcagaggttgcagtgagccaagatcatgccaccgaactccagcctgggcaacagagtgaaactccgtcgggaaaaaaaaaaaaatttgttttggggaaaattctgcatatggaaatctgtcttatacacacttttctatgtactgtttagctgatacacgtttttctatctactgtttatctgatattgccaatcactgaaaaatgcgaagagtcaaattttaatatctagttacacacaggtatgcttttgttttgttttatacctggaatgctttatatatcagtaggctatataaaattgtcaaaggcatttatgtactttgtagtgattttaggtatgggtgttgggtgctttcatttgtcaccacaaacaaacatattaccacagagtttagatgacacagtattagagtatggaatcaagctcttgtcttttgaagttgatgttgtgacctgtgtaaaaagaagttttaaaagtcaattatttaaaaaaaaaaaaaaaaagtaaagaaaagaaagaaaccagcctggccaacttggtgaaccctgtctctactgaaaataccaaaattggccgggcctagtatgcacctttaatcccagctactcgggaggctgaggcaggagaatcacttgaacccaggaggcagaggttgcagtgagccaagatcgcaccactgcaccccagcctgggtaacagagtgagactctgtctcaaaaaaaaaaaaaaaaaaaaaaaaaaaattaatgccttcacaaagacaaatatcttgtttatggtgaggaagacttaaaagcaaatctggattttctgtttgactgaaagagtctagatacaggattttagaacgatggtgattttggagtattatctgtgcagcaaaggaggaaaaacaaaacacatacaaatgaaaagtgcttctagatgatgctgagggcttggctgaggttggtgagtataaattagtattgttgctactttataattctgtgatttccttcagtatcctgcagtcaccctagtataacagcagagatagtacttgaagtatttggtccagagttagagctttacttggcagacgtggaagcagtaaggttaaaggaaattgacagggctagtaattatataatttaaatgatgaactgtggggccatgctaaattgtgaaggaagggaggccaggaatcaactaatagatggcttaaatgaaaagatttctgcaggccggtcgcagtggctcacacctgtaatcctagcactttgggaggccaaggtgggtggatcacgaggtcaggagttcgagaacagcctggccaacatggtgaaccccatctctactaaaagtacaaaaattagctgggtgtggtggcacatgcctatagtctcagctacttgggaggctgaggcaggagaatcgcttgaacctgggaggcacaggttgcagtgagctgagatcacaccattgcactccagcctgggtgacagcgcgagactctgtctcaaaaaaaaaaaaaaaaacaccgattcactctaagagcactttctcataaccttggaaagccagccaattagaactggttaagctcctcatttgtcctccttgattacctagctccctcatgaacttaacgtgtcatatatttcaggtgccccattttaaattttattgtgagcaacattccttctcttgtaacaactttattttcttagttaactaatgttttaatattgatgaattcttcccgtgtattttctaaactcaccaatttgtttttgtccagggtgttgctgcttctatggttattttgaaggtgctttttgctcaaatgagttatggactctatcaaccaaatacgggatttttgagacagaaatctgacattcagcaagggtacagaaatcttgctctctaaattgatgttaaaacataacatgtccataattaatgtattataacatttgtctataatcttcccaggtgttgaaatggtagtttcatactgcttgcctttcaacatatatggacattgtttaatccattcagaaattcagaaatattcaagataaatcacaaatacaaaacatgctgtaatgccactaatcttttctattagatttgctttaaatggtgtcatgtttatgtcttcatttacattgtccatttaataggcttccccagcagtcctgctctggtaattagctggcttatttatacctcaacaccttgagctgctacatctcatttaacttactgctctttaaagttcttgtatctcagtggttctcaaccctcaatacacattagaatcatctggggaacttttaaaaaatactgatgcctggacaccatcccagatcaattaaatcagaatctgaaagttgtagctctgagaaccatgggttcctaacctttgaccaatgccactgcaaacactgtgcttaaggtgaggttgaagcagtaaaaacaacaatccaatttttttttttttttggtttgttttttgacccagggtcttgctctgtcgcccaggctgtagtgcagtggtgtaatttctgctcactgtaacctctgcctcctgggttcaagcgattctcctgcctcagcctcccgagtagctgggactacacgcgtgtgccagcacacctggctaacttttggcatttttagtagagacagctttttgccatgttggccaggccagcctcaagtgagctgtctgccttggcctcccaaagtgctgggattacaggcatgagccaccgcatccagccagcaatccactgcttgacctcatcccttccactcttattttccttcccttggcagtaatttaaatatatatatatatatatatataattagatatcatcacattcatgggttatcaaaacttagtatttctccaccaaccctaaaatgccattggaaaatgcaatagaattctggaagtaagattgtatttgaaaattataaaagagatccatttgctttgctttcattttattgtaatgcaaagagaaacagagcaaggagactatcagcaaagacaaaggagattgaaagagcataagacatttaggaagctaaaggttgtttagcataattgagccttagaatagtttccaagggaacagggcgggcaaagctggagaggtaagcatgatccacattctgagggactttggatctcatttcaaggggtttcatcatgactggttacataacttgtgtggccacaaaaagtatgtagccagtacaatatgaaaatgtggggcccttgttaaaaatcattgagaatttcaagatgtcagcataagagtattaaaccatgcacagggctcttctaaacattggcctgtgtgtgactgcacaggacttatgcccaggaagttggccctgggtttaattatatcctgagggtgatgtgggacctaaaagatttaggcagtgacttgaggtcattgtaaagattgttctgaccttggttggaaaatggattgttggacccagagaacaaggttctacaatggctttaagaaagctagtgtatctgtcttggccgggctggtcacgcctgtaatcccaacacactgggaggccgaggcaggtgtatcacttgaggttgggagcttgagaccagcctggccaacgtggtgaaaccctgtctctactaaaatacaaaaaaagaaaaaaattagccaggagtggtggcaggtgcctgtaatcccagctactgtagaggctgagacaggagaattgcttgaacccttgaacccggcaggcagaggttgcagtgagccaagaccatgccactgactccagcctgggtaacagagccaggctctgtcaaaaaaaaaacaaaaaagctgggtgctgtggctcatgcctgtaatcccagccctttgggaggccgaggcgggcagatcacctgaggtcaggagtttgagaccagcctggccaacatggtgaaaccccgtctctactaaaaaatacaaaaaaattatccaggcatgttggcacgtgcccataatcccagctacttggtggctgaggcaggagaattgcttgaacctgggaggtagaggagacagaggttgtggtgagccgagatcgcaccactgcattccagcctgggcaacaagagcaaaaactctgtctcaaaaaaataaaaataaattttaaaaagctagtgtgtctatctccatattttttctgtgaattttaactattgtgatggtaatattagtgataggaccaggaatagcttctactaatacaacaagtaaacaaagtaaacacttttttttttttgagacagagtctcactctgttgccaggctggagtgcagtggcgcgttctgggctcactgcaacctccgcctcctggtttcaagcgattctcccacctcagcctcccaagtagctgagattacaggcacccgccacatctcccggctaatttttgtttttgtattttagtagagatggggtttcaccatgttggtcaggctggtctcgaacgcatgacctcaggtgattcccccacctcagcctcccaaagtgctggaattacaggcatgagccaccgggcccagcaagtaaacactttcatatacaatactgtcatttgatccttcaactatctggttgtcaggcaaggcatatgttattatccttagtttacagataaggaaacagttaagtcacttgccaaaaattacatgactagtgattgatgtatacaggatttgaatcagcccttctgacatttacactactgatatttctgctctattaatactgctagttttattagctacttatagaagcaattttttttttttttttttgagacagagtcttgctctgtcacccaggctggagtgcagtggatcctcctgcctcagcctcctgaataggtgggaccacaggtgcatgacaccacaccaggctaattttttaatctttatttttgtagaaacagggtcttgccatgttgcccaggctggtctagaactcctgggctcaagcagtcctcctgtgtcaccctcctaatatagaagcaatttttaaaacatccatttgtacagtatttagtagattttattaaattgtaactgaagttattgtctactgtgttttcaaagcctctcattacagagatccacatgatgaaatttgtactaccagaaagatctttatgtagaaagatgtctgttttcttttaatcagatgttaaaaattatgttacatgcatcactcttttagcctagctgccagagaacctatgtgccaatttaatacccaatttttttttttttttttgagacggagtctcactctgtcaccaggctggagtgcagtggggcgatcttggctcactgcaacctccgcctcctgggttcaagcgattcccctgcctcagcctcccgagtagctgggactacagggatgtgccaccatgcccggctaatttttaatatccaatttttaaaactagctcatacagctcctcaactcactcaagagcatgtctactattgttatcgttgataatgctattttcacattatatttaactttcttatattaaatgttataagttgcttcaaatatatttggaagcggtcaggatataaattcttaataaactaaataataaccatttggaaatttatgcaaaagaaaaaagcagtgtttaaatggctgagcaatagtataacagacttacccactcaagcttattaaagccagaattaactgacaagtcagataagcattccctaattaaatgaaagaggagaatgaataataacatgaaagtgaaaaaggatgtgtgagcctacaaaagacttaggccaacaaatctactcttagagattttctaatgtcactataaattctagtacctctgtgtcctactcaatatctctcgtgtttttatcgtcttccatgcttaggtcttgtttttattttaggcctgtctttgttgatatttctttcttttttttttttttttttttttttttgagacggagtctagctctgtcgccagtctggagtgcagtggcacaatatcttggctcactgcaacctccgcctcccaggttcaggccattctcctgcctcagcctcccgagtagctgggattacaggcatgcaccaccaggcccagctaatttttgtatttttagtggagacggggtttcaccatgttggccaggatggtctctgtctcctgacctcgtaatctgcccaccttggcctcccaaagtgttgggattacaggcgtgagccactgcccccggtctttgttgacatttctttattattattttgtgtatgtcatgactagggatttagatatttgaaggccttgtcttttataatagatataacaagtaaatttaggaactttatattttataaatagttgattatttttatagactcactatgtttagattgttttaggtgtttatttctttttgtaatttaagcacttagacttagttacactccagggaaaaacaacattcttttaatagtcttggtttcacattttcttgattctcttgtctatctttgtttgttcctaatttgtacataaatagtgattaaagttcagagtggctactgcaaaagataatgtttgaatttcaaaacttaccttatttcttttatgatattaatatgttcgaagtatcaagtaaaattttagcatttgagaccatgtggaatataagcttctatgtataggggagatcttataaaaacagcttgaaggaaggtgttcagcagaatttattggctggattgaatatctagtccaccattcacccctatatttgaatggattccttgccttcttatcctgggtaggttcgtagtttatcttgtcacatgccagccgttgttgtccaccctggacttcgcctcttaagtaatagacagcccctgactttcacccataaattatctgatggtgactggtttgcctccttggttttctttcactgcccagtgccagcctatctaagcaagatctctataaagataacatccttatttattaggactggaaagtaatttagaaacattccagttcgttggtcttaatttatggatgagaaaactgagacccagaaagaggaagtgacttacatctgtattgaataacattttgtaacatattggaatccaaacatgcagattatttctatagcactttgtctagtttttttaagaaattatatttctctttgagttattcaagttatatttgtgcatattagttacaggaggcagattagtctttcttactttatttcacacagatgattataggaatgtagagcatccacaagaaaaaaatcaatagcacttaatataacaatttagatatatcatactctattgaactttgaagctatttgttatacactatcatcatcatatttttttctcttaaacatatgtaggtcataaaattgaattgtaaaattgcgagtaatttttataatttagcaaatattcaactaatatttacggagttccaggtatgtgacattacatttgtgttttctttacgccatcactacttgatcttgcttttgtgtacgaaacacttcatctgcttttataattttcctctattttaccttctttcttcatttcccttggctgtcttcactagtcccaaaactttaatcaacgctttaacatgcaggactattagctttatgtctcccttttttgctcactctttgacacaccagccctaatcttctaaccattaactccatgtttctacctagatatagatccttaacccccgaactcagtatatttactaataaactcattcatcttcctctggaatctatttcttttaatgttaccatcactttccttagttatacaggtttatcactggtggttttcttgataccactctctcttgcctcccacatccattcaataattatcatttttaccatttgtttagcatttaccatgagcttttggaattcaaatattatcttttgcagtagccactttgaacttttgtcactattcacgtatgaattaggaacaaacaaaggtagacaagagaatcatgaaaatgtgaaaccaatactattaaaacaatgttgcttttccctggagtgtaattaagtctaagtgcttaaattacgacaatgaaataaacacctaaaacaatctaaacatagtgattctataaaaataatcaaatatgtgccaggcctttaacatttcatcctcagaactatcctatgagttaggagttactatggtctccattttacagttggatcaactgaggcacagagaaattagggaccttcctaaattcagaagactagtaaacagaagagttaagattcaaatctacacaatctgactctatagttaaggctcttaatcactgcattcagttgcttgctaaattaatacatgctgtattttcttcttttttttttttttgagatggagtttcacttttgtcgcctatgctggagtgcaatggcctaatctcagctcactgcaacctccgcctctcaggttcaagctattctcctgcctcagcctcctgagtagctgggattacaggcgtgcaccaccatgcccagctaatttttgtatttttagtagagacagggcttcaccacgttggccaggctggtctcgaactcctaacttcaggtcatctgcccacttcaacctcccagagtgctgggattacagggttgagccaccatacgcagccatattttcttcttttacaatgtatttgttcccatctagtcactttctattattaccttggcacaagctctcattacttcttgccagaactattgcagtagtagtctagccagttcccccgtctctacctccctccagtccatttcatatactttcctgagataaatctttcccaagcatggctaggtgtatttagctgtccttagcctagagaaaaatggagtggctccaaactaattaggcccttgaataatataggaattttccctactacccttcatttatcttgtgatctaagcaaacttaattacttcctgaaacaccattctctttatgtattaatttatctatgcctgaagttgtcagctttatgttcttatttatgtatattattttataattatccatattatacattatcctgtgtacatgtatctctgggacatatagctattgtatatgtgtattgcttgttttccctctgagatctttaaattctctcacatgtaagcatatgttgttgatgtattctgaaaatgttttttatgtgtcattggcgtgattgtgattttacaccataatttcccaatgtttatgtaaacattataggaactctgtatttgaatatgaaactctttatgccattagggcatttgccccatctataccttttctggttcctattttaaccagggacatgaatttgtagcctggccagctatagttataggtattggctacagaacttttttttttttttttttgagacggagttttgctcttgttgcccaggctggagtgcagtggcatgatcgcggctcaccgcaacctctgcctttcgggttcaagcgattctcctgcctcaggctcccaagtagctgggattacaggcatgcgccaccacgcccggctaattttgtatttttagtagagatagggtttctccatgttggtcaggctggtctcgaactcccgacctcaggtgatctgcccacctcagcctcccaaagtgctgggattacaggtgtgagccaccaggcctggccttttttttttttttttttttttttttttttaaacaaaactaactggctcttacaagaatcagactcatgaccttggcctcattagcactatgagctaaccaagtctgacatatagaaattacacaagcgacaactcataagagaaaccagaactgtaagatggccttttggaaataattttcttaaagagcatatccaaatggagaccttcatttagcagcttataacaaattcttgatcgcagagttgcttcattttaagagtgaaaaacaatataacaatagcagtagaaattgaaagcagggaagttttcctgacatattgttttctttcttgtataatgtagatttatatagaacaggggctctaaccacctgtcagtaatatgtttctgtcaattttcctgtagatttttattcatggaaatagcactggtggcaaacatgagctagtgagtgaaagtatcctacacaattccccaaacgcctctgccagtttattttagtgttaatttttagtgcactttttttttttttttttttcagtgtggttggagcaaaacagagattaagagaaaattgctatggttctactggtttggataaatgggacaggtgccaacaattaccactggtgtgacttttccccccaatataagcattactattatgactattttgtttcctccttttacaaaatgccaggtggaatttatagagttcttattgtgaaaactaagacctattcctgattcttttctgaatttcatgactttgggaatatcctttagtttatatactacagttaccccctccataatatggggataccatggtgttaagattgatgtaagaattaatgtgtttaccagtcagtcttctagccaaacaaaaataagacacatttgcacagctttagttgtcagagaggtctggagcaattgttacatcctatatatacttctgcttgtgattttgagggcttagggtatgttgcttcaatcatatttataactaatgctgtatttttttactatttctgattgctaccttaactaaattaattttttcctcataccctgatactaggcatttggaatttagtaagtagctgaaatttgaataaatagcaaaaacggtataagtttttcaggttttttttttttttttttgagctggctagaacagacacatggattgaacatgatatctgacattgttgataatataatgagtaatatcaaggaacggtgaaggaagtgttgtagtttctaattttttcaatatggaagtgaatctactctatgataagtgcaacacagcttatctaatgctacttaaattgaaaaaaaaatgagagttccatgataagatttaaaaagtcatgtttgcaaaactcatttgaatagtcagaagtatagaaagtcgtcattaggcagctcttcatatatttgttactaaatcatctatgcagttacagattttatatatgtgtttttttcacatttaccattaagggactcttagtcctttttttttttttttttttattgaaacggagtctcactgtgttacccaggctggggtgtagtggcgcgatcttggctcactgcaagctccgcctcccgggttcacgcctttctcctaccccagcctcccaagtagctgggactacaggtgtccaccaccacgcccagctaatttttttttgtattttttagtagagacggggtttcaccgtgtcagcctgaatcgtctcgatctactgacctcgtgatccgcccgcctccgcctcccaaagtgctgggattacaggcgtgagccaccgtgcccagcctcttagtccttttcttacctgtgtgagtttatcagtgctacacaaaccaggaagaatgttaatttgctggctgcctcccttgagctgtttaccacgtttttgaggcagaatagaaaaggaaaggaacttaattgagtgtaataaactttaaaaaatctttccaggccaattgagcagtcatttcattacttttaagacaagcagggaatgatctataaagagggaaaataagaggaactagctgtgaggactaaatgaaacaaagacataaagagtacagcatagtataaagcacatggtatcctctaaatagtaataataatggttattggtaaggccttgaactaaattatgcttgaactaaatatacccaaaaacataacaattcagatttaaaaatgatgaattgcccagtgacgtttaccatcaacccctatggataagatgtttcattttagagagtgcttggtagaaaatgctagatggaaaagtcagaggattctttgttacagactacatagcttgaaatttatcttgtaataatgcattaatggaaaaataggaagacctcaatcatagattcaacttttagcactgggtgcaatgtccctcatttttgagatactgcgagattcagatgatttgcccaaggtcataccatttgttagtgaccaaagaagatcttgaacctcagacatctgatataaagttattccagtgttctttttattttaacaacctgacatcaggatggatattataaaaatagcgccaaatgtcagtctaaagcaaaatatttttgtatttcaataaaaaaatgaaaattatacattggatgaaatgtatatgactaaagtaaacaggcttttgaaatttaaatcaaggctctttcatagaatctgcataataaatgccatttatagttaatttattctatatgtcatatatttaaaatgcattcaaaatcaaatatcaagactaaattgtactccagttgaaaatccatgacaattttctctttgtctaaatcctagctgatatttgtttattgcacccctttcttttagaataatagaagcttgagaactatgcttggtaatataacaagaaagcatgattatagatataaatgatgtaacaagaattctattcccagttgtgcgttgtaagactgacaaacattggattaatgttgaataggtcatttgcaattctatgctgtttgtagagaaatcatattttgctattcttaggaacttacatatgagtttgttttggaggttttctgaaacatgaaagacataaaaaagacagacttttcctgtagcaattcatggaatacgttgtacattgttcttcctaaactacgtaactctctatgtgaataagacatcatatcctacaagccttacaaactttgactgtccctggacctcttgtgagaataaattaaagatgtcatgtctcatatattttgttatcagtgaggaaaaagaaataacattttctttttcatattttggtagagagtgcatatgattgatagtgaaatacatgcctatagtaactatttgtagttatatatagatggaacaattcagtgacgctttccaactttatcaggacctaagacttttacctttccaagtccaaagtgactaactgtaactctactagtaatttttttaaaaagcttatttaaaaaaaaaaaaaaaaacaagaagaatgtctccggccgggcgcggtggctcacgcctgtaatcccagcactttgggaggccgaggtgggtggatcacgaggtcaggagatcgagatcatcctggctaacacggtgaaaccccgtctctactaaaaatacaaaaaattagccgggcatggtggcgggcgcctgtagtcccagctacttgggaggctgaggcaggagaatggcgtgaacccgggaggcggaggttgctgtgagcccgagatcacgccactgcactccagcctgggccacagagcaagactccgtcttaaaaaaaaaaaaaaaaaaaaaaaaaaaaaaaaaagaagaagaagaatgtctccatagttattcataacaattgtgaaaatttaagtaattggccgggcgcagtggctcacgcctgtaatcccagcactttgggaggccgaggtgggcggattacaaagtcaggagatcgacatcgcgccactgcactccagcgtaggccacagagcgagactccgtctcaaaaaaaaaaaaaaaaaaaaagaaaatttaagtaattggatgagttgttttcgtataaattggatgtatacgtttgatgtcctcattgtgttcagcaagctaagatgtatatgtacagttaaacatgagtcatgccctctatgatgagtttaaacatttaaaccaaatatttgttacatatgatacattaagtacaaatgttttttatctatggtaccttaatttatataacatatcttaggttataaactgtttgtttataacaacaaataaagcgaagtattcaaaatggcttgtagcaaggtgctgagacatgtgaaggagtgccagattgttcttgataatttacttcccacctctgactcacttttacatggtcagctttcagagaataagcacaaagatgttagcaaaattaagggcactttaaagtttttgttgagatgtttttaagtcttaaacaaaatttcaaatccagagatttgtgggaccaaaatgatgaattaaaagagaaggattcagtgtattttctgaaaaattattcattacctatagctgatacgaccagtgccagccatgaattacctagtccccatgcattgacagctgatttacattcttgcgccagctccttatctcatagtagatcaggcgtttgagtagcatagcattagcttatctgtttttttaagatcaatagaactcaacaaaggacgatagaactgtataccccagtcaataagttagacacttattaaaccttttataaaagtattggatatggccgagcacagtggctcacgcctgtaatcccagcactttgggaggccgaggcgggcagatcacaaggtcaagagatcgagaacatcctggtcaacatggtgaaaccccatctctactaaaaatacaaaaattagctaggcatggtggtgcgtgcctgtagtcccagctattcaggaggttgaagcaggagaatcacttgaacccgggaggcagaggttgcagtgagctgagatcgcaccactgcactccagcctgacgatagagcaagactccatctcaaaaaaaaaaaaaaaaaaaaaggtattggacactcagccaggcatggtggctcacacctgtaatcccagcactttgggaggccgaggtgggcggatcacctgagggcaggagctcaagaccaacctggccaatatggtgaaaccctgtctctacttaaaaatacaaaaaattagccgggtgtggtggtgcatgcctgtaatcctagctacccaggaggctgaggcaggagaattgcttgaacttgggaggcagaggttgcagtgagatgagactgtgccattgcactccagcctgggcagcaagagcaaaactctatctccaaaaaataaaaattaaaaaataaaataaaataaaatagtattggacactcatcctctgaggaggcagtgtaactgggtgagaaaaaactctcttatatatcctttaggtacagctctgatttctgatgataagcttgctataaaacaatctattaaaaatgattctggctgggcatggtggctcatgtcccaaagtcatcccagcactttgggagactgaggcaggcagatcatctgaggtcaggagttcaagaccagcctggccaacatggtgaaacccgtctctaccaaaaatacaaaaattagccgggcgcggtgtcgtgcgcctatagtcacagctacttgggtggctgaggcatgagaatcgcttgaacccaggaggcggaggttgcagtgagccgagatcgcgccactgcactccagcctaggggatagagtgagactctgtctccaaaacaaaagatatctcctataccttgcataagcaaatgatgtgaggaaaacttgcttaattaagatcccaattttgttttggtgcttttgacactcttcatgcttgactaaactttttcattatggatttgcatttcttttactttttcttttcttttacttttcatttcttttacttatatgaataaaaggtctattcccttattggtttgaatttgggttacttggtgtctttggtcagtaaagagaaataatttgttttagcatccaatggattatggtctgcttcccaattgtttttgtttttcaattccatcctgatactggaacaacagatcatcttgtttttgctacaaacaggtgacacccaactatagtttgtgtatattgtaagacatacagagagtgttacaaattcccagtgttttcctctgtttcttagtcctgtactattcaggaattgtttcacacgagccttgataaactagctttctcaagaaagaaggttatgatatgttgttgttttgagatgttgaaattatgttaaattatgcataggaggtattatttatttattgagtttagtgctcccaaactgtattctacagaatattgttctacaggatgttacaataatgttaaaaaagggaaagaaaaagtatggaggtagtcaaggggatcatctgtggcaaataagttgtgaatgtgctgggttaaacaaagacaaacagatctattttctgcagaacttctcatgacttttaatatgctatttttattgtaaatctataaggggctatactataaaacatttctctaacttatttagccatggggtgtgtgtgtgtgtgtaatactttttaacatctcaagtatggcacacagtttgggaaaaggtggtctagctatttgttcttgtatgcaaaaggcatgggtaaaatggacacaggacaaaattgttaaaatgttgtttgtaacatgcctacagaccttgttggcaaagcttcctgattataggaaatccccattgaaatattcagggggagaaaaaaatcaaataggattattttttaaatgcattggctataacaccctgtatgttgaatgtgggaaatagactaattttagctaatatataaataaacagtatggattatatcaaacccaggacttcagaacattatgaagctgtgcataagtgcaagcctgagtattgttaattagtaaggatgtggttttcagatcatgtcatccagttataacaacataccataaacactgtccaagcattgtcagtttgtaaacgtatcatttgctgtgagttacttaaaacattcaaaaggtgtttaacaacagtaatagttgatctgagaagaaatcacagtggtcgatcttgaataattataacagcagtattaaaaccatgggactgcagtgaagctgtgatcatgaaagaacctcatgttacaacataaaactctctgtgaaccattactgagaacagaacaacactgaaaaaggcccggatagatatattgctagaaacagttgccctagttatttagtttcaaaatgaagtagcagagaatcccatatgggaaaagtacttgtacatatctctgtgatggtgttcatctcacgatgtttgattccattttgatgggtttgttgatagcatgattcctgctgtcactatgatttgtgtttattatagctgtttcctttttaataaaggatgctgttgcatataaacactgacatgaagctatcttttcagaaattgcattctgtatgctgatatagtcattgcaatgttgtaaagtgagtattttgctaccaacagagttggattatatattttaatatatcgattagtgtattttgttgtttcaatataagaaaggacctatagttatatttattttgcatttgttcttaggtagtatacacactttcaaggagagatagcacagtaggcaatacaatgtggctgaagcacaccttgatagaagaacaaataaaggactgggcagaggtgaaaatgattatgtaggaagtaggagaaagtcagattcaccatagtcgaagagtcatggcaggagaccattgaaagtcaagaggcaccatctgtcctaagctgagctgaggcagtgtctaactgccatagccaagagtaggagctaagaaatctcagaccgagaaaatagccaaagattgaggggctaggttgggcgcggtggctcatgcctgtaatcccatcactctgggaggccgaggcaggtggatcacctgaggtcaggaattaaagaccagcctggtcaacatggtgaaactctgtctccactaaatacacaaaaattagctgggcgtggtggcgggcgcctgtaatcccagctacttaggaagctgagataggagaatcacttgaacccaggaggcagagattgcagtgagaaaagattgcaccattgcactccagcctgggcaagaagagagaaactccgtctcaaaaaacaaacaaacaaacaaaaaacaacaataacaacaaaattggctaggcgcggtggctcatgcctgtaatcccagcactttgggaggccgaggcaggcagattacctgaggtcaggagttcgagaccaacctggacaacatggtgaaacctcatctctacttaaaaaaagacaaaaattagctggacgtggtggtgcgtgcctgtaatcccagctacttgggaggctgaggcagggagaatcacttgaacctgtgaagtggaggttgcagtgagccaggatcatgccattgcactccagcctgggcgacagagcgagactccttctccaaaaaaaaaaaaaaaaagaaagaaagaaagaatgggaaatgggaggcaagaaggtagggaactgtcactagggcagttcagctggttgtgctgaatagtgtttttctcacctagagctgcttttaacaacctcatacctaatggcattttaaattttatgtctggccccagaaaaaggtttgcctgtaaaataaattgaacatgattgaatagaaagtataaagaaaaaaaaaaaaaccttccgtacatctggtttaattaatttacagtcctctagcaaagtgtcattaaaggcatttctgatcagatccagattggcagcaaatccaaacccatcatttcctctctccttttttgcctccccgcatctctccttcttaggttagaaaaggatctgtttgaattagccaaggatatactacgttgtagatggtgagggcagaagtacattaagcagaattcagcataactctctttggcccccagagtagcttcagggggcagggccattggtggtggtgaggttgtggggagggtttgtggtatgtagggataaccttcctggcccctttctgtaagctgtcaccagatctggaatgttcaaatcttgctgtatcactgctctttttcatacagacctatcattaccattcaggaagaatttctgcaatctatatacgttctcatttaatgggatatttacaaattctgagccttccttatctctgaaccaaattcagcattaccaatactgctaggtatcctggaacaacatctctttttccatttccttgcaatccgtttatcattttccttcttctccacatgccaatacactctctaatttctttgtatctgggtggttatgatactgccctgtttttggagggccacagtaacaaattcatttcctcgtgagtatttgttcttacttatccaaattagccttatggaagcacttgtaacagataaacatttgctttggaactttgtgctcttaccttaaaggaactagctttaagctttgaatctgaagtaggaatagagataagaaaaaaagactttccacactaaagagacagttaacaaaggctgagaagtgggaaactctgaaaggtaaggggcaccgaattgttacatttaattggattattggatagataatgaattgtgaatggggcagtttaagataagacagaaatgtctattgagaccagacccctctgggtcttgagtacctaaggaagaagctcttattatatgtataaataaggtttttgagtagaaccccactgaaaggctgcttgctgacttgaataaaaagccactgttgaatcaccaggatgatcttgccagttacaaaacccttgccttgtgaaactaaaagtttattcctataaagtagaaatagtcatagctgactctgtatgggaaaaaatgaaatgagcatttatgcaaaagcttgaagcatgcacctgcctttcaggtttaatccttgtgtctcatttggcaaaccagttgtaccctttgtctgaaacactcctgcacttcatctgaatggaaaccctttcatttctgttatgagattgaataaccaggtgattggaggaagactacagttaagtgtgatttatagacaatagattttgccagaggagattttgaagctatgtaaaaattctttttattttttcatgatatttactaaggttttatcgatttcagattcagtctcaatataaaatagtaataacattagtggtacaaatttcattagcacatacttagatgtaagaaatcataggctgggtgcggtggctcactcctataatcccagcactttgggaggttgaggcgggtggatcacctgaggtcaggggttcaagaccagcctgaccaacatggagaaaccccatctctactaaaaatacaaaattagccgggcgtggtggcgcatgcctgtaatctcagctactcgggaggctgaggcaggagaatcacttgaacctgggaggcagaggttgcagtgagacaagattgcgccattgcactccagcctgggcaacaagaacaagactctgtctcaaaaaaaaaaaaaaaaagaaaaagaaaaagatatcattactatagattagattggcatgactcaaccttctttagaggttagttgtttctactgagtatgtttgccatttggagatctggcatttggggagtatttgtgcttcaggtggcttgaaaggcagatcttataagtttataacattgtcatctattttcaataggtttttgatattgaaaggaatcatttccaaacagtatcactactgtctaaacactgagtagttacacatacatattagcaatgactaaaaaaatactgtttgcagcaaggttggaaagaaatagaatgatctaggcataaaccacatatcttcctaattaaatgaaacagtatttcattgctgcttaacctactcttgtcttacagattgaccttgactcaattccaggtcagaagtcttcccacactgtgcttattaaggtctctggcatttgaaatggcagagctgctctaatcttcaaatcccatcgctttactttgcttgctatactcccttttccctcacttctgtacagcctacaagtcttatgtgttaaaaagcctctgctaaggccaggcgcggtggctcacgtctgtaatcccagcatttttaggaggctgaggctggcagatcacctgaggtcaggagttccagaccagcctgaccaacatggtgaaaccccatcttttttttttttttttttttttttgagacggagtctcgcactgtcgtccaggctggagtgcactggcatgatctcggctcactgcaagctcggcctcccgggttcacaccattctcctgcctcagcctcccaagtagctgtgactacaggcacctgccaccacgcccggcaaatttttttgtatttttagtagagacggggtttcaccatgttagccaggatggatgaaaccccatctttactaaaaattcaaaattagctgggcgtggtggtgcatgcctgtaaccccagctacttggagggctgaggcaggagatggctcgaactgggannnnnnnnnnnnnnnnnnnnctatctggcttttgtgtgttgtacaaatctatttccttagacatttttttttctcctgatgtcttccaaaaatattttaaatgtaatatttgttttaagactaattgctaacatttatattgcatcaaagtttgttatattcatttagacttacatctgtataacttttttttttttttggagatggagtctcactctgtcgcccaggctggagtgcagtggcgtgatctaggctcactgcaacctccacctccctgggttcaagcgatcctcctgcctcagcctcccaagtagctgggattacaggcatgaaccaccacacctggctattttttatatttttagtagagacggggtttcaccatactggccaggctggtctctcgaactcctggcctcaggtgatccgcccacctcagcctcccaaagtgctggaattacaggcatgagccaccgcgcccggccaattttacattttttatacccaattttcattgatgcattctcaagacttaaataataatgaagtgcctgcccatatgtaatatttcctgatactccatgggctttagcggtaaggtaactttgtcatataagaacctaaaataactgtagttacacttttaaaatagcttgttttgctagtgttgctatagaaaatgctttataaataacatttcaagaactgtgtttctctgaatctccttatcgttgccagaatgtttcccagtaacttatctgtatctacaaagaaagtgctatgtttagatactggtcagttctaagtcattttcattgatgacaacattaaatataagttatacaaaatagtagatattccaactaaaattttatctcttctttgtgaaggatctgtttcagtccttaagaaatagagtcatttgaatgggaaaacctagaaacagttttaaggcccagggtatggtgaagtcaccaacctgtttcttctctgccagttctaatcttgacataacaagaaagttactggacaatcaatcatgacctttaggggtgtgggggaaggaaaagaaaagacaagtttaggcagctcctctatttctaaagaatgtcatagagaaatttaaagaaatccttgctatactttacctggccccctcctggattaactcatgaggcaaatgagatttcctcactctgaatttgcaaagcgacaaaatttccaccaaagaatcagcatgaatgggatttgaagaatggaataaaaagtgaattaaattactgatcaccctaattttcaatactcattcattcattcagcaaaaatttattaagtgcctcctaatctgctagatagtgttgtaggttctggaaataccatagtacacagataaacatttctgccttcctggagcttatgtaatagtaaggaaaaacagatgaaataaagacattgcaaagtatgttcaaaggcgataaatgccatagggtataaaagtgaagagggagtttggtggtatgttcgtattttagatagcacagagggaaagccttattgacttggtgagttctgaataaggatctaaagaaagttaagtcatgcagatatgtggggaaagagcattccaagcattccaaatgcaaagaccctgaggcaaaaagctggtgtgttccaggaaaagtaaaagtagtgagtccagttgcctgaagctcatgaatgagagggagagtcgtagaagataaggtaagaaaaattgtgaggggtggagggagttgtacacccaaatgatatagaaacttatggatctgccgggtgtggtggggtggctcgcgactgtaatctcagcgctttgggacgctgatgcgggcagatcacttgaggtcaggagtttgagaccagcctggccaacatggtgaaaccccatctctaccaaaaaatataaaaattagccgggcatggtggcaggcgcctgtaatcgcgctacttgggaggctggggcaagagaattgcttgaacctgggaggcggaggttgcagtgagccgagattgcgccattgcactccagcctgggcgacagagcgagactccatctcaaaaaataaaaaaaagaaaaaattagaaaaagaaacttgtgggtcataataaggacctgagctattatttaaagatgagaagccattgaaaggttttgagtggaggagagacatgcactcagttaggtacaaacagaatcaccctgaataatgtgttaagaacagactgataagcaaggcagatgggaagcagggagacccataggaagtaattgcaataatctaggagactattgcagtaatctaggctagtattagtagaggtgatgaaaagtagccgaatacctagatatgatgtaaatgcccagtgggttcaccttgccagctacctagacagagctgatttatcaagataggacagttgcaataaagaaagagtaattcactcagagccagctgtgcagtacaccagagttttattactcaaatcagtctccctgagcattcggggatcagagtttttaaggacaacttggtggggggaagcctgtgagccgggagtgctgattggttaggtcagagatgaaatcatagggagtcaaagctgtcttcttgtgctgagttagttcctgggtgcggggacacaagatcagatgagccagtttatctatcagggtgatgccagctgatccatcaagtgcagggtctgcacaatttctcaagcactgatcttaggagcagtttagggagtttcagaatcttgtagcctccagctgcatgactcctaaaccataatccctggctaatttgttagtcctacaaaggcagtctagtctccaggaaagaagggaatttgccttgggaaatgccgttatcatcttttttttttgggtgggggaggacagagtctcgcctgtggcctaggctggagtgcagtggaacaatctcggctcactgcaagctctgtctcctgggttcataccattctcctgcctcagcctccccagtagctgggactacaggcgcccgccaccaagcccggctagttttttgtgttttttagtagaggcggggtttcaccatgttagccaggatggtctcgatctcctaacctcatgatccgcccacctcagcctcccaaggtgctgggattacaggcgtgagccaccatgccggcctatcatctttgttttaaactataaactaagttcctcctaaagttagttcagcctacgcccaggaatgaacaaggacagcttggaggttaaaagcaagatgaagttggttaggtcagatgtctttcactgtctcagttacaattttgcaatgctagtttcaatgtcagtttgtaccatatgaaattgccaatatttgatcacttttgatcaatagaatcctttttttttttttttttttttttttttgagatggagctctgttgctcaggctggagtgcagtgtcatgttctcagctcattgcaacctcctcctccccagttcaagagattctcctgcctcagcctcccgagtagctgggattacaggtgcctgccaccacgcccggctaatttttatatttttagtagagacggggttttgccatgctggccaggctggtcttgaactcctgatctcaggtgatctgccgcctcagccctccaaagtgctgggattacgggcatcggccagtgcacccggcaagaatccataatttctagtggttctttctaactttttgaaagtagaatggatagaagtttactaaaattatacactagatgtgtgggatatgagaggagtgaaggaaaattcccaaggcttttgagctaagcacatggtaagaatagagttgtcattaactgagacaatggagagcccatggctattaattggacacttctgagctagtcagctttagtttaccgaagtctaaattcaggcagcttttggctgggcgcggtggctcacacctgtaatcccagcacttcgggaggctgaggtgggcggatcacgaggtcaggagatcgagaccatcctgtctaacatggtgaaatcctgtctctactaaaaatataagaaaaaaaaatttagccgggcgtggtggcgggtgcctgtagtcccagctactggggaggttgaggtaggagaatggcgtgaacccgggaggcagagtttgcagtgatccgagatcgcgccactgcactccagcctgggagacagagtgagactccgtctcaaaataaaataaaataataaattcaggcagcttttttgttgctgtatactagtggtcacaagtgaacactggataatatgcacaattcattgtagatccatccacattgctggcaaaaataatcaagctttcctgttacactgattgatactgggtctgtgtggtcatcttcttataagaaatatggtcatcttcatagaaaaataactttatatcttttatataacatggtttgaaaaatgtgatttcaactttgtcatcgtgctgcttctttcaacttttattgtctaagctcattttcttcattttattatattctttcatgacttcctctcactctaaatcagttaagattcagctagaatatatgttggtacatacaatttggaaagattgtctttatgttctgtgatcaaatgtgaaaaatagaaccatggagtcaaaacagagtaaggctttactgtttttttttgagacagagtctccctctctcgccccggctggagtgcagtggtgtgatctcggctcactgcaacatccacctcccgggttcaagcgatttttctgtctcagcttcccaagtagctgggattacaggagtccaccaccatgcccggctaattttttgtatttttagtagagacaggttttcaccatgttggctaggctggtatcgaactcctgacctcaagtgatccacccgcctcggcttcccaaagtgctaggattacaggcatgagccaccgtgcccggcctggctttactgttttgtaaaactgctttcaggaagtaattaaggtagatacacacaagcccaagttgaacaacattatatctcacttactttgaatggcctagtcaggaatattgtatatatccataaacgtgaaagtaaaacatttgacgatgtattttctttaggtgtattaagatataaggccaggctgggcatggtggctcatacctgtaatcccaacactttgagtggctgaggtgggaagatcacttgagcccaggatttcaagacgagcctgggacacatagtgaaaccctgtctctacaaaaaaaaaaaaaaaaattatctaggtgtggtggcgcacacctgtagtcccagctactcggtaggctaagacagggaggatcactttagccctgaaggttgaggctgcagtgtgctatgatcatgccactgcactgcagtctggaagacagagtgagattctgtctcaaaaaataataataataatggtatgaggccagttcatcacagtaaaaaataatattgtggaaaatctatagtgttgagttagattcaacttagaaattagcaaacactgataactacttgtcaaaaatgctgataatgtactttcaatagaggtcacagtatttgtctagaatgagttaaagataagagtctatacctttgctgtgactttatctttttgcctgactagtgtctctttgatatatatctttctatactgtaggggctgatttcttctgcgtttgaatttatgaggcaaatagaattggactgaaaaggtgttagagaatttagagaaatacttaaatgaatcactcagtttgtttaaatttagaaacaataaaagctgtttgttcaggctactattttcaagataccatgttgtgtatgagcataaatagtgccccaggttgctggaaggcaggcttggttttgtttttgagaaatgttttagttgaacaatttttaaaagaagaattgatccacatgtttaacatttcactcccccagaccagcctgggcaacatggtaaaacaggaaaggaagatgagaaataatattctcctattattatggaaacatacctttaatatatggccattgactgaatgcttagttttacttatcattctccttttttgttagactcttagccttcttctccctgcccttaaagaccctataagagagaaaaacaggtatacaagtcagttgccatggtgcacaactgtagtttcagctattcaggaggctgaggcatgatgattgcttgagaccaggagatctgggctgcagtaacgatcatggtgcctgtaagtagccactgcaccctagccttggcaagtgagaccctggctcttgaaacaacaaaacaaaacaagtacacaaataaagcaagtaatataaggcatgatatggcgtaacagagatgcttttgtgttttaagcatttttactggagattaatgagtggatgtgaattttaaggtgtgctccaaggtacccaaggggtttccatcaagatgcatcagaggttgctgatgggattggaaacttatcccctttacccccactcctctacacacatgctcacacagagcagctccacttttatctgttttataaattgggtttttgtgtagcactgtgaaaagaaagtgttctttttgtttgtttgttttgggttgggatgggtttgaaagtgttcttttaaccattttttttttttttaaaccacagctgtaatagaaagaacacgagctttggagtaagaaacatctgagttgaaattttagttttgctcttagatgatgcttacctcatccatcaccataagctcttccttgtttctcaattttgatcttcattttgagtatcaaatgagagatgtgtagagtgcctattgcattgactgatcaaggattcctgttagattggaaaactgtgagttctattaaactattttttatatcatagatattattttaaaaccttgagaaaagcaggttcacatatttattaagccgatgattacattttttaacttagcccaagtttctttatgtaatttggcctaaatatatctgagatcctttaagccatctatcgatatttgtacttgatcatcgcatcatagtgatctcacgatgttgagatgttcaactcctgagcccttggggtagccagtgccctctagcgggttggtttgccttagcaaccttgagcagccttgtccgtttaccctagtgtgccatgtaaataatatcatttcctaaatatgccgtgaagacattgatttaaagaagcatagatgatccttcctgttctgtttttctcctcctctgttctttctcttctcactttcttgtcttcaaatcccctggtttaaggccaaagaaatcagtagactagccgagcgcagtggctcaggcctgtaatcccaacactttgggaggccgaggcaggcggatcacgaggtcaggagtccgagactagcctgaccaatatggtgaaaccccgtctctactaaaaatacaaaaaaaaaaaaaaaaaaaaactagccgggcctggtggcgcgcaccagtagtcccagctactcgggaggctgaggcagtagaattgcttgaacccaggaggcagaggttgcagtgagccgagattgtgccactgcactccatcccgggccatagagggagactccgtctcaagaaaaaagaaatcagtagactagagggtaggcagcataagcaatttgatgatgggagacagtccatttctttttcctgtacctcaagccctatttagatagactttatttacatattaaggaaaaaaaacatgttttgacaagttgactagtttcctcctgggtttccattttccttgagcaaaatctgcaacagtctcatgtagatggggtaaatgggtttatgtgtgggggtccatgccacatgaagaagttagatgtgcactagcttccataataggaacagcaagaattgaaacagaaaggaaatagaaaccagtgcagggtgtctaggcaagatgagaaagcaaattgcttggaatatgaattgcatgatgactattgtaatgcttctattattttctgaaaagtaagaatgtctttatgttgagcttgaaccagaaggattactgagtccattctgtgttcaatctgtaaagaaataaactaaaacaggtgaacattgaaaatgttacaatgtcataatttgttttttttagcccaatcaccacttttctgattgcaaagtaagtccttcagtcaaatccattgtttgtctgtggttcttatgattaacttccttaaactcaaataacgtttgaaactcaacattttaaggatgtttttaaataagcattattctaacggtgcaaggacattttttaatgccttgccttctcttgcctaggaaatagaaggcagaattaagacttgaaacatcattttcctttcttttaagtgatgattcagtattttagttgattgtaaacagacattcctcttttgcttatgattacctgatgataattcaagttaaatcattgagataataaatctcatacattgatttgatgagagaaatcagtgttaacgccaaaccatgttgaaattggtcttagagatataagccattttgcaggagtgtgtttttgactaatcatgccagagagaaattaatcgaattgtggaatattacactttgcattcatgaaagaatgtgataatgccactactcttcaaatgcatgaatgtgactgaagggaacagtaattatctgcattcctttctactttaggagccagtgtatcctgaccttgtccgtgattgtaatcaccgtaacttgattagagattttttaaattatttttcaattgacacattttaatttatttatggggtacaatctgatgttttgatacatagctatattatgatacaaccagtttagctagtgtatccatcacctgtgcatttatcatttctttgcagtgagaaattatataagatacaatattttactgttaaacatagttaccctactgtgcaatagaacaccaaaatttattcttactatctaattgtaactttgtacctattgaccagcctctctccatccttcccttcctcttcccctctccagtctcaaccactggtctatccttttttgtttgtttgttttttgagatggagtcttgctctgtcgcacaggctagagtgcaatggcgccatctcggctcactgcaacttccgcctcccaggttcaagcgattctcctgcctcagcctcccgagtagctgggattacaggcacctgccaccacacccggctaatttttgtatttttagtagagacggagtttcactatcttggccaggctggtctccaactcctgacctcgtgatccaccagcctcggcctctcaaagtgctgggattacaagcgtgagccacaacgccctgccgcccactggtctattcttgattacagttttctttttttttctttactttttttttttttttttttttttttttgagatggagtttctctcttgttgcccaggctggagtgcaatggcataatctcggctcactgcaatctctgcctcccgggttcaagctattctcagcctcctgagtagctgggattacaggcacccgccaccatgcctgactatttttgtatttttagtacagacaaagtttcaccatgttggccaggttggtctcgaacccctgacctcaagtgatccacccgccttagcctcccaaagtggtgagattacaggcatgagccaccacgcccggccgattacagttttcaagatgtcatgtcatccttgctgttctaaacatcacccaaaattggagaaagaatagtggtaaaacagtagcgacattaaacttaggtaaagcttctcagtgatattattaatagaatcagaaataaatgacgttttcttataaggattcaaacacagaaaatcttcaagaaataccagtagctgtattttttttcccttctgagccaaaggttagattgggaggactgtattttgatagactccttacgacattttaaaataaattcttcagatctagaaagttgactctgaatattttccattcataattttgagaattttctaaaattgatgagcaaacagttatgcagtaagaaaaagattgtatagaaattgataatttgttctctttccatttatcgctgatgctccctttctcacttctacaaataaaaagtttcaaatctttgttctttgtctcttccatggcaatatagaagttataaggtaataaatcaaatttggaaaaagatcttttttcctactctaattgtagggctttaactcttatagagaatcagaacgttaaagtacttctcatataaaattcccctttttttttttttttgagacggagtctcgctctttggcccaggccagactgcagtggcgctatctcggctcactgcaagctccgcctcccgggttcatgccattctcccctcagcctcccaagtagctgggactacaggcgcccaccactgcacccggctaattttttgtatttttagtaaagacggagtttcaccgtgttagctaggatggtctcaatctcctgacctcgtgatctgcccgcctcagcctcccaaagtgctgggataacaggcgtgagccaccacgcccggccaaaattcccataatattatttcaaaatagaattagtgcctagtataacacctagtactgagtaggcactcagtcagtatctgtgtaggaaggaatagatgggacatgataaatataattgataataaatattggccggttgcagtggctcatgcctgcaatcccagcactttgggaggccgaggcaggtggatcccctgaggtcaggggtttgagaccagcttggccaacatggtgaaaccccatctctactaaaagtacaaaaaatagccgggtgtggtggtgtgtgcctgtaatcacagttacttgggagactgaggcaggagaattgcatgaacctgggaggcggaggttccagcgagccaagattgcgccattgcactccagcctgggtgacagagtgagactctgtctcaaaaaaaaaatatatatatatataattgataataaaaattgataatattaaataataataatattaaatatactcttgaaagactatgtttttctgctgctagacatactactttgtaaccaaaaaagcatacttatttgtttttgtgaaacattcacaacataaatggttaaacagcataaaggaccgtatgtttgagtgttacctctaaattaactaactgtaggcactgaaggatttccatgaacacaggacttttagtactaaaactagggggtctatcccaggcaaactagaacaaactgatcacccttaaaattatctctcaatttggccaggcgcggtagctcttggctgtaatcccagcactctgggaagccgaggcgggcggatcacctgaggtcaggaggtcgagaccagactggccaattgtggtgaaaccctgtctatactaaaaatacaaaaattacccacacgtggtggcgggcgcctgcagtcccggctgctcaggaggctgaggcagtagaattgcttgaacccaggagactgaggttgcagtgagccaggatggtgccactgcactccagcctgagtaacagagcgagactccgtctcaaaaaaaaaaaaaaaaaaaaaaatctctcaagttgaggctgccttgaatgtaggttaagctttctggataacttcttacattaaaatttttggataatttacattacaaactgagtcaaatgaaagatcttttattttacttgaaatatataacatattcagcatagaaggagtaaaaagaaaagtataaaaaatattttcattaaaagctatgtctttaatttctgatggaattagtagagattttattactaattcatttagtatttatgagtccactatggttgtcagttatcctttatgacataatttataagattactgataggagcacattttctaagctgaaacatttagaataccattatacaattctttaatagctggagacggaaaagagagtgctagatggagaattaacctctgaatcatgttatgcactagggacttagggttacttttggagtagtatggaaacaaatttaagaatagagtgtgcagtataactttataacacggctcattttcagtgtcagagatcaaataaataatgtgaaatatagcattactgtgcagtagaaatccaaaataatgcaggtagcatatgatataggcattatcataccccttaacgcacaacaaaaggtgtttattattatcataatgttattttccctaatatttatttgctttaataaattattattgcaaaataagtaatataaattaaatgaatttacatgtcattgcattcagatttacatatatacatatgcatgtacgttcacatacattcacatatgtatgtgtttttgttgttgtgttgttattttttttttttttttttttttgagatggaatctcgctctgtcccccaggctggagtgcagtggtgcaatctccgctcactgcaaactccgcctcccaggttcatgccattctcctgcctcagcctcccgagtagctgggactacaggcgcccaccaccaagcccggctaattttttgtatttttagtagagacggggtttcaccatgttagccaggatggtctctagttcctgacctcatgatccgcccgcctcggcctcccaaagtgctgggattacaggcgtgagccaccgcgcccggccatgtatgtgtcttaaatggctatttgccagatctttaaagttgccttccaattttggctgagaatcatcttagaaactgttttgatttcaggcatatatatacaaatgacatgctagtttatacctttaaaagtatatttgcatgtagcataatttggaaggacgtatttttattaaagtatttggattaataaatgttaatgtcaaatctaaaagcccacagcaatggagttgaaaatttaattttaactaaattttaatgtattcatcaaatatgtgttccacagtatttaatgaagatatattgtttataattcacactttgcagacccctttgaagacaataaaggcatacttttaggacagaaaatattctacatagtttgtgaattggagccaatgttctcttgagtttattcttcttatttttaatgcaatttaaaaaatgtatttagggcacatttctgtaagtttaagcatatgattctttatgggagagtagaaaaagaaatcaaatatattttgcgaggtggaagaaaagctgaacataggatatagaaggggcaatgccaaaaggaaaggaaatgaggatggggaagggccatatttttaattacttccaaagggcactggtgtatgttttataaccattcatctctgtttttatgaagcactaactccctgaagcacaaaaattacatgtgtgtgcctgaaggcatacacaaagaaaacaccagaaaccatagctgactcttagtcactggtttaatatgtacagttttggagaggtctgggagtctatctgaatctactgattttgattagtttttaaagaatgaaaaaacaaacaaaaaaaaaccctttcacatgaaacctaccactcaaaatttaagttggattagagatagtgctttgagatttccttcctgactaaaaagtaggttgttgatagcaaaagatcttttgcaactctagtatttgctgtaaactatgatatattcctacaagtacaaatagaaatattttaacatttattcttaagtttatcccagttcttttttttttttttttttttgagagaagtctcactcttataccccaggtttgattgcaatggctcaatctcggctcacttcaacctccgcctcccaggttcaaatgattctcctgcctctgcctcccaaatagctgggattaagtcgcctgccaccacgcccggctaatttttgtatattttagtagagacggggtttccccatgttggccaggctggtctcgatctgctgacctcaggtgatccgcccacctcagcctcccaaagtgctgggattataggcatgagccaccgcacccagcccctgagcttactttttaagaactggcataggccgggcacagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacccgggaggcggagcttgcagtgagccgagatcgcaccattgcactccagcctgggtgacagagtgagactccgtctcaagaaaaaaaaaaaaaaaaaaaaagctcagggaccgggtgcggtggctcatgcctgtaatcccagcactttgggaggccgaggtgggcggatcacctgaggtcaggagttcgacaccagcctgaccaacacggagaaaccccatctctactaaaaatacaaaattagccaggagtggtggcgcatgcctgtaatcccagctactcaggaggctgaggcaggagaatctcttgaacccgggaggcagatgttgcagtgagccgagatcacgccattgcaccccagcctgggcaacaggagcgaaactctgtctcaaaaaaaaaaaaaaaaaaaaaataagtaagctcagaaaaagaggctctttataggctaaatcaaataacttgttgaacctaatttttaaatttggctcttatttgtgtactcagtatttagatctaatttgactctgataataaccaactttaagtgaagcagctaccctttggtgcctacagatgactctcctttcaataaaacatatttaaatagatgacagtgatattttctatgatattcccattcgagaagccccttgctgtggttctggcaaggcttccacagcaggtgatgtggggctcatgagaggagtgccttacttactcctatagaaagctataataaaaggagcaaataaatacctcttgtagctaagaatctgatgtaccacttaatattttcaggtggcaactgcactgtcatttcatataaaattcctttcattagctataaaaaacattgcctgcctgccagctgtttggaaagcatcgtaagatcaggaaaatgacaaaacagcccctcattcgcagtagatacaatgaactagtcaaatagtacatttttaaaatctatcttttgcaaaaagaatttttgcttttcatctcatgcgtttttgtttttaatgacggcatctcaatttttgttcttgtttttttctatctaagctaataaacagattgtgatagtctgtactcaaacacaaaggttcaagagatctggaagaacctgcatatagtagagtataaaaggcctgtgcaacttagactcaaatgtatcaatgcctacaggaaaacaccacaggtcagctctttgtatattctctagtcaggtaatgataacctaaactatctctatgagactgctgaaaagttatcgaagtaaattatttttcttgtcttttttttttgagatggagtctctcttgctctatcgcccaggctggagtgcagtggcatgatcttggctcactgcaacatccacctcctggttcaagcgattctcctgcctcagcctctcgagtagcttggcttacagacacctgccaccacacccagctaatttttgtatttttagtagagacggggttttgccatgttggccaggctggtctcgaactcctgacctcaggtgatccgcccacctcggcatcccaaagtgctgggattacaggcatgagccacctcacccggccaataaattatttttcttaaacatgtatcattcatcttagagtgtagaaacattgaccctggtgatgaccattgttatttgtgcacatggctgtggatgaagaggtaaatgaacagcctccattgtccactgcctgcgtgtggagtaggctctgtggttggccttatgtctgatgagtgcaatctgcatctgcaactctgcttcttatagccataatttgcctaatagtattgctcaaggagagaaaatacatatccatatcttcaggaatataggaccatctggtgagaattacttttaatggctacattgaatattagtagttgattgttaatacagagagtaggaaggacattataatgctcaatagttgtccagtctgggcagttactcagctgtcttagacaagaccaagttttgccttttttagtttttcatcttaatgttattttattttattttattttattttattttattttattttattttattttgagatggagtctcactctgtcgcccaggctggagtgcagtggtgtgatctcggctcactgcaagctccgcgtcccgggttcacaccattctcctgcctcagcctcccgagtagctgggactacaggcgcccgccaccgcgcccagctaattttttgtatgtttagtagagacggggtttcactgtgttcgccaggatggtctcgatctcctgacctcgtgattcacctgccttggcctcccaaagtgctgggattacaggcgtgagccaccacgcccggcctaatgttattttaggtattttaggtgtggtgcctagttttcaactcttgttaaatatttcttaatgcataattctaagaggtttcatttaaacttgatctactttatttaatctaaggcatttgcagtattgtttctgttctttaatttagtaaaaggaaagttaattattgtattctttggagtaggaagtctttgtgaatttaaatatttgtcgtatagaagtctaacaaaaaatattctttttaaaatatggtcaaatacaaattgaaagcaactatatctgtagaaaatttttcataaaaatcattgactgaaggaacaaaagcatgtcattgtatataccaacccttctttatgcattatccactaaaatgacatttcaaaagattcacagtgggtagcatatggaatactccataaacactgattagatttaataatgtttgtatcactgtttgggaacatgtacaaggaatgcgaccgccatatattattaacatcaaaataactcagaagaaaagctcctaattaaagcagggttggtttagagacttagcaaaattgcagccagaaataaccacctacccacctgcccgggacttggggcttgctttcatgcatgcaaaacagacttgattcttagagcttcaagatagctgctatgaaaattataatgggctgtgacaataccattttcagcccgtccagttctgcaccaaacctagtttcagaaggacaacactactgcttgagttgaggtttcagccaagtagcatcaaaggaaagcaagtttgtggtttgcagttctgctgagctgcactcagtgactctgcatgattgattagtatccttttgctttgcaaatgtgcatatattaagttcagcattgcagtttgcaaagattcactcatggcctgccatggtaattgatgcacacctgtcctagggagcaatgtatgagtttttttgtgctttcacataagaagtctctggagtatttttaattggtcatctctagaagagggaaacaggagcagattaaaagtatacaggaaaaggaggttgttctacaagcaatttaaaaatctatttgaaaaagatccccaccacttataagctgaatagttataattaatttgtatccctgcattctaaaataagagtactcaacaggttttatttttatggacaagtatctgtgggcttaggaaatttctttctttcttgtcttttttttgaagatggagtctcactctgttgcccaggctggagtgcagtggcgccatctctgctcactgcaacctccgcctcctgggttcaagcaattctcctgcctcagcctccaaagtagctgggattacaggtgcctgccaccccgcccggctaatttttgtatttttagtagagacagggtttcaccatgttggccaggctggtctcaaactactgacctcaggcaatccgcctgcctcagcctcccaaagtgctaggattacaggcatgagctaccgcgcccggcctaggaaatttcattgttatttattgttgtttttgttttgtttttatttttgtttgagacagtctcgctctgtcgcccaggctggattgcagtggcacagtcttggctcattgcaacctccgcctccccagttcaaacaattctcatgcctcagcctcctgagtagctggaattacaggtgcctgccaccacacctggctactggctaatttttgtatttttagtagagacagggtttcgccatgttggccaggctgggctcgaactcctgacctcaggtgatccacctgccttggcctcccaaagtgctgggagtacaggcgcaagccactgcacctggcctaatttttgtatttttagtagagacggggtttcaccatgttggccaggctggtctcaaactcctgacctcagatgatctgcccgtttctgcctcccaaagtgctaggattacaggcgtgagccaccacacccagcctgttatatgtttaaccctttttccaagttgacatttccctgatactttggctttttaaatagcatacccttccccacaattcatttaatgaatcccttcttaatttacttaaaaacaaagatgttcctccagaagcaaccagtttttttctgtattgtttagggattgtgttttctggttttgtaatagtatcagaacatataggtaaatattattttggagtctagtttaatcagatcactcttttgctatagaaatatgttactagcttcttaacggccaggcggagtgtctcatgcctgtaatcccagcactttgggaggctgaggcaggtggatcacttgaggtcaggagttcaagatcagcctggcaaacattgtgaaaccccatctctcctaaaaaatcaaaaattagccatgcatggtggcgcacgcctgtagtcccagctacttgggaggctgaggttggagaatcgcttgatcccgggaggcagaggttgcagtgagctgagattgcactactacactccagcctgatacagagtgagactctgtatcaaaaaacaaacaaacaaacaaacaaaaaacaactatgttattagctccttaaattataagtcatttcattgctttctctggacctagcatctatcattgctcttgtttacatctcagtaaacatctcagtttcaatctgatttagataaatgtgattttttaagctgaaattcctaaatcagtagtaagtgtgcaaatattttaaagattatttgccatatgttattttagatacttatccctatttttctgcttttaattagaaaaaataatttataaactggatgatgttaaaatatataaataatttattaatttcattcataaaatgagctctaatatatatacttcttatatttctagactaatatacagccacattcatcattttttcctagtacattagtatttttatctaaattaattttcacccgctaatgaatattaggaagcactatacatcattaaaagtatttattccaagatgatttccccaaatgtgttactatgtaaacatactctgtttacccctccctttccatcaaaaatagccttaaggcatcatgataaaaatgatactgtatttatggacaggataaatcaaacacagtgaagatgaaagaatcagattaggcattccatttgcttactcagtatggtttctcttatgcccaggtttccatctttacagaacttattgggcatgtttcacccacactgcaatgtaactgattttcttttctctgccatctgctgttcagttaatatgtgtttggatgtgtgttttatgcaaaataactaacagtctaacattttggcacattttgctcttatgtcttgacaatgtctgggcatttgtagataaaagagatatatttttgttttacatgtaagtgagtgaaaatcactttcccccacccacctctctaaaatgagaaaacactgagaggctaaaaggaaagagcccacatttaaaaaagaaacaaacattaaatcttatttcagagtgattcaaatattgatatccagtagaagcatatatgaacaattagagtgtcttggtttttatttttttgaaacttcactaaactggacgctggtgtatataacctgttctatcagttgttggagattttctctacgtctgaaagtctttagaccagccaatgactactttcaatattctgagggagtaacatgtcctccaaggcaccaggacattacaaaagggagagcacatgtgagggaacgagccgggttctccacttatggttggctcaatcatagaacttttctcttgtagttaatacctctaattccattgctgttttcatagtaactctgtgtaacacttagaagcctttgctcgacattgtcacaaagtagctctaaaatgtggatctcatagtctatctgggcacatctattggcattttttctgccctccctgcattcttagacacacacacacacacacacacacacacacacacacacccacacaccccacatgctttctctgggctctaatcaaagcctttgtataatgaattgcctaggggagaaggagaaagtcactgacccctctctcctgaacttgcacagagccatatgactactcaaacatagaaataaaaatttagatttggtgtttgtgtgtgtgtgtgtgtgtgtgtgtgtatgtgtgtgtatgtgtgtgtagagttagtgacctaaatagaagtttgcctatttcttcctttattgtggtaaaaacacataatgtgaaatctaccctcttaataaatttttgaatgtacagtacattgttaataataagcacaatgttgtaccacagatctctagaaaattttcatcttgcataactgaaactctacacctactcaatagcaactccccatttccctcacccctcagcccctggtagccacctactctctgtttctatgagtttgactactttagatacttcatataagtggaatcatacagtatttgtcctgtgactgacttatttcatggatcataatgtcctcaaggctcatccatgtcgtaacatatgacaagatgtgtttctttctttcttttttttttttttgagacagagtcttgctctgtcacccaggctggagtgcagtggtgcaatcttggctcactgcaacatctgcctcccaggttcaagtgattttcctgcctcaacctcccaagtagctgggattacaggcgcccgccaccacgcccagctaactttcgtatttttagtagagatggggtctcaccatgttggtcaggatggtcttgaactcctaacctcaggtgatctacccacctcagcctcccaaagtgctgggattacaagtgtgagccactgcacccagccttttgatgtctttgtttttaaagactgaataatattccattatatgtataaaccacattttctttattccttgaaggacatgtagattctttcaacttcttggctcttgtgaataatgctgcattgaatataggagtgcaactatctcttcaagatcctgcctttttctttttttcagtccaagagctggctttgaataacacattgacattgaaatatatatggttcctaagatcatgtaattttttgagatgtcagagacacctagagacagcaaacacattaaagatagattcacagttctagtttatatccatgtcacaaactgaacactactgaagctattttgttattgtttgttttcctcaagcagaaaattttcacagggcacatttttgtctctaacaaaggaaagaaaagaaaagaaatgtgttctttggaagtaatgccactgtattcaaatagcttcttccacataaagctaaaaatgtctttcagagttaaataatgcagtttcatatttaagacatacattaaattgatactaggaaaaaaacacaaaatccaccagtgacccagtaaaattagtaaattcttaatgtatgtataagtatatacacatacatacctacacgtacacagaaatgcatatattttagggaaaccttaaaagagaaaaggagttgctgaacagcttaggaaatacagtacaaacaaaaagcagtattgtctgcaaaaaaatttttgttgcaaaagtaatattttccttgtggaaattctggtccagagttgggctattacctatattgaataaattcagggaaacattctgaaatgtttgactgctatgattgaagtattatattaaagtactttatatcgtgaaatgcacttgttttcaaccatgcaaacagttttattaagtaggaggatatcagggttaaggttaggtttacatgaccatatgagaaaatttatataaggtgatggcatgaatggattctgatcttcaaactagacaactagaagttggaattctaatgtcaggggtatcaaacagcccacatggaaaagaaatgagagtctttaataagcaattgggttagaaaatatatagtatttcaatgtcattattttatttcagagtaacatgtctgtcattgagatagtttactgtaggttaaattcagtatgaggttgccatgtacttgcaaggttcttaaccctgttttagagatcataagacataaaagtgtgcaaaatatattcattctagaatagggagtttcctacactaaacaaccagcttaaataatatattcaagtgttttcatgagaaaaaaatcaaaatactttttatcaagatgttagtgctttcattttacctgaatacttatagaatctagcattatacagctggaaggaaccttgcagaatttctactcaaattgctttattttgtatctgctgtgagggatgtaaattccacagatcatcttgtatatatataaaaagggctaaatctcttgcctcagttcatagatcttttgaatgcacagaattggctcttatctttattagtaaacttgatttggaagacatttccttttttgttgccacttctttacctcattggtgattttagttaagtaagcaaagataaacaagaagtggaaaagcagtatcagctgaattgaaaccactacttagattgaaaaagcatgattggacactatctataattcagtataattctcaaacctaaaatgggacatttgaaaataagtgtaggaaaaatacttataaaatgggaaaaatggaaataaaatgtccaaagaattcagaaaattatactaaagggtccaatcaaacccaaatatgtacatattcattccaaaacaacagacatatcagaagtacctggtaccataaaaattaaaatacacacacactcacaaagactgcacaatataatgagaaacatcgtctcagacacttggcatcaccatttctaagtaatttcataactgtatccagttattcttgaatctgtagtaatatttcttaaactcctttttgccctagctctgtcactgttcaataaaactagattccccagggaccttccctttggcaaaattcacactgagtacagtttttgtttcattgatatttgtagtaaaatcatcctttataatcattgaaactgttagcacagactgcaggatctgatagtttgctctgtagttagatatttccagaatatcctatatttggggggagtatatcaaggccaagcatattcggactaaaggaatgtccactgaaccaacaagaatgttaagggagccttgttaaagtactgtcctgatctcgatccgattggctaagaggaagtcttcctgtccttgctccttgtacttcttactgctttgtacttcttactgctgccatgcaacctgatctccattttatcaaggagcctatatacttcaactgcctattagatttcactatcccagtatttcacagataccacaaactcaatttgtctaaaactagtcattattctctgcccccaaaatagtgctcccttacttgtttctcaagttctgataaaacacaagctcacacaaaacatactaagagtcacccaggctgtaaaactcaaggggtattgtcaatattcccctctctctagccactaatatctagtcagtcaccatgttccatggattctacttccttcatattccttttttttttctttgagatggagtctcactctgtcgctcaggctggagtggagtggtgtgatctccactcactgtaacctccgcctcccaggttcaagcgattctcctgcctcagcctcctgagtagctgggattacaggcatgcaccaccatgcctgattaatttttgtagttttagtagagacggggtttcaccatgttggccgggctggtctcgaactcctgacctcaggtgatccgcccgcctcggcctcccaaagtgctgggattacatgcgtgagccaccgcccccgacccatatttcttatatctatcccctgctttccatttgcagtactgttctgttagcttcccagatgctctccctatgtccaatctctcatctctccaaattatccttctcctgttgccaaactagattcctaaaaacaggtaaggtcatgttactcctctgattaaaaatattgataactcatcacctgcaaaggaaacttgaaaacattaacatgcatttcattccttttcaggcttatcccctctatagctccctgcttgtgcaagctaccttatctcagaatagttccagttccttaacagttctagatacattgaggccgggcacagtggctcaagcctgtaatcccagcactttgggaggccgaggcgggcggatcacgaggtcaggagatcgagaccatcctggctaatccggtgaaacctcgtctctactaaaaatacaaaaaaattagccgagcgtggtggcgggcgcctgtagtcccagctactcgggaggctgaggcaggagaatggcgtgaacccgggaggcggagcttgcagtgagccgagatcgcgccactgcactccagtctgggcgacagagcaagactccgtctcaaaaaaaaaaaaaaaacaaaaaacaaaaaacaattctagatacattgagacctttgctcatgctattttcattgcctggagtgtcttctctctggatagaaaaatcctttccatacctcaagatggaatttggaagttacttccttgtgaaacttcctaatgattccaaagtcaggcctttctatgtgaaatttattttaccacatgctagtttaaaaaaacaaaacaaaacaaaaaaaaaaacagagcaggcacggtggctcacgcctgtaatcccagcactttgagaggctgaggcgggtggatcacaaggtcaggagtttgagaccagcctggccaacatagtgaaacgccgtctctattaaaaatacaaaaaatagtcgggtgtggtggcaggcgcctgtaatcccagctcttcaggagactgaggcaggagaatcccgtgaatctgggaggcggaggttgcagtgagccgagaacgcaccactgcactccagccgaggcgacagtgcaagacttcgtctcaaaaaacaaaaacaaaacaaaaaaaaaaaaaaaaaagaggaagcaaactatgggctaaacatgctggtttaaaacagttttgtctgaatccaccacatactatctagatggcgatgaaaaagttagttggtctccctgaggctaatttcatcatgtgtaaaatgtagttaataatagcatatataggccattgtgggggttaaataagacaaagcttgttaagcatttagttcaatgcctgcttccttgtaagagttcaataaacattagtttctgctactgaggctctgctgttacttatcgtctcctaacactagtttataaattcagtgagggttaggaaccatgtcttatcactttactttctttttctctatttaatctctagcagtttcttatatattatcgcagcatgataaatgatgctgagaactgagtgtgaggtagggcttggggtaggaccttatctaattaacatctgtgtatgcctaccatgaatattaaataataatactgacattccaaaatatacacatcaatctcaaaaatgtttaaccataactcctgtattccggtaaacacaactatatggcaatcttaatagttatgtattgcctaacacctgttattttttaactgcctttgattctgtgtaacattctcaataatttatcaaatgtactttaattggatatttacatactgcatactcttctcattagtaggaactagcaaatagacttactatcatttagattgtattctatgcttcatttaaattagtctgagagtttttggttgttgttagtgtgtatgtatgtgttttaatttaggcaccattttttataccttaagcaaaggaaatctgatcctaccacttctttgtttaaaccttgtcaatgacttacgttttgggcaagaaagagttttaaatgcttaatagatctatagaatctggttcctgcttacctcaggaaccatctccttcctcactcccacttaactccgtagtctctagtattctaggcctttttcatcttctttgtgttcctagaatatttaatatccttccaagccttccctcatactaccacaatactccttgtggctcttaccatccaggtttgagttttagtgcgtcatctttcaagaagcatttccagactcatggcctacccctgtcccccacaagtctattaagtctcccaaatatacattcttataacaacttaagctttgcagtcacacttttcttttcttttctttttttttttttttttttgagacggagtctcgctctgtcacccaggctggaatgcagtggcacgatcttggctcactgtaagctccgcctcccgggttcacgccggttctcctgcctcagcctcccgagtagctgggactacaggcgcccgccaccacgcccggctaattttttttttgtatttttagtagagatggggtttcaccatgttagccaggatggtctcgatctcctgatctcgtgatccgcccgcctcggcctcccaaagtgctggtattacagttgtgagccacagctcccagcctgcagtcacacttttcaaattgcaatttaaaaaatgttttgtatttgtttaatgtatattttccccactcaactgacatctccttggaaagcagtaaccttgtctgaatattcactactccgtcatcagcacctagaagatacctggcacatagtaggcatttaatcaaaatgtttgaataaatgagtgaagaaatcactctgctgggtgactaaggatgcaaagctaaactctgtcttcgaaggaaggataaaaagacagacacataaaagacaagagagtgaataaagaaagtgggtagagaaaattaagagtgctgagtgtacttcttatctctctaataactaccacatttgtgactttaacaggaggcttatttaaaagcattttttttatcctagctgactcagaccatttatggaaaagtggggtcattgcagaatgtttttatctttctggtagcataattacctcctctatgttaaaaactgaggactttggttcaaaatactcaccactgactatactatctttgttatattatttaaatgtcctatgcctcgattttctttctttcttttctttttttttttttattttaacaagatctactctttaggtagtgagagagcactaagaaaatggctactccaatggggcaggaggtaaaaaagagaagcaggggtacttgatatacttcggatagtacaaatctggtgattctgatccccagaagggattatggactgatatggtttgtctgtgtccccacccaaatgtcatcttgaattgtagtccccataatctccacgtgtcatgggagggacccattgggaagtgattggatcatggggacagtttcctccatgctgttttcatgatagtgagttctcatgagatctgatggttttatcactgtctggcatttcccctgctggcattcattccctcccctgccaccctgtgaagaggcgccttccaccatgattgtaagtttcctgaggactccccagccatgtgagactgtgggtcaattaaacctctttcctttataaattacccagtctcaggtatttcttcataccaacatgagaacagactaatacatggacgtaaccccacattgggtgtcagaataacggaaaaggtgtaaaagtgaggtgactgattctcctctggaaggtttgcagggaggctgtcctagtgggctgccaccaggatagttgctactcacctgtgtcctggcctggtcctggctgagtcctcacccaaactgctctgatgggtggcagtaatgatagccatgcctcagttttataatctgattttttttttttttttttgaaactgagtttcgctcgttgctcaggctggagtgcagtggtgcaatctcagctcactgcaacctccatctcctgggttcaagcaattctcgtgcctcagcctcagaagtagctgagatgacaggtgtgcgccaccacgcctggctaattttgtatttttagtagaaatggggtttcgccatgttggtcaggctggtgtcaaactcctgacctcaggtaatctgcccgcctcggcctcccaaagtgctgggattataagcgtgagccaccgtacctggcctataatctgatttttaacagaatttttttagtctatatcttgaactattttaaagtattatgttgaacccaaatgaaaattaatacatgcattccatattatccttgttaatgcttcatatttgtaaatacttgtcaatgcatattcatcacataatgtgtggtttgtaagtttcacatattttaatattatttttaaagtacatttctttgaaatgttaataatttctaactaaaaattatccaaattaaatggaaaaattcatgttttgtttttagcattaagaggaatcttttctgacaggttttaaaaagtggaaatgctgtctatattttaatagattgtatatttgtgacttccttttatttaaatgggtaattatgccaggttgttaactaaagcttgtgtgaaggttaagtggatctcaagttgatttttccatgttcttcaacaatccagcagtaatgatatttaatatttcaggcttttaaaatgaaaattataagtaactaaggtactacctatgaagatgaaaaattgtagcaactgatttgactcaagtatctatgagctctataaactcttcatttcccagtgctctgctaatgcttattctaattctaatggaacatgttttttgtggtaacaattactccttacatcaaaattaagtaaaatgataaacagttttctacacatagcattgatgaagtgatcctactttaccaataggatcagttagagggcaagggggtataacacctgccttcagctacctgaaatagtcaaaaccaatataaatgtacattaaagtataaaggaaataacttactttctattttggtataagcttatggaggaattacaactatctcaggttgaattttaagtccatactgttagtatattactaaggaatataatctagaaattcatatatagtcacacaaaaacatgagtgataaaagctttaagagaattctatatagtgcataaataccccagtaattctgatcactgcttccctagatgagattccctagataaaaatgctttgtgggctgggtgcagtggctcactcctgtaatcccagcactgagaggcctgggtgggcaaatcacttgaggtcaggaaggagttcgagactaacctaaccaacatgatgaaaccccatctctactaaaaataaagaaattagctgggcatggtgctggccacctgtaatcccggctacatgggaggctgagacaagagaatcacttgaacctgtgaggcagaggttgcagcgagccgagatcacgccactgccctccagcatgggagatagagtgagattctatctcaaaagaaaaaaaaaggaaataaaaatgcgttgtgggacttatgataaatgttttataaattaactttccagattcatgactgagaccaaactgatttcaaattaataacattttcaaaacattagcattttaccttgcagtgttttaaaatgctgcacacattttagtttataaaccccacaaagaacacttctgttagggagaagatgatgtgattttagcttacagttatcttaaataacttcatgcttgaaaaatcagaaatatttgtctttgtagaacaaggaatttgaaaggggactagtaaaaggaaaattgcattgaatttcttattttcctctcatacttgccaagtttatatgtattagatatgtcccacttcactgccataaggttatatttattttaggttataaattactctgaattaccttcatcttggaaggtccattgttttcccagagttcttctctttaaatatttcaaggacttccaaagttgcttaaacagatgggaagaggtcactctacattttgatcctggaatagtctaatcatcctccccagagtgtcctgttctttgaagcttttgtagttgttgtcactctctcctgtggcaccaaatgccaggaaatctgggtattcaggagcaaatgccctttggctgctgatcgtaccagtgccttcagtagtttctcagggaactgtgttaggagaggttctagcattagttatatagtgtgtccataaccagctttcccgtgtcaccctaaatatggccataggcttctccctcagtgctgccaaaacacaactaagggcaggctgcctggccgagtcacaccaatcataatggtctacaatacactttcttaagtctcagttatattcagtcttaaccccaagtgaggagtaacagtaacccagatcaaatctctactgatgaaacaagctttctcctccttctccatagacaaggtcctgttaaagatatacccactttatattataaatagaaatctacaggtagctgtaaagataccttgtatctctacgacatgaaaatgtcattctgtttctagaatcaaaactgcctgtaagccaccaaatagccttgctggttttttgttttattgttttttttgtttttttttttttttgagatggagcctcgctctgtcgctcaggctggagtgcagtggcatcatctcggctcactgcaacctctgcctcccgagttcaagccattctcctgccttagcctcccgaatagctgggattacaggtaccctccaccacatcctgctgttttttgtatttttagaaaagatggggtttcaccacatccaggttggtctcgaactcctgaccttaagtgatccacctgccttggcctcccaaagtgctgggatttcacgcgtgagccactgtgccctggcaattagcctttcataaaatgcattttatagtaagtttttttttttttttttttttgtgaggcatcccactacatacatttaagtcttatttctactgggtatggtggtagatgcctgtaggcccagctactcagaagactgagatgagaggattgcttgagcccgggagttctgggctataatgcgctaggctgattgggcatctgcactaaggtccacattaacatggtgacctttcagtaacgggggaccactaggttgcttaagcaggggttacctagcccaggtcagaaacaaagtaggtaaaaactctcatgctgatcagtagtggaattgcacctgtgaatagccaccacactccagccttggcaacataacaagattctgtctcttagaaaaaaataaaaagacttattttctttaaaccgtattcttaatttctattctctaatataggagataaacaaaatggccagttttaaattttatctattgtattagggttctccagagaaaaagaatatatatatatttcttttttatataaaataagaatattttatacatctatatatagagagagagaattatggaggctgagacatcttgtcatctaacctccaagcttctgcaagctaaaaaaccaggaaaactgatggtatagttccaatacaaatccacaggcctgagaaccaggggagccaattgtttatgccccagtcccagtcccttggcccaaaaaccaggaatgtcaatgtcccagggcaagagatgatagacggctcagctccagaagagagagagagcattcacccttctccactttggtgttttatcttggccctcaacaaattggatcatttcccaccctcattgaggagggtgatcttctttactcagtctactgattcacatgcaaattcttccagaaacaccctcacagtcacacccagagacaatgtttcaccagctatctggacatcctttaactcagtcaaattgacataaaattaactattacatctactaaaatatctactagagcaacattcaggtctaaagacacaaacttaatttaggctgaccatcattctactgataaacatattcactattacatatatagctttaaaataaatatgattgaagccaaccttgttattaaaatgtatttaagatgttcagattgatgaaacgaggggattaaaatgcgttctcaaatacaatgaaatagtactgtaaaaatattctcagtaaatgagttttgctgtgaaattggtttaagattcataaaagggatttcaggtttttaagtactcaagtcagcccatgacccagccttcagtggtgtcatcctatgcagtgttagaatgagcctttactccttcaacaaatatttcttaagaactgtatagcttactggttaagaacatgggttctggaggcacactcagtttatttccatttttgtgacatactagctgtgtgaccttatgcaattatttttttatctcagaaagctgttgtgaagatgaaatgagttagtccatgggaagtcttccacagcggctcacacaatttattttttaaaaaggttaggtacagttacattgtcgttattgttgattttcatttcttttgttactgctactatttcttctctgtgccaggcgcacgtctaggtgttgatgagtcagtgatcagagaaggtctactttcatggaccatatttttaagtagggaaaggtaggcaataaacagattgaaataagaaataagaaaaatagacaaaagagataatgtcagatagtgattaagttctcagatgaaataaaataggtcagagtaacagtgatggggatggatattttagattggatagttggggaaagcctctatgaggaagtggcatttgagctgcgactgaatggcttggtgggaaagaaacagtctaggcagagagaacaagtgcaaaggccctgagttgtctgtgaccttggtatgttgaaggaacagaaagaaggttgatgtagccaggcatagtactttaaagggagaatggcatgagcttacattgcagggatgggtagcggacaaatcatgtagagccttgtaaatcatgggaaagactttggattttcttccaagtgttgtagaaagttattagagggttttcagaaaggaatttacatttgaaatatcaacagataccattttttaaaaaattcaagtagagatgatatgtagacagttgattatgaaagtgtgtgtctcaggggagagattgggataggagagatataaatttgggcgtcatcaatatagatgatatttaaagctatgtgaattgctgaaatcaactagacagagaatgtagatagagggctcaggaccaagccctctactctaacattttatagaagtcgccagaggaatccaggcatggtggctcacgcctgtaatcccagcacgttgggtggcccaggcgggtggatcacctgaggtcaggagttcaagaccagcctggccaacatggtgaaaccccatctctactaaaaatacaaaaattagctgggcatggtggcatgcgcctgtaatctcagctacttgggaggctgaggcgggagaatcgcttgaacccgggaggcggaggttgcagtgagctgagatcatgccactacactccagcctgggtgacagagtgagactctgtctcaaaaaaacaaaacaaaagaaagcaaagcaaaaaaaaaaaagaaagaaagaaattattaccagaggagaggaagtgagaaagaaaacttttcatttctgtgtcacagaaattaagagaagtagctaaatgtgtcatatgctgctgagacctaaaaagaaaaataaaggagttaatattggattttgccacatgaaggtcactattattgtaaacaatacactgctatatgaaaagaactagatatcatgccatggactattacagtgtctacattctaaccctaaatggatgactgccttttatctagctcccacaactctaaaatttgaatggtaatattgctctgcctttttgaaaaggttgttataaagaatatgggatataatggaaggaaaggtatataataagtgataaagtcttatacacatgcaaatcgatggtggtagaattatttgtactattagattataaacttcttcagggtagagattaaggctttaatgatcattctatcgaccacaatgcttagcatgataccaccccagtatcttgtatttagtggcttaaaaaacaaaataaaaatttcccacatgaagccaggtgtggtggcatacatctgtagtcccagctacttgaaaggctaagacgggaggatggcttgagcctgggagttcgaggctgcagtgagctatgattgtgccactgcactccagcctgagtaacagagcaagatcctgtctctaaaaaataatatagataatttaaaataaataataagtttttaaaattcccacattaaatacagggatgatatggagtgatgttgtccacttcttttcttacctgcagtcccatataggatttggtgacatggttgcaattgtgaaaaatttcagtgctgactcgccagccatctatcccttttacaaagtaatctctttgaagataagtgaaggatttagagattgggctgctttccatttgttattttcaagataaaccattctcagaatttttcaggtttcctcacttgggtacgagacaatttctgaaatcagtttttgttctataagaacaaatttatgaaattcggtatcactacatggacatgttttagctggtgaaaaattgtgttatgataaatggggaacatacaaattttcccttttttgttatctttggctttttctctgtgttatacagatgttgagctttctgcaatatgcaaacagtttagtaatttgcattgcaaatagattacaagtaagtgacctttgcaaagtgcttctgcctagcgagtccctggaatgaatctgttttatttagggaagagaggctagaaaacagaaatgtcactttcattctttgctaaaaaatgaagagtcttctttctgctatgcttaaatatgatgataaacattttcttaaaaaccaatatatatatgatgacagtctcaaaggtaaaaatcagaatgtttttatatgaagcattacgtgtacccttccattgctaaaaaggaaagtagagtctgtcagaaatgtgtttgttttttcgggtctattgacacaaaaatgggcttgaggactaaaagatttaatgtggcttgtcagcatgaaagaggctgttgtgttgttaatgtgaatgctaatacttacgtagcataaaaaaagaacataggaagtgggcatctcacttttaaaatcatggtgtattccataagtgtcagctgcaaagtaactttccagaaatggtctgatttccccattgacttccattatagaactagagctgtgttcccatggaaaataaatttggccccaggttataataaaacacagtgaagaattcagaaaatcttataaagtcaagtttttcaaggcacaattatcagtacttgataaaataataacaccacaaaatattaatactctatagtagatcttaaaatagtatgccccagactgcaccattatttttctatacaattccaagtctattacttttgcatctagagaaattttacttctgtgatcattattaatttttaatggatttaactctaatttaaactgttgattttgtttccttttttctttatggttagtccacttacctttttctaaaacattcttatctatgacaatcaaaagttactagccatagaagaaagaccagaaggaaatgctccaaaatgttcacaatacttgtttctgagtgggaaattttagttgatttaagtttttaatttctaagttgtaaaaaagggccatttatatcttctataatcagaaaaaatgtattataatttctataagtataaatttatatatagtgagatatctttagtaggacacatttatatatttggttcattttatgatttggtaatggtagttgttaagatcatttattccttcaaaatttttttaaaactggtaaaattagtttctggagataatagcttctacttaattttctagaacatactactcaaagtgtgggcctggaccagcaacatcagcatcacttggaaattagttggaaatgataattcttaggcccctgatctggggccccaggaaacagctatttgtgttttaacaagccctttgggcgattaaggttctaaagctacagaaaattctctctagagctacagcaaattttctttacctctctctccttctcctccctctccctctgtgtccctctctccctctccccttcatcctctcttctccctccccccttccctccttctccgtcttcctcctttcttgccaggccacttcctctcctttatagaggaaaagtagtttctcttctcacccattgctgggtttgtagctgagacctctaaaacaaaagacagattaacaagaggaaaacttatggatttatttaatataagttttatgtgacacaggagccctcaaaaatgaagaccaaaagaaatagggaaacttgtatatttttatgattaggtttgatgaagagtggacagtagggaaatataatcaggcaaagggggtatgatctaatggtaatgagctgggggaacttagcaaggcatatttgttcagattcttctctgtgtccatatgtctccagagataaggacattcttttccttcaggtataggaggagcagctctgaaatgagggtcttataacctacttcagaggcagttaagagaatcattttcttgcctgcttcaggagaaaaggattagaagatcagagagaacttcctgcttttgctgatttctcaaatgccaaggtgccatattttggggaagtgtgtcttgaaccccatcaccttcttccttctctgtttcctttcctcatgtgggttatgcatatatgtatacacacacacatatataacactcatatacagaattcactataacctctttttttttttttttttttttgagacagagtctcacactgtcgcccaggctggagtgcagtggcgcaatcttggctcagcacagcctccacctcccgagttcaagcaattttcctgcctcagcttcccgagtagctgggagtacaggcgcgtgtcaccatgcctggctaatttttttgtacttttagtggagacggggtttcactgtgttggccaggctggcctcaaactcctgaccttgtaatctgctcaccttggcctcccaaagtgctgggattacaggcatgagccactgcacctggcctcactataacctctatctctacttatatagagatgtatattaaaaagagagaaaaaaaaatatatatatagttttttctttaagttttttgccactgttttctaccttactcataaaaatatatgaggccgttttctggtatttatgcctatatgctttcatttagcaaacattttctaacaaatgttccgtgtggctacatattgaatagttctgcctaatttaaagatcttcaagtctcactaaccaatataatgactctatcaagttattttgggctaaaatgtgtcttccccaaaattcatatgttgaagtcctaaccaccatgtacctcagaatgtgactatatttgaacatagggactttaaggaagtaattaagttaaaatgagctgattagggtgggccctaatccaatatgtctagtgtaagaagaagcgattaggatacagacaggggaacgactatggagagacctcagaagaaactaaacccaccagaccctgatctcagacttctagcctccagaattgtgagaaaatcagtttctgttgtttaagccacctaatctgtggtattttaccatggcagccctaacaaactaatacacaagtatttgtgcattactaatgtatttatagaagtgatgatttaatttaatcttaacatctagtgattgattgcctttaaaaggtactgttgagccatgttccttaacaaaaagctacagctttacaaagactgcccgagaacagtatgaaaaactctccaccatgcacaacaacatgatgaagctctatgagaatcttggagaatacttcatttttgactcaaagacagtgagcatagaagagttctttggtgatctcaacaacttccgaactttgtttttggtaagtaatacatcttaaagcattgcaagacctgttgcttatatttctgaatgttttccttctattgtcattttatgttcctattgactatattgatttcatgtgacatttttttaataagaattgacagatattttatacctgtgacatggataaaaattaagttataagtcatggctggcttaacataatgtggacctaaatgaatcatcttcaatgttaagtatacatgggaaatgttttactgaaattttataggaaatgaatgaattggtacttaaataaccccaatttttatatagcataatattataatttcacgtagcgtaaacattaatatctagaacttttcacataataaattcaaatgctgtgatttataaataagtttctttcacagcctaaatgagaaactgattttgaattggactgtgtaaataacattgaatacctaaagtttctttcacaatgtgggctcttgttttaaactggaactcttgaggatcacagtaaatattagcattaattgggggtggcaattagggtacaagttatgatgctaaaaggaatcaaaggctttgctatataaatgctatggaaatacacgtcctctgcatctaacaaaggagtagcaggaagagcacagactgattgcaatagtaacagaaagatatgcataatagttgatatcaaacaggtaaaggtgtgtgtgtatatatatatgtgtgtgtatatatatgtgtatatatatgtgtgtatatatatgtgtatttatatatgtgtgtgtatatatatatatatattttttttttttttaattttttttgatatggaatcttgctctgttgcccaggctggagtgcaatggcgtgatctcggctcactgcaacctctgcctcccaggttcaagtgattctcctgcctcagcctcccgagtagctgggattacaggcacatgccaccacgcccagctaatttttgtatttttagtagagatggggtttcaccatgttggccaggctggtctcgaactcctgacctcaagtgatccacctacctcagcctaccaaagtgttgggattacaggcgtgaggacctctagcaataatccccaacaggaagatcagttaacaaacaaattcattccagtgtgaggtattcccaaagcagtactttctttgtattcccaaagcagtactttctttgtcaatgctgttgccctgtgaaatcatttgattttggtgtgacttcatctgtgagatatgaatatgcttgtggaaatcaaattgctttcatctcctaacccagggcctataacccagagcatacccgaacagttaaacaagcagctttagtcacagaagttaatccacaaacttccagaagtatgatcatatgtcttcttttttgctgaaaatattagttgatttttgtctttgacccttcatagagacacatactttttagctaacccataactagtagaatgtgttctactggcaatgagaagagggctaagagaagtagtcaaatcattttcaaaacttaaaagctgattatatgctatgaacacataagcgcacaggttatatctacttggattattttcaaaaaggacaaaacaatgaacattaaaaaggaatgatgaccagaaaatatactttagttgacacactgaaatgataaatccaataattttttttgtaacaatgtctgtgggtgaatggatatataagaatatgtatgtggctaggcgcggtggctcacacctgtaatcccagcactttgggaggccgaggcgggtggatcacctgaggtcaggagtttgagaccagcctggccaacatggtgaaaccctgtctctactaataatacaaaaattagccggtcgtggtggcgggtgcctgtaatcccagctacttgggaggctgaggcaggagaatcgcttgaatctgggaggcgaaggttgcagtgagccgctggagacagtgagactctctgtcccaaaataaataaataaataaaagaatatatatgtaaaatatataagaatacatatgattaatattgttgatctccatttagatcctaaaacactgtctgtcttattatatgttcccttacctccccaatacacagacacagagtagtagatggtgtacttgcccccccatgttgcagcattcttctaataattccagtgttacagcctgtgtgtactcatattagccatatgcctagaaggctaagaactctacttgtatcacttttcaatcataacttgttttttaaaaatgtaagaatattattgttaacgagacctgattttgtatcctggtactgccactaaaaagctgtgtgactttgagtaagtcatttgtcctttctagctatccatttctgtctgtcttttgtaaaatgaaagagttaaaggattgatctctaagaattcttttccctgttagtagtctgagtcacagttcgaatttcagagatggcagagtcatatatattacatacatatgtaggatatgttttatgtctttctgctgacttcactgcacatgtagcttgagtacagagtaagaatttttcatatattgtcactgaatgtaaataatttgatattcttatgtccagtttcatgtccatttaagttaatttcttgagaacctgttacgattaactttcaaaacaagtaatcagatcctaaatgtgtcaaccaatctgaaacacttacctaatgcactcctgaccagccattgctatctttgccttatataacagtactgctaccacttctatctacaaatctttatcaacttgctgccatgagaattaggtgtgcaacgtattaactgttttgaacgtgggtgggacatataacctctctgggcatttgtttccttgtctataaaagacggaaaataatttaagccatgtcttcctcactactatctgaaaagaccttgaaacctatgctatacagatgtagaatattattagccattctctgactatcctttccattaactactgaaaaccaacttgattttggtaatgctctgggtcacagataaaaggaagagaatggtttctctctatccatgagtggggacagacaaacaaatgcaatataatttgataagtgctgccatagaaatatgttaaggtgcgataataacataaaggaggaactgcctaactctgcctgtgttggccagagaggccttcatagaaaaagtgacattagggcccggcacggtggctcacgcctgtaatcccagcactttgggaggccgaggcgggtggatcacaaggtcaagagatcgagaccacggtgaaaccccgtctctactaaaaatacaaaaaattagccgggcgtggtggcgggcgcctgtagtcccagctactcgggaggctgaggcaggagaatagcgtgaacctgggaggcggagcttgcagtgagccaagatcacgccactgtactccagcctgggcgacagagagagactccgtctcaaaacaaaacaaaacaaaaaaaagtgacattagggcagagtcttgaaaaatccataggcgtttgacaagcaggtttgaggtttttatacctgacctttaagtcgaagactcctaaatcaacatcaccaacttcagtcaatcctttgtgctcaccatgttcctgtttcatagtgaacttgaagtgatttcactctcccaggggagggaagaaccctgaaagattggcaaaaattgtaatcgccagaagttcccattttcttagtgctttgtgtgtttggcctcagggttcttagcactaaaagcatattggactatagatggaagcaataaaataccagtagtgctgagaagaaaataagagttctgatgcatgtgctaccaaaaattacttccaaatgagctcagagtttcatcttgggagatctatttggcatatgtagcataaacaaaatgcacataccaaaaaatcttcctccgatagagatatcctctaaaagatggggcaaatacaaataaaagaatttgacattatggattaagatctttttgaaagtaaacaattcaaatgaatgaaagcagaattggataatgtctttggaagacttctattagttaatattcctattctatattactcagctaatgaggatatcaaaggtattccagatgaatgtacaatatattggtatcaaggtatatataattagaaacatttctaaattcagaattgagaccctttctagttagtttctcagagatttcatgagtttaaagaacagcatacaggccaggctcagtggctcaagccggtaatcccagcactttgggaggccaaggtgggcagatcacgaggtcaggagatcgagaccatcctggctaacacggtgaaaccccgtctctactaaaaatacaaaaaaattagccgggtgtggtggcaggtgcctgtagtcccagctacttgggaggctgaggcaggagaatggtgtgaacccaggaggcggagcttgcagtgagccaagatcacgccactgtactccagtctgggggacagagtgagaatctgtctccaaaaaaaaaaaaaaaaaaaaaaagaacagcatacaatatagacaaaattaatagcccctaaatttaagttgcatattttgtggaagaaaatcaaattccatgatacacaatggagactcaggagggttttgtggtaggaggggtgtggataatgagaaaaattacttaatgggtatgatgtatgttattcgggtgatggataccctaaaagctctgacttgacgactgtgcaatccatgcatgtaacaagattgcacttgtacttcataagtgtatacaaataaatcaaattccatatttatgcaatgtctaaacatcttttttgcttattctcctttctatgcttcagtcattcttttagttcaaatagttgactgcacaaatagtcttttttttcttttgagatattttgaatagaatattcaaaatcggtgaaccgtatatgtttcaccaccatgcagtatcttgcttaggcataaaaattaatttcagctgttgggaaagtgttcacggcaagtattatacttctataactttcacagctccaaataaattatagaaaatacttcttttctgttttaaatctgtcagtttcctgctgcttctgtgtgtttttgttttgcttttttaaagaacaatatgttacccaggcactccataaatatttgttgtgtgtgtgtcctcattctgtacctcatataccaaatataggaataaggctttgcagaattattagattcattgacataacttgaaaatgttaccgttgcttttaatcatgccagccaatttcccctcaacaaaatcagtatgtgctactgttcatttgataaactttggaacagctcctagatgagcattaaaataactaagtgttaagatgctaaatgatatcaagtaatcatagcgttttatgccattattcaggcttgctgcttctacttcccagattgactgattgattgagaccgggttgctctgtttcccaggctggagtgcagtggtatgatcatagctcactgtatcctcaaactcctgggctcaagtgatcctcccacctcagcctcctaagtaactaggactacaggcatgcatcaccatgcctggctaaatttttaatttttaatagagatgagatctcgctgtgttgcccaggcttatcttgttttcctggcctcaagcaatcctcctgcctcaacctcccaaagtgctggaattacatgcatgagccactttgcctgaccctagataacttttgaatccatccatttctctccaagcccactgacactatttgaattcctggcttcaaccatctctcgtccggactataataatgacctcctgactggtatctgtgtcttcttctcttacccatttccatttcctaatccattcaccccattttagtcagaataaaattaaaaacaaaagaaaccaaacaagataaccttagtttcctgacttaagattctttcataacttccctgtggcctcaggataaatctgagcttttttttgagatggagtcttgctctgtcgcccaggctggagtacagtggcttgatctcagctcactgcaacctccaccccctgggttcaagtgattctcctgcctcagcctcctgagtagctgggattacaggcacccaccaccacgcctggctaatttttgtatttttagtaggagacggggtttcgccatgttggccaggctggtctcaaactcctgacctcaggtgatccacctgcctcggcctcccaaagtgctaggattataggcgtgggccactgcacccgaccaaatctgagctttttaaactaaaatggtttacaaaatcaaaagagctatggttactttaaaggccagaccatctatggttggctctgaatgggccgcagtcacttagattgaactcttctcccaaattgggaaatgttacttctggaaagtagaagcagtagaacaagataatagcaagttcctaagaggaactgtgtctctcagaacaaagagaaactttggaagcaccatatgaaaattcaaaaaaggctgaaaggccaaagtatgattgtcattatgcctttattgctcccatagctggtgtgacatggagagttataaccactgagttcactcttacgttaattctcagggatgttcttccttctatcttaagtaattgttctttaaaaacctaaacttgtctgagagctccctgtgtagccatgttggcttatggagataattaattttgaaaatctctcatctctcttaagctatcttcccttttacaaggcctcagtcatgtctaaatctaaactataattggaaagtcaatgagtatatctgcatttagttaggcttgaaagactaaattgataatatacagaaaatttgattcatttattaatggtaatttacctttaaagaaatgagggtgaatttttacatgaaaggattgtgtatataatccctgatccaaaatgacttaagttgttttgacacatttttaaaccaagcacttgacattaaaaaaaaaaaaaacttcagtattataaaaatggtaggcttatgtgagaaaccaaatatattgtttaacaaagtagtgtcttaatcagtaatgtaaattctgatatctagaatttcatcatccagaaatttctattagatgcctcataagttggtgcctctttgctttgccagtaaaatggtaatattctgaaaacaaccttaagaagctgcaagaccgtgatgtgcttctttaatgatatagttttttttgtaaactagatgtctccaggtctcttcatttatgaattcagagggggtgtccttagtaacagtaatccaaatatcccagttatctcctcttttcccccactggcaggactcaagctctttacaaagtctttacccctaaaagtacacctggagtcatttcatgggtgctgaaaacgtcatctgtagtcaccagttgaaatttgctcaccaatcagcaactgagtgcctttattctagagtgatgaaaatatagcaatgaacaaaacagacaaagcccctgcctgtcctgtcttgctgtagcttcagctccattctgctaaatgctttttgcaggcaaaactgcttggggttgcctttaatgaaaatgcctatgtgtgggccaagggtacagtttcctactgctccaattttgtcatcaatcttgaagtaccattgtggtattatgttcagtgcagaagtagccatgtttcacaggacacttcataaaaacagttcattttgcatctcttctgatccctttctccttggagactaaaaactgtttcaactcctagagacctgaagggaatcctaaaatcttaagcccctccattgccctccttctccccttttgttcaagtgcctaggcatgtatcttccttttcctaggagctgggaataaataaaatgccagcataaatcgtttcatgcaaatagagccctaagggcccaccaactctctctagttaatcatatacacccagataattccctttgagctcagctgggaccaccctgggtatatagccttaggtttattttgatctgttgcaactctttgaaaataggcaatccatggaaaatatatggtaactctattaagcagaatatttgaccggaatacctcattccccagctgtgccagagagcagactttactgtattttacagatatcattgaattgttctttagaaagagatgtcacctatcaaatgttgtattctctttgactgtttactttgggccagaagtggatgtcctatttctcttatatgatttttccttgtatagaaaagctaaatatcatatcatagggaactaaaggaatatgtaataagggaagacatggtttaaggaaaactcaaactccctaacatgataaaaaaaaatacctactagtatggatggtttttaaatatgtatgcattttagattaatattataaaactaaaaaaacagttttttctaaaaatatttataaaagttgacagaattgtttatgacaagctgaattttaccctttaaaaatctgacaatataataattaacaatgaaaatattaacaaaatcagttcaatgccaccttttcctattaaagtctaataagaactagaatcaggaaacagaatgtaatatctttagttccagcaacaacgcctcatgcagaatttttcacagaagtgttccctataaataagttattattgaattatgtccaaacaccaggaagtgggaaagtgtaagataagcaatatggtatacaagctgaccttttccagaagtcttgagattggccagaggtattgattgtgatcagagcatgcctgtttcaacctaagcatgaagatccctgaggttaatactactggtggcaccctctcagctggctgaatttttcttcattctgcttcatcctgttttgtttgtccatttgctaattaatcttctgtcagaaaagatgccgtcacccctgaataaggcagtagaagggaggacttccccggaattgtgcccattgagctcctttggtatgcctgccccctcttcttctcccccctccttccagttgcctaccaacttgttcaagtcatttcctctaagaagccctccctaacttccatttcggtgtagattacccttctctgtgctctcatacctccatcttagcacattttaccctgtaatatgtttatctccataccctcgtgattaatactataattagcctactgtgggtcaaacacagtgctgatctcgaaggatatgtatgaatggcttaatgaattaatagaacaatgagtgaatcaaacaaaaaatcaaaatatttgctctccagagctcacattctagtgggaaaggcagtgaaagaacaaatagtggtaatgaaatataatacatatgtacaaagagcttgtaagcacagagcagtgaggcatttcttctgtctgatttaaggaaagcttcaaagacatagagatatgtgaactgggtctgatcattgttttgctactatatggcctttcatgttttaaggagcactttcctttttgttctcccccacctcatttggtgtttaattttaatggtaaacatacattgtctcctagttttccatgctgagttcaaagtggaaaaacagctattttgttgccagagaagcagttaccagctaattatgatgatctaaaggttatctgccatatgcttagatgagcagtaaccaagcttcagttacttcttatgactgacagttgtcctgagcaataggacaattgatgcagattatctagggcaaaagcaactgcttaaagtctgacttgcctggtgttaatttaggccagtggttctcacccaagagcgattttgcctcccaagggacatttggcaagatctagagacatttttgtttatcacaactaagtaggatctgcaactggcatcaagtggctgaaaccaggaacactgttaaccatcctacaatggacaggagagcctcccacaataaataaatattcagcccaaaatgtcagtaatgttgagattgagaaaccctgtttcaggattacctgcaaaagattttttaaaaaaaattataaaaaatcagtggaaaacaatgtgcaatagtccaaattaataagcaaaatctactagataagttaatattatatctatcatattgatgtaatattttaataatttcaaatgttaatttgatcactgtattgttacagttactacttttttctatagctttgaaacatcccagtttatatggcttgtaaaattttttaattaccaatcatgcatgtaaattgtagaaaaattagaaaatataaataccaaaaagaaaaaaaactgtcgactgcaattccactatccagagttaattaatattaatacctcggtacatatccttccaggcattttcctatgcatgtacataagtatttagattgtgaatttgtttttcttaaaataataataaaaagacttctgaaaatttaagttttaaatttatattttcttgtaaaaaggctagtggatcatgcttatatggatatgtccatccacattcagtgtatagtgccgttggttatgtcttcagttgtgattaaacatgttaattggctcacttcatgatgcccttttacaaacacctggtctttggcaccatgctaacaatcatgactactgtaagccatctgtaaagagatcggtagaatcttgatttctctttttgttttctacataataccctcattaaacttccctgtgtcaaggggccttaaatcagtaattggtgactgtccagttaggctattcacactagtgtttcttaagcactttgctgttgttctctgctgtgcactttgatttaagaaccattacttacctaaactagggtgttcttttttaatcattgcaaattgttaataatataatgatttgtaatctaatcacaaaaattcttaacaaaagcaatgttacgatttaaaatgagagtaagtgtcctatatatgtcctatatatgtgtgtgtgtgtgcgtgtgtgtatttttttcctttgtttctgtcatcctcttcttgaatcaaatttcattgtcatggaatacagtctcctaaactgctttttaaagatctgaaacatggataatcttttttttttttttttttttttttatgatacagagtctcgctctgttgcccaggctgtagtgaagtggcaggtctcggctcactgcaacctccgcctcccaggctcaagcgattctcctgcctcagcctcccaagtagctgggattacaggcacctgccaccacgcctggctaatttttgtatttttagtagagatggggtttcaccatgttggtcaggctggtcttgaactctggacctcgtaatccacccacctcagcctcccaaagtgctgggaatacaggcgtgagccactgcgcccggccatgttataatcttaataatgaggcagctactatttttgctcatatccattttaatttctgtttctgcaaacatacggttttggaatattcagaatttcctgacattgttcatggggtattgggcaaaccagagaatacatagtattcctgaaaagctaatcatccattcaaatcttgacattttgaaatggaagatgctctattattcttcagggatcttatatattttgtgctcaaactactggattactcagtatgacagtgtagttgaagtcattttattttattttttcaaatttattaatcaggcacaaaagagccaaacttcatactggagacactatagtttagaatagtgtattatttgttcgtgctcaattgtctttggtctagtaataaaaaactaaagtctcatatacattggggacatataaaacagcagtaattaacaaaacagtctgggtgcggtggctcacgcctgtaatcccagcactttgggaggccaaggcgggtgaatcatgaggtcaggagttcgagaccagcctggccaacatggtgaaaccccgtctctattaaaaatacaaaaaaaaaaaaaaaaattaggtgggcatagtgccgggcgcctataatcccagctacttgggaggctgaggcaggagaatcacttgaacccgggaggtggaagttgcagtgagccaagatcgtgcctctggactccagcccaggcgacagagcaagacttcatctctaaaacaaacaaacaaacagatgattatgtaaaatggatgaaatcgcaaatataactgtattaaacaatataacctctacatgggagatatgggttggtgttccccaaaaacttgaaactttattttgaatgttaattatttttagtgttgtgagcaatcctccttcatcaaatgacatctacgagatattatttgtgaaagtatttgctcctttgtttaaaatataagatttgtaaataaaaatttaagatgaagccttttttaggtgacagtctccttctgttgcccaggctggagtacagtgatgcagtcatagctcactgtagcctcagacccctgggctcaagctatccttccacctcagcctcttgagtagctaggactacaggtgcacaccaccatgctcggctaatcttcttcttcttctttttttttttttttttcttttttagagacaggatcgtgctatgttgcccaggctggtcttgaactcctggcctcaagcagtcttcctgcctcagcctcccaaagtgttggaattacaggcatgagccaccatgcctggccagaagcattttttaatacatcctaattatatggttgttatttcatactatattaaaagttttagaatagaatatattcaaatagatagacttgtttcatgtgagcattatttaggcaaaatatgttttaggtaactctttaggtaacagtctttaatgaataggccaaattaattttcaattattactataagtgcttgtgtatgtagatattattgctcaagtttttctgtaagtacctgaaaataattgatttacctctgcttttgaacgcactagcatattttgatgtttattcttttgtataatgtattaggatgcctttagctgcctagtgacataaaacataactaaaattagcttaagaatatggttttactctcttacatcacaagaagtgtagaggtaaggcagttacagggttggttaattcagtagcttagtaatattattaaggacccaggatattccagatatttctgttctgccatccttggcatgttggctcttggttgcacaatggctgtagttgttccaggcatcacattcaaatatggggacgtctaacaaaggagagtgtgttgtctctatgaagcttttttttcaattagggagaaaagcttttccagcagctcctgggcagattgattccttcacattttgttgtccaggattgtgccacatgcccatccatccctaaactaatcaccatcaaggagaaccttagattaatccatggctttgccagcaagtaagatggctggcattggcagcgcgcggtggctcacgcctgtaatcccagcactttgggaggccaaggcgggtggatcacttgaggtcaggagttcgagaccagcctggccaacatggtgaaaccctgtctctactaaaaatacaaaaattagccgggtgtggtggtgggcatctgtaatcccagctacttcagaggctgaggcaggagaatctcttgaacccaggaggcggaggttgcagtgagccgagatggtaccactgccctccagtctgggcgacagagcaagagtctgtctcaagaaaattaaaaaaaaaaaaaagactggcattgcatggattgggacatgcaactaaaagtatcaatatagcacaaaagtaaattgttgctcagtattatttgaattgtcaaacgttgcaaattggcaaaagaaaaataaatgagatgttatctgtgaaatatacacttgtgttcaattaaatagtttttaaaaatcttagaaaacagaaatgtaaatagaaaacattacccatttattttgaagttatccttcactgtttgcgttctgtctttcgctagaatatacttacacaaggacattctgcttttctaatttgcttgaaaagctattagtttacttgctttctttttctcattcattcattcaaggattatttattgagtgcctattaaacagtggacactgttctagccactggcattgtttgatttatttcagtaaactaaaacagattttaaagctctgccatcatggagccaaatgtggaaaatgagaaaataaactataaacataattattgggaaaattatattacaagttagaacgttaagtgctatggaaagaagaaatcataccagtggaatggccacatgacagtggctaaaaggtttcaacaatagttataaagttccattgtgcaatcaatttcttaagctaagatttagattttaacagtgtaaatgtttcctaaaattcagggatcactgagttgtcctatttagaagacttcactaggtacagttagatgatttttatacaaacccgaactatttcatcagccatgtatccttatgtgatgtagaagaaataaaaattaattctgtcccactttacagaaaaagtcttgccaagggctttattgtttcagttaaataattgtaacattatcttctggaatatggaggatatacaaatagagaactttacctagaagcccggcatattgtctacttttagacacagatcaaatttaaaaattaaagaggaaacacctgagaagaaatctgtccttttcctaatgccatttcaaaatcaatggctcttgcctttgttaattaagcaagttaaaacctttccttgttcaagagaaaacaaagcaaaacagtatttttgctattaaaaacgccaactaggccaggcgcagtggctcacgcctataatcccagcactttgggaggctgaggtgggcgggtcactttaggccaggagttcgagaccagcctggccaacatggcaaaaccccatctctactaaaaatacaaaaaaaaaaaaaattagcgtggcattgtggcttgcacctgtaatcccagctatttaagaggttgaggcaggagaatcacttgaacctggaaggcgaaggttgctgtgagccgatatcacgccactgcactccagcctgggtgacagagcgtgactctgcctcaaaaaaaaaaaaaaaaaaaaaaaaaaacctaacaaatacagattcagtctcagtcactacttcttcctcaagggaactcggatatcttatttaagaagatagacaataacatcccgaaatgggtttctagacaggaagctctgacaaaaggtgagatgtatagcaaagcatgtagtgaagtaaaagcatatttttagtgccaaaaatatgaaaaattataaggaacttacaaagacatttagttcatcttggattcctttcccctggtccttgttctctgccaactgtcagctagttgatctgataaactaatgcagtactaatgtgtcactcattctgtattacatacatgccctttaaattcaggacaatgccttaattcagcagagcaattctgctgtcaagaacttcttgcaacatggctagctgatagaggaaatattggagggaaagacagcctttcttgtacctctgaaagaacatcatatatgtagctgcacaatcttcctgggtctagaatttttccccccacctcacaccctcctcccaaggacatttcacaatttaacctgtctgttctggtgtcataatatagctttgtcaaattggcatcttcctgggagtgacctccccttcgacatggatcagagaattcaggcaacccaaaaccccgatccagcccaccctgtcttttgagaggctggaaactcaggagtttcattggcagagatgtagtatcaactcagctttgattttccctttctttctgggtgacatttacttttttatatattgtcccttaggcagaaatactacactcaccttgtaggcttagcaggatgtctacagggggttaccccaagcttactgtgtgaaacccaagccatgctcagctcacttactcagccacggagacaaaagacaattagtgccttatggtatagtaggtacaaaagaaatgttttatactccagatttcctccctactctaccttatggtatggtacatatacagcctgatcactagaataatcctttgtcataataaaggcgggatttcttggtttgattttcagtaaaaatgtctcctggtgtttttttttttttttttttggatctccttccttcaatcttaaataaagcatttccaaaggtcttacttttggtcctgcatatttttcttcctgggtagttgatatctattccaatggctcctacactttcctgagttgtgattttattattcagctctagacccaagtttattttctgttggatgcctctaactagatttgccataactacctcaaactcagcatattcaaaagggaactcattacatccttttcaactttctcccatattctctttggctgatggtacaacttgatatcttcttttccctcgctatttacatctgttcagtctccatttcatacccagcttatgcagttaaaactcaagagactctatctgttttttatgatttccccatcagaatcttaccaaagcaccgttgtttgcatgttctatattaagtctcagcaaagaaaaaaaaatcttactttcatcctcactttaacggcccaagtttcagtgtttgtcctctctccttcccatggactactgcagtaatcttttagttctcctgagcttagtcttagcactctctaaactgtatgctgctgccagatactgttttctaaaacgtaggtttcattgggacattcaccttctcagaaaccttcagtggccttccatgggtgacagtaaagcctagactagcatttggaaacccttggtaatctaactctccccagccactaccctttttctctgattggaatacagtcacacgcacagtctcccttctacctggtgaaattgttttcaactttcaaaactccatttagtggctactttccctgttatgcctttcctaataccccctgctgaactccagggaaaattaccccctatttggtatgctcatcatatttttctttttctttctttcttttttttttcattttttttttgtttgttttgttttgttctgtgatggagtcttgctctgctgtccaggctggggtacagtggtacaatctcggctcactgcaatctccacctcctgggttcagttctcctgccccagcctcccaagtagctaggactacaggtgcacaccaccatgcccagctaatttttgtatttttagtagagacagggttaccatgttggccaggctggtctcgaactcctggcctgaagtgtactacccgcctcagcctcccaaagtgctggtgtgagccatcgcacccggtgctcatatcatattgttaatgtggcttttgtaatattcaactaattggtgatgtacagacctgccttctttgtgctgtgaattcctttacagtaaatacgtctcacttatctttgaatttttattacacaacagagtgtgtggcacataaaagtaaccagcaaatatttattgattggtaaccatgtttgtaattggtaatcatgttcctactgttctagaaatctaataataaatggtcttttagattaatatttcaaagccctctagctgtctctctctgcctctctctttctctctgccaccttttcaagatctttcattattttaacgactccttttactcttcgtcaacattgatttagcaaatatttgactcaagtacttaaacttgtctactttcactccatcactctaagttgtgaaatcccaaagtgagctatattttcctggtataattcttgagcagagctaataataggcacaggaagtacctcatgtttactccattttatttctacattctagcatcaaacctctcatttgtcagcctttgtgatttactgttcacttatgattgaccgtgaccatttacatcttcattatttatccatagccagcagacacctgcttatgtcactagatttttttttctctttatgataaaaatcattagagaaggactattcttcaaacataccttcaaacatctttctactttctctaagtcttactagcttcaaagatcctttgaagaaagaattgaaaattccaacttctcttttctggggagttgctatacttttaaaaagtgtaataattctaagtttcacgggataaaattttgtcatttaaaatttcttaagtatattatagtgtcatattttatttttatgagtgcttaagtataagcacaatatgcaaaaagtaacacagatttcattgtactagagtatccatgagtcaaaagggcatacagaagtttacattgaaagaagtcaagtctaacacatgacatttattattgcaaagtgttgtataggaaataaaattcaatgtgtctgtaaatgccctaaatcctcttataagttatttgtccaacatgttaagcctaatggaaaaaaatccctttataccaataaataaggcaacttaagcagaagattcatgatgaagccagaaaaactctataaataatggggtagtacccagggaggagggaggtaaaggaaagggcagtagatcattagcacaataaggaaaggatattcccatcagtaagtaagcagtgatatttggccaaatctaggtcatgatcaaggatataatcacaagtgagatgttttacattgtgcaatgtagctggcatactcatctacagatggaatggcttgcttcccagaatgcaatcactactatataacagtgtccttattatttccagtttggaaaagaggattgtaaagcagaatatctctggttccgacctgtatcccattcaaacatgatccacgctattttgttttcagatatttttacagaccaactctctgctgtatcatacccaagatttagggtgtcaaagaaagatatgaaattgtatattcattgtatttttttgtttgttttataaactaatgactcagaaacatatacctatagagccagaatagcctaggatagaaactaaggaattctctatcggtaaaatatctttttttttttttttttgagatggagtttctctcttgttgcccaggctggagtgcaatggcacaatctcggttcactgcaacctctgcctcccaggttcaagtgattctcctgcctcagcctcccaagtagctgggattacaggtgctcgccaccaggcccagctaattttttttgtatttttagtagagatggggttttgccatgttggccaggttggtctcgaactcctgacctcaggtgatccgagtgcctcgcttcggcctcccaaagtgctgggattacaggcgtgagccactgctcctggccctctatcggtaagttatcttaataactcaggctcctggcaagttttgcctaacccttcagcagctaactaatctttcaaatagttttctagagaaagtagtttcataacttgacttgattccattgctttgccatccttaatgtaaacttctttttaattatcagagtttctctttttaaaatttaaattcaggtcctattattttgacgtgggaaactctggaagatatctaataagacttgttctttaaatacatatccacttcatgtctatggatatagttatatcccttaattcaatcttccctgagcttaattatccatcttttgttcatggtttggcatttcccaaacgttcagcacttcttttattcttcatcggacatcaggtttttacatattctttaaacagtggaggatccagatttgtgaggctgtattttgtataatttgggagcagccatttaagaaaaggaatttttttttaaaagaaatcttttttatttttaaattttagcaaaacacatggccaagtgagcacattgccagtgcccctcccatgcaagttagaagtcctaatgcttttgctcattagcttcatggtgagtctgtctctgccctttgagtcgttcatcccataaattaaccacagctcttttaaaaaggccaaactgtcaaaaagtataagcccaagtaagatattgctatcacatatgcatgctggtctggtatttacactaaattaatcagcattgtcttcattaagtaagaaatagttattgcatgcctcttttgtattaggtgctgtaataggcttatagttaagggtgcttatcttaatagaatatcacacctgaagcaaactaaaccaacagagtctaccctttctttttttttttttttttttttttttggagacaaagtttcgctcttgttgcccaaactggagtgcaatggcacgatcttggctcactgcacaacctccacctcccaggttcaagcgatactcctgccttagcctcccgagcagctgggattacaggcatgcacaaccacgcctggctgatttttgtatttttattagagacaagttttctccatgttggtcaggctggtctcgaactccctacctcaggtgatccgcccgcctcagcctcccacagtgctgggattacaggcgtgagccaccgcgaccagccagaatctacctttcagaggctgttaaactaagccaacaccgaagcaaatgtgcataaaggatatctatgaatatctgaatgcatgttaaatacataatggatatattaacattatatataaaatagggtgagtgcatcttgtagtgatggttagtgaagcagcccttgaagtctccaatttaatctgagggaggagaggtttaaaggtatgcttgctctataacttcacttgctaggtataagtgctatgttttcatacttttccacacctcatcagtgctcctttttttgtttgtgttgctcggtttccattcatttttgatgtttttatatatatatatatttctctacatataaagattaccctgagttttcagacaacatcaataaagggaaaggtgctaccccataattactgaaaggacatcttgctgtcaatatcttggaagataggacaacaaatcatcaaacaatcactttctacttacaaaagcacaaggttctgactggcaatcaagaaggctttgtgaaaaacaaattgagcaaaaccatcttaatctacttctttgaaagaatctgttccccatactgcaaaaaaaatctctctgttcactaggatttttattccctcccatgtgacagtcattctcaatgattgaaaataataagaactagactttagagtacgattttaactgatagtaagacagtgctctaggtgggtctgggacatagagcaaaagtagactaaccctctagtgcttcttttgatgatccctaagagccatgagtgaaagaggcttgtttgtgatgcttattattgattccccagggactagaacggtatgtgacagttcatgctggataatgaatgaatgaatgtttcctgcttctcaatgaaggcataagtcactggatattaatcagcctacttttttcttacctttattgcttccctgccctcttcttcctttccctgtccctctcatcacccaaaggacagataaattttcaatggcagtatgtccagagagatttctaacacttcattaaaaaaggaattttattggctgtgtatgttccctcagaaataggatcaagctcagttaggaattagtaagatataaattaagggcaccaagcaggtagcatgcagacaagaacatacataaattcactggaaaaagattcttgatttttagtggaacagtacagtactaaccatgaattagcagtatatgaggtgtaactgttttttaaagaagacaaatcagaaatgtgtaaagtcaaagaaattttaagcctcttgttatcttaattgaaggataatgatattaccctaaatattttgggaacccttattttggatttccctaagagttatgcagcatgtgctttaggtctttccaggagtactaaatatttgtaatctgagggtgcgcttgatttttggaaatagccggaagttacatcaagccaagttttatcaataagatacatgatcaaactgagtaacaaaatatgtggtcaaaaatattgtgaatataaaataatgagactaatttcatttgattcagaggttaattcggaacgaggagtttcaattacagtgtaatagccctcaccaacacaagtttaggacttccaaaggtggctatttgtaggacaggattcagcagatatatcggaaccaatcttctaactttacagttgcacttgaaaatgttacaaaacaaatgctataatattttagaagatttagagcatgaaaaactggtagatattggatagcacatctcttagagtattgtttccagctttgtcctcttcttttttggggaggcaggtgaggatggagaagtctataatttaaaaataatatctaacaagtagagaacacccagaagaaaacctaaacattattaaatgtaggcaaattagtctctatgagaaagttattgttcagaaaatggtattgattggcttaatttaaagtcccaacagtttttctcaagggtctcttggatcccatccttcccccagtactctacaagctaagaaattcacctgcgttgcatttagggattagtttcaactttgtggaattcaggcaatatggcggttcctggggacaagctacacctccatgaaaaagttttaaggaagatattgaccaagtttctatttcacagaggccaacagacaagacgtgggcttaaaaaactgacagcttttagcgaggcataaggaaatatttcctttttgaggaggttaagtatcagaagaggttcctgagggagatcatggaaccctatccacaggcagaacattagagcaagcattcttctagagcccttcctgttctgtgagtctataattctacttgtcaaggtaatttgatattcttatccaagtctctaaggtgcttttgccaccacctaaattggtctcatcaaaaaccttattgattgtgctgcctctcccatcttctaagatggtgacagtattaaggcagtaaactcagatctcagacctgtcacataccacttgttttgtcatttccctccacctatacctccccaagatgttttttcattaaaatattgttaccagtcactttagaatttcattctgttcctttggttcaaaaaattgtaattaatttcctatagtcacttaaagcacttcgtagattttaatcaacagaggtctacattggcatgttgagctcagttgtttatcccttccagatggagataaatattctcaaatacctactaagaaaaatatgtctgcagaaacctgcagcattagaaaacctattctttgctgcagattgcagattaacttctagctaatcagagttcagcattctaatggactgtgacgggagagacagtttttcccccaacttcagatcacatgtttctgcagttgtaaggcaaattttaaaaggccttggggatcacagccagccttcattatcggtgcatgaccgctttgtaaccaactgtaagtttaatatccaaggagatttgcacataacagtcttttttctttcttcttgtttttaataattcacctttgagattctcttcaccaccatgctggtgtgcaaagatctgtttgtctgtcaaacctacagatatgtagcgcatgtgaaagctacattaattttttatttgtttcctaaggaggctgaacaataagctggttttgctgaatacaagagggctacttcagtgaacacatacttgaattcacttcagctggctccctcacctgcagcacagcagtttctcctatgattctcccctctgccaaaagggagtcacttatacaactaaactcaaggactttttgtataaaccatccacctgaacctgagaaggttttgtctgaaaccaaaagattactagaaaagctgtgtaaagcagggcgtggtggctcaggcctgtaatcccagcactttgggagggcaaggcaggcggatcacctgagatggggagttcgagaccagtctgaccaacatggagaaaccctgtctctactaaaaaaaatacaaaaaaaattagctgggcgtggtgtcgcacgcctgtagtcccagctactcaggaggctgaggcaggagaatcacttgaacccaggaggcagaggttgcagttagctgagattgtgccattgcactccagcctgggcaacaagagcgaaactccgtctcaaaaaaaaaaaagaaagaaaagccgtgtaacactgtttgtggatcctgcaagtatctcattcaaaacaaatgcctcattttcaaaattagaacacttcttttaactttggagactcaatgtaaacactaatctctacacaagtgaatttcctcagcggaatattgagctatgtcagtgtgacaaatgtcatggatatcgggcctctgaaacgctaagcactggcatttttaagaaaataaatgtagatgtcagtgaaccataacctatagatgattagaaagaaacttaccattcgaaagtggatgttttcttcaaggctgctaagattttctacaataaagaaatatgaggtgcgtagggaactatgtgtagagacgttctcggtaatttaatgttttgaaaactcccaggctgaaaactattattatgtaaatcaactagctccagctgctaattcttagaaaatggaaagagtatctaaagtttaactagattttgaccttttatgttatgaagactacaacaaggaagaaagaggaagtttgttagggggttattttttaaggtggtcagggaaggcttcactcataagacagacattcaagcagagacttaagggagatactttttttttttttttttttttgagacggagtttcgctcttgttgcccaggctggagtgcaatggcgcgactcggctcactgcaacctccgcctcccaggttcaagcgattctcctgcctcagcctcccgaacagctgggattacaggcatgcaccaccatgcctggctaattttgtatttttagtagagacggggtttctccatgttggtcaggtttcaaacccctgacctcaggtgatccgcctgcctcggcctcccaaagtgctagaattacaggcgtgagccactgtgcccggcctgagggaggtacttaagagcagaaggaacgcaagtgtaaagatgaggagcgagggagaccagtggggctggaagagaatagctgaggaagagatgaggacagagagaggtaacaggaggtcagatcacataaggctttatatgctattggaagcactatttttttttcaactatgagtaggaatagatggcctcactgccagaaaaaaaagaagggaagagatgaggacagggcttcaggggaaggtgaaaattaaagggtgggacagggaagtatagtctagaatggatatggagggaatgcaatgctgtctgtaggaagaaatgaacatagtacctcaggaatcaaagagggaagaaaatttctattttgtttggtttagcagattacctatggtctgttatacttctgtgtttcataccatatttacacaggttaataagcatgcctttaatccctgtctaactacagtatcaatacatttgttcagtgtctgttactgaggcacctaactacttgagcaagctaatcaaggtttcaattaccccagtgagaaagaagttctacttctctgttgcaatcgtagttgattggttgatgaagtatttataagatctttcataagaggaactttaaaggtcacttgtaccataataagtggaaatcgctgggaaagaaaaagtttagcagtattatagtgctgataaagtcttcagaggtactgactctcagagtctagttactgcagctgaaaattctttgccctgagcatttgtcatgactccttcaatccaatatgccctttaaacacagtgaaactatagaaaaggaatatctaatgttgttgggtgttaattaaggagtaggcttccttcctttccttaatggaaagccttaatttgtcttcagttgcagctgaaaattctaaagactcatttccaccatcttatgtaggttttttctctaatgatcaggttgttcaatttcttgttcagatgctgaaaaactcatcttgactcacactgtatcttcctacttgtaacctgatgtgatcattctcaaatgggagtgaaaaagacctgtacaactatatgagtcctgatttacttttgatattctttaagattttcacccacctttactataataacaaataaggacctcagcccaagctacaaatcaggtagaggtaacatacattgggatctgtgtttcctatcacctcttttctccttggttccaggcaagtgcaacaaaagtgtcaatagtataggccaggtgtgttagctcatgcctgtaatcctagcactttgggaggttgaggcgggtggatcacctgagatcagcagtttgagaccagcctgaccaacatggtgaaaccccgtctctactaaaaatacaaaaattacctgggcgtcgtggtgggcacctgtaatcccagctactcgggaggctgaggcaggagagttgcttgaacctgggaggcggaggttgcagtgagccaagatcgtgccattgcactccagccagggcgacaagagcacaactccatctcaaaaaaaacaaaaacaaacaaacaaaaaaaactgtcagtagtagccaaaacaattcaagcacagaatatgttaactatatgaagtagaggaaaagggaagaagaatttttaaaaagaaaaaactttttggtaaaatgatgaaaagttattgcatatagaattgcctttcctgtttcattgtcatgtttaggacatctttgggacagggaaaggaaactgctgctataaccttacctagttcactggtctggacaacctgtccattgctacctattttgcctcctgttatgactggaatgaaatgagaaccccaccaataagcaaaaagtttccacctttcatcctatctcctacttgcaatccctcagtagtgatattccagcacagctaacagcctcctatcagtaaagatgggaaaagtatcagaaagcttagcaaggcctggggtagggaaccaagtgtgggctaattctcctggtccttccgtaaacattaaggcagactaagtgaatccctcattctaagacaaatgttccctaaagaagtaaaattaaactcctattttccaaagcaattggacttttattgtactgtgtgctttattttctgagtgaggtgacagaactagagatgtttaaaaaaaaaaaaaacagtaattcccctccaaatttactacctttccccaggaaccttcatcactcagtttttgctacagtcctgtaaggcatgttgaaacttgagtaaaatgatgcatgaatttgttagtcaaaatagcaaattattctatgacctttattatttcttagatttgtcaaatatgatatcctaacaccaagaattttcccccaaaacctcctgtttattttacctctatcttttttctcttggcacagaaagacgagtcctattatctgttcaaagttggtggcttagagagtgtgtgggtgttttgtttcttcaaatttttacctgatgttgcaagattttcatatcaaaaagaattcttctttctccccagtgtgcacgcacatatgtggacatggtcctggattggaggaaatggagtacagaccctgaaatgcatgggacctttgtattgcccaaatgtggaataatataataataaccaccaccatttattgaacatgttttatgtgccaggcactgttattaatagctttatatgtgattcctcattaaatcgcaaaccaacactgtgaagtacaggtacaatcatgtgttgcttaatgacagggatacagtctgaaaaatgcattgttaggtgatttcattgttgtatgaacatgacagagtgtacttatacaaacctagatgctatggcctactatacatttagactatacggtatacgtaagcctgttgttcgtcgactacaaacctgtacggcatgttactgtacagaatacagtatgtaacacattggtaagtatttgtgtatctaaacatctaaacagaagaggaacaataaaaatactatattaaaaataaaaatggtacacctgtattagggcacttagcatgaatgcaccttagaagattggaagttgctgtcctcagacacaagcacacacattagcctaggactacacagggtcaggatcatcagtatcactgtcttccatctccatgtgttaccccactggaaatcttcaggggcaataacacacatggagttgtcatcttgtgtgataacaatgccttcttctggaggacttgaaggacctgcccgaggccattttacagttaacttgttataagtaggtgtacactctaaatggtagaaagtatggtatagcaaatacgtaaaccagtaacatagtcacttattatcagtatcaagtactgtgtattgtacatcattgtatgcactatacttttataggactggtaatgcagtaggtttgtttataccagcatcaccataataagtacatgagtaatgtgttgtgctctgacattatggtggccgtttcctcactaggtaaaaggaatttatcagttctgttataatcttatgggactgccttcatatatgtggtcccatctgttgtactacatgtcattatgagatgcatgactatatttcacagattcagaaaagagggttagctcagttaagtaaatggcccaagggcataaagcactatggtctctagaggagcttggatttaaactagatctcccagcccttcaaggccatcctgtgttcattatgatatgctgttttacttagaaagtttggattatggatcccgacttaaaatgatccatataaagaggacaatttcctattatttttactctggccataaaattacaggtaagacatttaaaaaaaatcttatcaagatgcataaaattagaattatacttatctaggaaatatggaaatggatggtattctggtcaggggttatttaataaaaattttaagtgttttatttttaaaagaggcgactgaaagaaacaatttaaaaattcttcagtgtctagcaaaaaaaaacccagaaaacttaaaaaaaaaaatctaaaagcacagtctgaattaaagcaaagaaagaatcagttgctcagagagttcaagattaaaaatgtgaaaaatatttaaaaattagctgggcttggctgggcacagcagcacacacctacaatcccagcactttaggaggccaaggcgggcggatcacttgaggtcaggagtttgagaccagcctggccaacatggtgagaccccgtctctacaaaaaatacaaaaattatttgggcatggtgtcacatgcctgtaatcccagctactcgagaggctgaggtgggagaatcgcttgaacccaggaggcggagcttgcagtgagctgagatcgcgccactgcactccagcctgggcgacagagtgagactccgtctcaaaaaaaaaaaaaaattagctgggcttggtggtgcaagcctgtaatctcagcactttgggaggccgaggcaggaggatcacttgacttcaagaccagcctgggcaacatagctgggctccatctgtagaaaggaaggaaagaaaggaaaggaaagaaaaaagaaagaaaagaaagaaactttgccaggcatggcagctcacacctgtagtcccagctacttgaaaggttgaagcaggaggatctcttgagcctaggaatttgaggttgcagtaagctgaaattgtaccactgcaccgcagtctgggtgacagagggagaccctgactctaaaaaaaattgtggaatttcccctattttgttgagttttcattaaaactactatctcagtgactcatatttagtgtataaaaagatttgcaatataatacacaccacgtttctttatattgttgccaaatcatttctctcagtatcattttcaaatccttccaacacccctgatcaacgaagaaatactcctcagtgtgatcacagtattcctctggcaccagagttaccaatttgttcaccatgacatttctaatttacgtaattttatggttatgtgactctactatcatacaacttctgatactgtaatgaactgaaagtcttgccaactatattcacgcgggtaaccagaatgatccaaaactcaaaagagaaaatgaatacattcctagtatttttttttcttttcatgagtgccaagttacagtgatatatatggaatcgtagaattaccttagatgccaatattatggtacagttgaaaatcatattcagtatagttatgagggtagatagtatcaggttggtatatttccagtcatagattatgtcctcataacttccccaaaaagggaggaagggggtttgcaaaataagtcattgaaaacagatgtggtcatttgtctgtcaatgactgaattcttgctgttcaaacttttaaatgattctgttatacataataatcacagctactatataataagcatttcctctgtaccaggctttgtcttaagtgttttatataagcattatttcacttaatctgttcaacagtcctgtgatttaagtagtatcttgattctgcagatgtggaaactaaagctcaaagagatgaactaacttgttcaaggtcacacagtttttaggataagtgatggagctttgatttgaaaccagatttttctgattccaggatccttactaccaatggttttatttctctgtccctgaaatatgccttcagctttcagtgatctcatggtgcttgtaaagtacttgagcagtcagtcatctctggaataggaagccattagaagccatgaaagtaaggaattgtttgctgtaatggtggtggtggtggtagtggtggtttatgttttcaaatatcaaggcaaggttggaagatgcttgcttcgtgtagacctgacctgaatgaggctggcatctgggctccttggaattttctgaatcagtttcatccatttcttaaagcttaattgaaataaatgagaggtcttagcatttacgtgaatttctttctttttttttttagcatatgacatttttagtctgtaggtcttatttagtgattatgcatagcaagggaaataagatttgtaatttattcactttttttttcagtaaggcaatagaggtttcagtgagagattttaaaaattaggttggtgaatatttcgtagtaaatcctagatacatttttcattatattttactcattttgtaccttttaccaacccttaacagatatgccagtaaaactgagacttttttctgtaaacatatttcttatcttgtatgaggttagtaccaaaacactttttcaattagcatccttttaacagaacactgtcctgtacaatgacagaatctaatcagttggcatttccaaccctgagaaataatgattaatgcttacttgagaatgatctttaagtactcatgagttagtgttttaaaatgtttagtgaggcttgacaagtacaaagtaatgttaatcagtcaattatttaggggattttcttaacctgaccttaaatttgctcctactgcttttgttcttttgattatttgatttttattttgtaagaattaggatgatgagaatacatcccatccctcaaaataatttttttcttcaccagcttttacatttttagaagggttaaacaatgtcttaaaaactaaagattattgatatgaaactgtctttaagatttccctttctctaagcatgcattttctatccctaatttcctaaagccagagccaagtaaaaacaccaagaggaatatgttattcttttcagcatgaggccttttcatgaaaacagcactagtgaccagaatcttattctagtctgtgttgcttgaaaaatatatgcctttgtagatgttttcatttactgtcaataatgccaaaccacagaaatggtttttttaattctgttttggcctcttaaagattacacattgccattacaaattgtgattgttttgtagttaaatctattcctgaaacatttcagatataaactgatagacctattacttgttctgttttatcctttagtagatctacattcatgttgttttagtggtgccttttgcaagcttccctctcatataaaaatttaatctctagccttattttcttctatcgcaaattgtatcactttgatttttatatgaactttttttttagttttagcatattttccagaaataataaatacatggagaatgctacagaaatagcatgattcaagttcatgtacaatataatgcctatcaataatctgtatcaacatttctattttcaaaatgtggttttgatttgggcgtttctttttgtaatcatttctactgtctttattagatgatcttagtcgatcaaaggatgcttataaaaaatcaacacagtcttgggaatcggactgccaggtttatgaaatgaaaatataggattcccagttgaagctgaatttcagataatgaataattttttagtatcaatatatcctaaatattacatgattttttttctatttaagtatgttccaaatattatatgagacatacttctactaacaaaagtattcacagtttatctgaaatgtaaatttaactgagaagcctgtattttatctggcaactctatttggaaggcatcatagtagtgaaaatgaacatagaggctaatgccaaacagtcctaggtggttgtgttacttaagaagctgtgtagctttgggtatgtcacttagcctacctgaacctaaatttcatgtataaaatggaacaaataatacctactttgcaggttttctataaagattataaagtatgtatttaagactagataatgtttaaaactcctggtacataatagatttcccttaaagagtagctgttattatcagaacaaagaagaaatacaaatgcaagtaaccagccgttttttttccctccatcttaataaactatgtgaggaatcctaatgggagcactcagcatgtaaacaacccattagattgataatataatagtccacccagatcttggtgactgtttaccaaattagagatttgaccactaataaaatatatacaagcattagccttctttctttcctctgctacttgcctcttttcatgttacttaccaaacattatatagcttattagtatcagggcctgaatatgtgatgccttttcacattgttttttcccttttgagttacaattttacttccatcctgtctttcttagacatctatttattaatgtgattaatttttattgagataatttacataccataaattataccatggtagtttatataattcagtggtttggccgggtgcggtggctcacgcctgtaatcccagcacactgggaggccaagccgggcttatcacttgaggtcaggagttcgagaccagcctaaccaacatggtgaaaccccagttgtcaccactggagtgggatcatactggcatctggcaggtagaggccagggatgctgctaaacatcccacaacgcataggacagctcctaccaaagaataatctagcccaaagtgacagtcgtgctgaggttgagaaaccctgctttaaaattatgattctagtatgccagtttatttttaagtggtagtctttgagttcatctacaatagccaggtacctttgtgctcctagcctattgctatggagtctaagagcacaaaaacaatgacaggagaaaggggaggtaccagtgaaggtaaaatcatttagattttgtaggaagaaatcaattcttgcaagtcaggagaattttgaaagtgtttttaaggctattttaaactgctgtgtcttttaacataaagaaaaaaattatttcaatataaacccctccaggcaaagccttgtagacgtattctcgttattgagtctttttctttagggtttctggaacaaaatagtttttgtcaaacagcttgtacatgctatgaagtatatttaatcaatcataatagaaaaaagaaacagagcagcttgatggagggaacttgtagttgatatgtctctgcattcgtgatttacctgaactcaaaggaagttgatattccagctgatcacattaattcagctttgtctaataccaactactggaatgtactcattcacttatgttccacaaataatctatccaaaataaaacagacaatagcttgaaatatgtttcagcatttctaaatattttcacaagtaaaaagctgtcatatttgaaggtatttcttttctgtgataatactgttgattgtttcctgccctgcatgattagatgtaatcattatcaccagcaccaggaccaccatcatcgccatcatagactaaaattccttgattataatatatcaggatctattctaagcactttatgtttgtatcatttttcctcacaaaactcctataaggtagtttttttcttaatctcaattttgcagataacagaaaagtacacaataaaggggataaaatacttgctgagtcatatttccttactatgtcttctcatgtgtcaaactagttcatattttaacaatacataaagtatacttattgttaaatctgtaacattgatgtccttaattttctggcaccctagataatggcaattgaagactgagttatttctaaatcttttttcaagaagagatattttacaattaattgtctctctcaaaagtatatatatgcacattcaggctgctgtaataccttcccatctctgcatatttatataaatttaaaactgtgcaatttctccattatataagtaatggaaaggtttttgtttaactttgtttatatgtataggaagcagtgagagaaaattcaaaactgtgcaatgtctctattatataagtaatggaaaggtttccatttaactttgtttatatgtataggaagcagtgagagaaaacaataagagaagagaaatggaagagaagaccaggagggcaaaacttgcaaaagagaaagctgaacaagaaaagttagaacgccagaagaaaaagaaacaactcattgatataaacaaaggtatgaaaatatttccaatttttacaaaaatgcaagaagtacaaaataattgcagttatttatttttggattataaagtaaattttcatagaaaattcacaatagtattagttacttgtgctaaatttctctcatgatgctatgtgtggtttcctatctccctacgctgagcattcaggatttttgataaccaatgcaagatgatattttgttgagatagtgtttttctccctacttttcttgccatagtatattatattctggatgaggcagtggggagggaaaaagtgggtgagatgaaatgtgaaaaacgggtatggggagataagccttagcttttaacttcattttgttggcacatgtctgttggcagtgcagtaacagttaacagtcttccttggaagcttgaacattttaagtcctaagaaatattgacagcactattacaagttgaataaaatagggaaaggcatcttgcacagctataaacctaagtacaagatgctggcatgtccatatagtttaaagtaagttgtttgaggccgggcacagtggcttatgcctgtaatcccagtactttgggagaccgaggcgggagggtcgcttgaggtgaggagttcaagaccagcctgcgcaacatggtgaaacccatctctacaaaaaatacaaaaattagccaggcatggtggcaggcgcctgtaatcccagctgcccaggaggctgaggtgagagaattgcttgaaactggggggcggaggctacagtgatccaagatcatgccactgcactccagcctaggcaacagagcgagactgtatctcaaaaaataaataaataaataaataaataaataaataaagttgttttattggttagcaagagtgactgtatattgttggtgagttgtttggtttggttggtttactttctaaagaagagagggcaaaaaaagaaagtgattggtatcaggtatctgcacactgaaaatttaggaataaaaaaagcatgcatagtctttgtcacctgaggtttagagaatttaggaacaaaacaaaacaaaatctgaataagatacaaggtaatatgattaatatggaccatgtattactgaagataacaatagtaaaaattgcaagcactctataatattgaccacatgccaagcatggttgtaagacttttacgtatttatttatttatttttttgagtcagagtctagctctgtcgcccaagctggagtgcagtggcttgatctcggctcactgcaacctctgcctcctgggttcaagcaattctcctgcctcagcctcccgagtagctgggattacaggtgcctgctaccatgcccagctaatttttgtatttttagtagagacagggtttcactgtgttgaccaggctggtctcgaactcctgacctcgtgatccacccacctcggcctcccaaagtgctgggattacaagcgtgagccactgcacccggcacttttacatattttaagtcaatcctcacaccatctctatgaggtaggtactattatcatctcattttacagatagaaaactgaggctcatagaaattaaggaacttggccaaggtcacacaaacaggaagtactagcaccaagattagaatccaagtcgtctcactatagaatctttccatttacctatgccactgtcaggagaaaatgataacaacaacaactaacatatagcacttgctatttaccaagaactattctaggaattttacatttaggaaccaatttaatcctcatagaaccctattaggaaagtactactatctcattttaaaatgacaaaactgaggcacagagaagttaagtaacttgcccaaggtcacaatgatagtgagaggtagaaccaagatttgaacccaggcagtgtgtaaccagagttaattattattatgtgtttttaagtgtaattattaattataacaatcattatcaagtattttgcagtaatgtcttaatggctaatcttctaaagtaatatccgtactgttaagtttagtctttgtacttttaaaatatataaacattttcaggaattgactatagtttatatcttccacccaggaaacaaatataacattttaacagaagaaaaaaagtaatattatgtaaaaagctgtgttaaaatagaatagtatcaacataatttagcaaacgaacttcataattagaatcaggaaaactggtcatgactgaggtcactctatcaggaggtaagcactagagtacagcatggcaatatgtgtttataggaagttatcattgaaaaggtgaagaagtcagtagaaaagttctgaaagtggctgggcatggtggctcacgcctgtaatcccagcactttgggaggctaaggtgggtggatcacgaggtcaagagttcgagaccaacctggctaatatggtgaaacaccgtctctactaaaaatacaaaaattagccaggcgtggtggtgcgcacctgtagtcccagctactcgggaggctgaggcagaagaatcgcttgaacccaggaggtggaagttgcagtgagccgagatctcaccactgcactccagcctgggtgacagagtgagactctgtctcaaaataaaaaaaaaaagaaaagttctgaaagttagctcctttatgtgcagggaggagtagtcggagaagaggccagaagagatagtaggggacaggggacagattgtgagctctctttctttcttttttttttttttttaattatactttaagttctggagtacacttgtagaatgtgcagttttgttacataggtatacacgtgccatggtagtttgctgcacccatcaacccatcatctatttctcctaatggtatctttctttcttttctgctatgccaagggtcttaatgctgaaagctatgggaagcccatgaatgtttataaactggaaaatgatgtacatagtcaggattcttagatcattttgtttttgttttgttttgtttttttgtttttgttttgtttttgtttgagacagggtctcactctgtcacccatgatggagtgcagtgccatgatctcagctcactgtaacctcccagccagaaaggtcattttgacagaagcagaaagaatgtattagaaggggaaagccctaagaaaatagaggttatgaggatattgtcatagtcctgacaagagatgatggtggcctgaactaatacagtgacagtgagatttaaaaagcaacaagaggtgtattagtcagagttcttttgagaaacagaactagtaagatgtgtgtgtacacaaacacatatacacacacagatttattttatggaattggctcaagtgattatagaagctggcaagtttaaaatctgcaaggcaggaggacaggctagagacccagaggaaagccaatgttacagttcaagtctgaaaactatctgctgcagaattctctcttgcttgggggatgtcggtgtttttgttctagtcaggccctcaactgattggatgaggcccactcacatcatgaggtacaaaccgctttacccaaagttcactgatttaaatgttgatctcatccaaaaacaccctcacagaaactaccaaaataatgtttgaccaaatatctggacattgtggcccagccaagttgacatataaaattaacgatcatgagagggtgttaaaggacagaattgacaggtgctgatgattgattggatgtgtaaatcaaaggaggcaagtgttaaagaagatggtatgcttcacagagaaagcaaactcaggaatagagcacattttctcaggagagttacaatgactaatatcattttaaacatgtttagttccaccttgtaaagatggaaaatgtctaagaagccattgtatatgtgattgtgaaactcaggaaagaagtctaaactaaccatatcggcttggggatcattggtttttatttgaacattaaagttacagtgtactagtttgccagggctgccataagaaaatgccacaagctaagtagcttagaacaacagatacatgttgtctgacagttctggaggctagaagtccaagatcaaggtgtcagcagggtcatgctccttttgaagagtctacggtaggatctgtgtcagacctctctcctagattctagtagttttctgctttgtcacagcataacttcaaccttcaaatggcattctccctgtgtgcatatctgtcttttcacatggtgtttattttataaaaataccagtgatattgaattaaaggcccaccctactttattttatttctttagagatggagtctcactctgtcacccaggctggaatacagagatgtgatcatagctcactgcagcctcaaactcctaggcagaagcaatcctcctccctcagcctcccatgtagctgggaatataggtgtatgctaacatgcccagctgctcttagttactgtttttttttcctaaaataaatattttagaacaatcacctcttaattacatagttcaacttatagcatgtgtgtttgaatgggatcaccacggtaaagtataaatcagaggttctgaaactatttgatctcagaacccatttacactaaaaatcattgaggaccccaaatgccttttgtttatctaagttgtttatattgacatttatcatcttagagttgaaactgagataattttaaaattatcgattgattcaattaaaataacaatagtaaaccttttcatgttaaaataaataaccttttaaatgaaaactacctatattttccaaaacaaaaaaagaattagaagagaaaaagaataatgtcataaatctcttcacagtctgacttaataagacagcttgattctcatacctacttttctattcaatctgattcaatatcattcttcatgtaacttctggaaaacttcacgatacactcaggaaagaatgagaaatagaaaggcaaaaaagtgtcagtattattatgaaaatagttttcaccttgcaaatccctgaaatgatctttcggggcctccaggagtcccccgccacactccagcattgctggagtgaacaatgaaaagagtaagtggttaaaaatggagcctatcggccgagtgcagaggctcacacctgtaatcccagcactttgggtggcctaggcgggtggatcatgaggtcaggagttcaagaccagcctggccaagatggtgaaaccccgtctctactaaaaatacaaaaattagctgggcatggtggcaggtgcctgtaatcccagctactcgggaggctgaggcagagaattgcttgaacccggggggcagaagttgcagtgagccgagatcacgccactgcactccagcctgggctacagagcgagactctgtctcaaaaaaaaaaaaaaaaaaaaaggagcctatccagttttgttctgagaatgtaatctttctcccacactacagcaattcctacgctcctccaagtgtttattaacctttcactgttctcctaaaaatgtgtctataacagacaaagaaagaagggcttattttgattgtgtctagttgttataggaccaacaagtttgtatgcctgctgcacagtaacagaccaataccctgagacaactgggatgcagcagagaaagacattaatgattgcagggcaccaagcaaagagatgggaggagaccctcaaatccatcccctcaaggagttcctgggctgggatgtttaagtggatctcggagagtagggggctggaaaattggagtcattgattgaccagggcaagggggatgaaatcatcaggatgtggaaactgcattctttggtgagtcagcttcttgtgggatccttcagaccagctgacatcagtagtttcattggtacacagcactgaaagaatagctccaatggaaaacttaatgttttataatgttcaagttgttatctacacagcagttaaggggaactataatcttgtaacagggtctgtgtgattttgaagcaataagtaccgaacaactatgaggaagcaggtcaagccggtcagagagcaagctgacttaatgattaacactgaatcactgaatgtaccacaagcttggtttatctttttccctgctttctgtctttttttttttttttttttttttttttttgagacagggtctcactctgttgccaagactggagtgcagtggcgcagtcttgtctcgctacagtctctgcctcccgggctcaaacgatcctcccacgtcagcctccccagtaactgggaatataggcacacaccaccatgcccagctaatttttgtattttttgtaggtgtgtggtttcgccatgttgcccaggctggtcttgaactcctgagattaagcgatctgccttggcctcccaaagtactgggattataggcgtgagctactgtgcctggcctattttcttttcttttcttttcttttcttttttttgagatggagtcttgctctgttatcaaggctggagtgcagtgatgcaatctcagctcactacaacctctgcctcctgggttcaagtgattctcctgcctcagcctcccaagtagctgggattacaggcatgagccaccacgcccggccttggcctattttcatttctttctctcctttcttccctgattaatttttaaatttttatagggatggtttcatagtctgtatgtattttcatttgctaatatttagttaattaccttttcaaatgtcattgagaccgtaagataaatatccaaataagtttttatgcatatgctcagctgagtgatttgagcatgaaaaataaatttttaaaaattggatttattttttatgttttagtaccatagctctatttacgtatcagtcaaatagtaaactactgttaccttcttgactcatggcccatgtgttacaaatattattattatttattgtaatgttactttatacttggactatatgtgcctttgtacttataaatatgtttcaaaaacagatccttccattgcaagtgtgtagttttaattatgaaaatgaaaagatgcaggaaagaaagagtaagaataatagagttgggtgtctgtcaagatggagctcactgtctgagtttctcagagagtgtcttatgaaagatgctcttatcaactagatggaaggcagttgtgagccttctgagagctgggaggaatcatgatggagacatatcatatgtgaatccatggggcgtgaaagcctatggaagatgtgagtgaagtgtcatcagaaagtgatttatataactttaaatatgtccaattagaacattgtaatcttctcttccaccgaaagagagatgatatagaacatttcattgccattgcgaggtatgtaatatatagtacatagaggtatttcatgcatgggaccaaagatacataccattggaaccataggatcttacctgtaacaaaagtagagagttccctggataaagtaagtcacattggaaattacaaataactttttaaaaaagtgtacactttccgtaaagcttctatttcctatcaatgtagcaaaggacaaacacttctcccccaaccttttttttttaacacatctattgcttagtagatgtaacttagcaaaagtaaggtatctttatgtggcatgcaaaattatatacattcatcaaggagaaatatttgaggatttaattattcagaaaaataatagtataaagcaaacacaaagattatttctgtaatctacatttgatcaactgagctcagaattaagtaatgatatcatgaaaaccaagcagccagagaattatatctttcaagttaaatccataaaaaaataccatgtaccaaggctatattttgagagatttggagatcagaaggcaaatgccatgataagaaacagtttttttaattgtaaaggagaaaatagatatgattaaatattaaagagacaggcattttataaacattaagtggtattactaaaaatttaaattctgtgtgttcagaagtgaagatcagtcttagctctgctacctagctttatgacctagttctgttgccttatctcttcatgcctcagttacctcatgtgtaatataggataatgacattcacctcttatagttttagtgaagattaagtgagataattaagtacagtacaaaacacaggacctagaatatacttgctgctgctgacacgatgaaagagtcatttttatgctttttgaagaatctagtaaaaactcaagaaatagtctccacccttaagaagttttcatttttgtcagagaaataaaataaaggtgacctagcaaacattaaactgtgtgctgatacataatagagattatttgctctttaactctatctaaaaagggaaatcagtgaggtctggtaaaattacataaagtttcatggagaaggctaaatacagcctctgaacataccagtcaagctagaccctgaaggatgggtaacatttggctgagcagaggtgaaactatccaagtaaaagggaataacatcagcagtagtgcacgtcagcacataaggcagcatgctttatgtaggatatgtgtatagcccacaggaaaatacatcaaaacgattaagagaatgggtcctaagttcaagtcccagcaccacagtttgctagccatataatctctgacaaggtgtttcatctttctgtgcctcaattttttcttctgtaaaaccagagactggtgttatttatactgtagtctgtttattgattatacgttaatggcatttggcctattaccagtccctgatagttaaatgttcagtcagtattttctgttggtgtcgttttagtgaagggtttgatttggaaaattgttggaaaggtaggatggagccgggctgtgaaagagccttccaagtcaggcaggggagttgtggcatgatgaggtaggagagctaaggtcattatgggaattcatttagggattttcaagaagtaagccagaagcacaagaaaggagaggagactacaaggaggatgtagctggaaaagaacagtgaaaggtgatgaaaagggagtgagctcatacctgattctctcttcaaaggagtttaaacctgcagcagtttgagaagatggtaacaggaaggaaaaaatttcataaaggagattttaaaagcagttggaagttgcaagcaacagattgactgatgagcaagagacatctttttaaaagaacagcacagttttaccagtagataattatatattgatatattttggcacattaggctatttgatccatccaatcaacgtttattgcaccattttccaaataattataattagagcatgcacagtaatataccacttatttaaatgtaaaattgagaaagctaatttaaatgcaacaaaaatatgctaagtcaacaaatgtactctaaaatgcgtgcaacagtatgcaaactatgtaaagtacttggtctaatctatgttctccaatgtttggctatattgatatagaggataattatgttagggaccactaaaaaaaagattaattagttctgtaggtagaagagaaaaagcttaccaaatatttgtaaataaatctctttcttttcatgtttatggaagtcagcaaattaactgcaaaatcttagaggaagcaataggaaaaagtatgttaaaatgggtattttgaaattgcaaactataagcatgattcttatgcaaatattaatttaatcaggaagagttttactcctccttgtataagattatatggaaatcagaattgcctgtttacttctagtgtcatgataaagaatgaggtaccttagatttgatgaaaaatcagtcttcagagagttgatgagcagttttgccaaataaacctaaacatttaaactctggttgatagcaattttgtttttatctgttttcctagttgtaaaataattacatcttataagtgaataaactcatttcacattatattattttgatctgaataggtcaatttatgtttcttactgtcataccccagacattaaattatagtcaccaaaattatagattagaaaactcacaaataatggaattgattcaagtagcagtaaatcacctccaataatataaattaatgaggcaatatcggtactatcgttccggcatatttttacaactgctaataaacagctcatagatgctaatacaaagtaaaacaagtttgtatgcttggtggacctagaaaacagtctttggcctagcaaagccttacctatgaagagaaaaagtgtatctggctgatactatgtttactttaagttacctagtttcctaccttagcaaagatttcaagaaatctatgtttatataaagatcagaatttttttctctttgttctctagatttgatttttcagtgaaaatttgggttttgtttccccagataaaattattcagtacagtaaagacttacccaggtctttggagcttctcacacattaagatgtttagtatgaattcgtgactttgttattttaatgaaatatctttaggtccatgttaaggcaatatcgtgtcatgctgctgccattcagtcaacatttgttgaatttctaagttcaagcattgggataaaagatattgagatgcaaagaggaggagctcccattgtagcaatcatcaaatgataaaccacaccctgctggttgaatctgctgatccccagtgacatgtaatctgtcagatctctccatcattggtttagcctgtgattgaaatgagtttacccctcttgcctttggagccagacaaaaccagttcacatcatggccctgctccctacatggtgtatccttgaacaactcatctaacctctctgatcctcgaggacagagaaaacaacagcatcaacctcgtaggattttcataagaagtaaatgagaggatacatgtaaatctcttagtacttgcctggcacatggttagcatgtaataagtgttaaatgttatccctttgataataataattatttagtgaacatatcaaggaaaattatcaatggcaataatcattacaataagatcttgattgactagcctaaaagaagtggagttttgattaatctgactttataattatatagaaagctgtttatgcatcagtctttatcatctgaaatctttctcaactctttgtacaactctcctcgcactctcccaaccacctccgcccacaaaaaaattttggctttacatgttacacaggtgaaaatgtgcagcagcatgtggcacatagatataattttggacatgtagccagcacacaatatacatttactggtagatcattaggatttcgttattgtctctgggccattattcagagcatcagtgatcagtatacactagcattggagcatgtgctttatctgtactatttccagaatacactctagattaattgaagattctagttattttttcctgtagcctatttgagccacttatcactagtaattttttttttctgaccccatactaaaataattacatttctggcttcagttctcgggaaataagtgctaaactctcattctatctgccttagcagtaaaacaaatttctacatctactaaaaatattcttttaaatgagagacaaaaataaatatgtgaaacaagataggtaatatactttagatctcattaagagttcttacattctaaatgcagaaactcagatttgcaaaaactgtaagagctgtcttcagtgtgctgaacatttaacaagatttcatcaatttgtatgtagaagatgagtaacactggcagttacaaatttggcttttctctacaatatatgcttgttgctatatatgatttatgcaactttactaggcagaaatctatgaaaatattagagcaggtaagtgaaaacaataaaactgactatataagaaattaccaaaacacattgtaggtggcctaatcatttattaaaaacatgctttgttccatattttaatattctaattcttattacagaaaagtgtcaaatgaataacagctgttatacagcaacattgcaattaattttgctctgttctcagtcaaatgcacttagattcatgtcagtaattacacctaacagattcacagaaccaacaaactgcactgaacccaactgagtctctaatgacttttttttaaattatatttggtccacccacattgaattcccgagcccctgggctgctttagaatcaggacaaaatctactgttacacttggccgggcgcagtggctcacacctgtaatcccggcactttgggaggctgaggcgggcagatcatctgaggtcaggagttcgagaccagcctggccaacatggtgaaaccccgtctctactaaaactacaaaaattagctgggtatggtggcggatgcctgtaatcccagctactcgagaggctgaggcaggagaattgcttgaacccgggtactccagtctgggcgacagagtgagactctgtctaaaaaaaataaataaataaattccgttgttacactgaatgtgcaaaaggattatggacaaaaacctttcagtgattgttaatttaattccacaagtatttattcagtgcctacagtgtgctgatctgtggtgacatatcctaatcaaagtatgattgactgataacttagcactattaacctatttcaggggttattaactatcagcctttctccctctcttatgtgtgtctgttctgtaagaaataatggttgttgcttcatgtagtcccataggtgtatgtatatactcacacaggaccgtatgtagcatataatatttttcacatatcatatataatctcttaaaatcatctatatttctttttttataaatagtcaatcctcagtcctctgttacacccctcacacatgaacaacctataaagtatatagtatcttaacttgttagtgggataaaatggaaaagaagacatcgtttaagaaagcaattatacctttgtcacaatggtattaggaagacattaaaacctaaacttagaatacctgcttgtcatatatatcaacagtaggtttcatatgctatttcgtaacagcttagaagatgatggtatgattcatttgaaaatcaaaaaataattatccttttaaatgtgcaattaactatggatggcataatacttttatttgtttgaaccagcactggaatctactttaaatgtactttaaaaaaaaattctttttgtcagactagatatttcagagctcctgtatttgatttagccttttctatttgctgagccctggagaaagttgcgtaggaattatttggggcatcattaaataggatggatgcatataggtctaggaagactcaggcatagccctgctgaggattggacagggtccaggaggttccttttacatccgtgtggttctgtggtataagataaccacattctcagagtatgctggtttaggctgtgttgtaatctgtaaatcatagtgtcttgttttgtttgtctctttagtcccatatttttataatgtaatccctaccccaattttttagctaataattttacgcagttgagtgtttgaagttgaagaagttttccaaatttcctgttgatctcaccaatatctacacattcttggttgagtcactaccttgtctgattttctagaacagtatttctgtgaaaggaaaatgtgttccctctagtcctcttttgtcaaaaaccctttgcacttgctttcttttgccaattgaaccttttttgaaatgcatcagtagggagagcttgcctagcctttgctagacaggagtagctgtaggtgcatttaaacaatccaacttgaaaaggggatttctctctttctatttgaaaacaattgaaaatgaaaagtgtatgtctcaggacagagtgcttaaccgacctcattctactgaacttcagcatggtatatgaaactacctcccctgtgtcttccccagtgttttaaaaagatgcttaacttgtttgaggcaactggttctgagtcagagctctctatccagcatcaccagaatccattatgttgttaggtcttgttataccgttctttgcatctcttttttcttcactcaaatagtcaatacagctttgttctaagggctatctgatcatgttttgaggggaaatcgagattgagctatagagatgaactatggttacattaacctttaaatgtaaccacattccttcccccacagtacattcacatgcagcctgtacttttaagtaatcctgtaagctcctgtggctaaagcatgttgaaagtatctattttcaactgagtaaccctgacagtagatgaaacctccaaaagatacctccctcctcaagggtggaagtgggggtaggggcaatggttggcagtgcagttttcagcctattctccctcatcctctctctttttttaagaccctagaggagcaaggtaaacatctttataaggaaatgtatgagttagctcttttaaaaccacagataagtataatcttaggaaaagagatcatgtgccctagactttagtagttaacatttcttctgaaggatgtgattttttttttttttttttgtgatggagtcttgctctgtctcccaggctggagtgcaatggtgcgacctcagctcactgcaacctccgcctcccgggttcaagcaattccaattctctgcctcagcctcctgagtagctgggattacaggcacccaccaccacgcctggctaatttttgtatttttagtagagacggggtttcaccatcttggccaggctggtcttgaactgctgaccacatgatccacctgcctcggcctcccaaagtctggtattataggcgtgagccattgcacccggccggatgtgattttttttaaagacaaagtaactaaagactaattgatgctgacataccaaagtaaaaccagaagtctgtattgaggagccatctcaaaaatttactttaagacagtatgtcttaaagaaaaaaatgtattatttaaatggaaagtaggaccatatgccaggttttgtttgttttgtttgttgtcatatttttgttgttgtttgagatgggacataagagactagttgcttgtctcacagatatggtagggaaaggaaaccttttggtggaagttagccatctcttcaatctctgatattcaaggagtacccagttttggttcaccaaatgtaagtcctttgttataagcatcctcttttatgttggtttgtttggcctgtagacagtttctgaaactaatttcttatttgcatgtaatgctttcatataatattcatctgtaaaaccatttggatttttcgagttgatacatttttatcattctgctgcacctctctcccctccttctttgggcttgttgcactgtcatgctcctcctgatgcattgcttcctggtgggtgacatcatgatttgtgagcaacccgatatataaataaggtggtgagaactgcctcagcaattcagtttctatttgaaaggcattaagcagcctctttctgttttcttacatttttctctactttgtgttttcacagttttattaggcactgtagaaggacctgtttttctctttcattacatttctgaaaatcattaggttgattcaaaatcttttggaaatgtaatgcccccttatgctataatatacctctcatactgtatacattttggtcacacccagatgtggagtttagcaataactaacaactactaatttttaggagcatcctaggaatacagatgctttcagcagtatgtttttattttcactgatattaaaggagtatttatcttagaagagtggtaggaaagcacacatgaatttggaccttaatccttgactatgtagacattgaatattcataggtgttttgtgtgctatggtaggtgtggaaatatatgtgagatcaatatcacttcacctcaatatcttcaaaagtgaatatggatatggttttgttagctgaactcattagcaaagatgccttttaaaaatagcaaaggttacagtatatataatgtatgtgtgaatatccacatattattagatagattccaacatgagtatttgtatgtgtttctgttaacaatataatttactatcacagcttatttttcaaaattccattgaagtataaagctggttagaaagatatacggcatctttttctttttttcagctctcctaaggtataattgacaaataaattgtacatattgacagtgtactatgtgatgttttgacatatgtatacattgtgaaatgattaaatcaatctaattaacatattcatcacctcatatacttttttggtggtgagaacattttagatctactctctgagcaattttttagggtacaatacagtattattaactataaccaccatgctgtacaatcagtctccagaacttattcatcctgtctaactggaactttgtactctttaaccaacatctgcccatctcttcccccagctgttggcaaccaccactctttctgcttttatgagattgacttttttagattgcacatctaagtgagatcatgcagtatttgtttttgtgtaaacaagcatacagtattgatgtcaaggtcttgtattacccaccttagaacaagacagtaggatcattatttttattcagttaatgttcatttatacttacccacatattattcatttttttttttttttttagacaagggagtctcactgtgttgctcaggctggccacgaactcctgggctcaagtgatcctcctgcgtcagcctccccactagctaggattacaggagtataccatggccctagctccacattttactcttcattcttttttagcatttcagagcatccatctggaattaactctttttgcctgaaatactctttcctttgggcaatgatagcaaagtatttgggcagagcttcttcaggaactttctgagtcaagtcagacccaagccttgtcccacccctcccccaaggcatgggacctttgcccttcttgttaacctcctatgatctttcattcctattgtcccatctcactaacagtgttcctcgtgtgttctgactcatcactttagctgattctctctcatcccttagtttacctggtttcattttctgatttagggccttgcatagtctgattgattagtctcagtttcaagtcataacctccttgctttctcgaggttcatccagccccactcccctcaccccaccccttgttaattagcaggccaatgtactaccatctttcagcctgagtttcttctgaaagaacactgctgttctctgttgatactgtagcatcttggcaggtgcctcaggaaccctgctactgtgggtttagtacttcagattcttgccatgctgcagcttcagcataacctgggaactggttagaaatgcaaagtttctggcttcactctaaacccactgaataagaaactgggtgggggtaaggggacagcaatccattttctaacaacctccctaggtgattctgatgtacactaaagtttaagaaccctagagcccaatgactcatcttatttcacaagtgtggcaactgagttactccaggtccataaagccagtttagtgctaaacagtagagccaggagtagcctacttcagcccaccaccttgtctactaggcttctctatgttacttgtgctgaacattgtttttagttaaatattagaactgagtcatgacattgctgtacatttgcaaatgagaggcttgtcctctaagctttgcattccttctgccagtgacagtatcagtcagaatcaagtagttctcagtgacaaagtgggaggatacccttggcattggactctttacagggaactcagtagagtctttgtgttgttcattatggctttggttgatgtataatatattgccatgttcttaaaactaaaacatgctagaataaactcaacaagtgataaggaatgatcatttgcatcgtgtgtgtgtgtgtgtgtgtgtgtgtgtgtagatgtattaatatttagtttgtaaaatgaattaccagagaatttcttaagtagcaatgtccctgtatattaaaatgtaactctttgaaagtgggaaggaggtagataatgagttggataactgttcaggaacacatctactgaagagcacatttacattctcttagttcctaatatagtattagtatacttattcaataattgtccttgtttgtatgtactttagaacattttgttcacccttgctggatgttctcatatcttctttagataacaagtaaacatgtctgagagtttccatttgttttagtttgacatctttgccctataaaccctcatgtatctgaactttagaggaaaggaaatctgaagctactatttcaatcttttctgctttcaattttatttttaacaaccaaacagttctttctgatgataaggaatcagagcattgagaccattttcttactaaatcatgcttatgtggatggaaaaagttagtgcagcctctaacggaagtgacttaaccagtgggaaattcttcctttatatgattttataaatacaaaagtaaaatcgcattaagaaattatcaggaatagtaactactgcataattttgaagaccctgtaatctttcagatgttataagaaacttgtgaaaaatggacaaccaagatagtttatgatgttacagatgagttttgttttaccataactggctacataatttgtggagctccttgcaaaatgaaaatgtgggacctcttgttcaaagattattcagaatttcaagatggcagcagcagagcagtaaaccaagtgtgaggcccttctgagagcagggccctatgtgactgctcaagttgcacacccatgaaacctctgtggtttacctaattgagacagttaatgagagaagcaaaatgtgcaccactttgttcctggaataaaatgaatgttttgacttgaataaaagtgagaatcttttaacaaaaagccacttctacaaaaggctcttcctgtaagtgacctcttttattcatttcaaaatgtctttttctgtcaattccagcatgatctttgtcacaaataaaaaagggagctttccccatgagaatttctgtcaagaaacaatcttcttcaactctcttctgatatgtgaagaaatagttcttatctctcttaaagtaggtttgaaccttattctctgatgaatactttacatactctaagcaaacagcttcaaatttctcacagattttgccgatgagattcccatttctcttttttagtccctaatgactgaaggtatcgtatctagggatagtttacaccacattctctataagtaatgtaataggacttatagcatttcattttgcagcatatctttgggtctgtttgcacttaatgtggagttcgctttgagtaatatcagtcctttgaatttgttttatgtgatttggtttttataaaacattaggatgctctctagattatccagcccagttccctgcctctaggtgtacctgaatgtaactctgtaagacaaatggttatacagtaagtttctaaatgtcccaggaaaacaaaaatgtaatggtacagataatcctttttttttttttttgagacagacttttgctcttattgcccaggctggagtgcaatggctcaatcttggctcaccacaacctctgcctccctgggttcaagcgattctcctgtcttagcctcccgtgtagctgggattacaggcatgcaccaccacacctagctaattttgtatttttagtagagacagggtttctccatgttggtcaggctggtctcgaactcccgacctcaggtgatctgccagtctcagcctcacaaagtgctgggattacaggcatgagccaccacgcctggcctcagataatccctatatagtgagggatgttcagggaaataccagctgtacttgtattcctggcaagttccattattcttgaatgtaatcattattctttttttaattgcagttatttgatgtgtcttattcctttacttcagtgaaagttttatttgtaaacctaaccttatttatattcttggccgagaaaatagaaagcagacttttctacccagtatagtccactgtgtaaaactcttgaaaactttctcatcacatttgtcagctgtctctgatacatagacagacctgagttaatgattgttattgtttacatttcttttttctttaatgaaaaactattgaattattcagtttttattaaaagttcaatgatttttatatttcagatgctctttagtattcaatatattcacagcatactccaagtctccctcactggtccactggttctaatatttactagaataattttatttaccatatgcttgtgtcatattggaaatgttaggggaaaaattgaattttgaatgtgaaaggtcctttcttcttttatcaaaaggaaaaaaatgcattctctgacattaataaaagtcatgctgacgttctcttacaagaaactcactaaaatgacaaagagcatgaaaaaatgtaattaggtgtttgagctgagttggttggtttgttctcctacctgataaattctaatacacagaaataaaattccagttaatgagaaagtgcaaacatggcagatatatcgatattctagataatattgtcattatttcatgtgcttacgatagaaaaaaataaatttgacttttttgcaaatattgctgggttttcctctgaaaagcactataatgagtggatttatttattcaattctcagtgagttactggctgactcaaggttttggaaaaataaacatgtattctctatctctaagtatattaactaatctataaaggcttgacattcattaatgcttgctgagggaaaaaatgagttctagagattgtgttttgctcagtactgcataacttactttcacaagctctgcttaagctttgatttctaaatctctccccagtgaaatcatacctcaaagatgtttcattaaaatgacaagataagctccctcgcatccctatgctggagtgggggcaagggacagagttttgggagatcttgcaaaacggttcctaagctttagggaaagaagtgcaaattattgacttcagtgaaaaattgacaacatctccatggtgaagacagtagccaaaagggtgggccaactgtgtgccaagcctccgcttgtcttgatcttgttctcatggttgtgctgatgactcatgggggttggatttgtgtaatgtaggaaccattagaaaatccatgcttttcaagtaatgcattttagaaaaatatttttaaatgcatattttcattgtcataacctgcattgtacaatcttccacttttcgttccctacctcttttctatttggaaatattttctcagagtgttggtagtagttcacatggcttaattatgtctctaaatattagttcaaaccatatgaaattgttgccatttgactgttttttgcctacaaaatgacaatgtaatatggttcaatctaataagaaatatataattcccaaacagaaaggtaatatcctagtattacttaatcactttttgttgtggatgaaactcagattctaccttagttgatcattttctggctgtgagataattttctcacagattgttggcattgaaagagaactcttaaataggaaaaccctctccctgggcatccagggccaccctggaaaacaagccttaatgaagtcacctgatcagtaacctggtctcctgtggatatagttctcctgtttgcattgtacatctttagggaaaaaatgcagtatagttggttaatttatcagtctttatttttgttccagtgaaacaaaatgccctggccattctaattagatcaagagtcactgtgatgtctttgatagagctgggtgttaacaaggtttttctcagctaccagttttcaaattgttttttaaaaatggatgattaatccatccagcacttgttgatttctcccggtttgactctgaggtggaagtgacatcttcctcactttactacccaattcagagtgtaccttaaaatagcttcctctaaactggatataaagatgtcagcaatgtgtagattctctaaatatgcttttccttctttgttcaagacagtgctaatgtgagtgcttagttactaaaacaaatataatgacatttttaaagcctcacacagttggataattgctttaaagaaatcatggtacatttttttacttcctcttcctgaaatagaaatcatagtcctattgaagacccaggattccatacgtcgtaagagtataagtagtgtattccttttaaaggatggggataaatttcccctatactaaaaatcaccagctgccgtagaagtgctgagtgaaaaatggttcttatcatttctttgtggactgcaatttccccctgttgatataggctataaataggaaataaacagccttgaatgaaatcagatatagtatgcaaagatttcactgatgagtttaggtgagcaactcataaaaagaacaaaatattgcctggtcctaaatctttgccaaggaacctttagtaacctccttgctctcaaccattttggcaaataccactttttaactccattttttggagagtaacagatatttgtttttgaatttttttttacataaaaaagagtaaaaataattaagaatattaaaaattatgactgttacacgaacaagcaaaataaacatagtcttgaatatcttttaatataattagcagtttctccctttatgacatttatctgagataatttatcagcatttggactatactaaaatgaattgcttttctaaacagtagaaacttggcttctgtaaatacctgatccatgccgaaagtataatgtagaagtaggcttttctattaactattgtttgaagaaccaaaagtctatagtatttttctgtgttcttcagatatattacatatcaaacaagtaaagatttttaaagaatatttcattttactttattagcaaataattctctttatgattattattactggccatgaattcttttaatctccaaattagcccacatagaggaaaaaaaaaactacacaatttgcctatttggaagataccttacaattctctcttttacatagtgctatctattgagtaagtgcccagtggttatgcattgatagtttgaaagagttaattggaaactacgtaggagtttgctgaaagcatgattgaagcagtgatgatgaactgtatctaagtttgccctgctttcctctctggagcccactgttccaagaagagacatagttaaaaacaaatttgaaattgtaaatcttttctagttaatcccaagcaagaaattaagtgcctatttgcaagtctggctctgaccatacctctattcattttactaaaatataatgatatttgcagacagtagtgacacaacagtaactagatggcaacatagtaacttcataaaatagcatatgatataaatcatggaagtttttgaattaaaaatatcaaagaactgcaaaggtcaagtagacacatcaacttaaagcacttatgaagttaagctctaaggaatgacagtcttttaatgccactattttctctggttttaccagctttggggaggttatttaagcataatttttattcatgactttattttaaaagaaccacatgatgttcagaaattgatataattatatctctgaggtattggtgcagaattttgtaattctataccattttcttacaagtgatcaactctcatgtaattcaatggcatccatattatttattcagtaatctgtaattatagatttcctctaatgaagcaccctatgctttattgccctgggttctcaggagctctgtgggtgtcaattttagaaaatttgaaattgggaaagctatattttcccagatgaacattataaagtaatgaagaggttagtaagtgttgccttgattgtttgaaacaccaaaaggcaataccacccaatatacaattatcatattacttttagtataccatcttctttttttaatttaaaggttagattcaattaaatggtagtagcagtatgttaaatttactgtgagtatatgccttaggaagttatttatctatttattttgaagttaatttttttctattggagaacaacttctcttttacgaagtaaagtatgtaattaaggtctacctgaattttaattattagaacagaatattattaatatgtatttataaaaattgtctaaattacctgaatttagaacatttaagtttctaaagcactcattccctcatttgattccttgaatagatctggtgagctaaagtatatttatgtggtagtctttctaaaagcaatattcatttaaacttggcaagtgtaaagtatctaggcttggtattttttcttttgctattttttagaatttatgtgtatcttttctttccaaaattaagcacatgagggaagatgtataggtgtgaacactcaaggtatgtacaaaatgataaagacaagtagcctaacggggagttgaagaagccaaagaaaaatttttggaagcaacttataaaaccattgtagattggattggatctgatacacattgaatcttagaaaagaggatgatgttattaaacttatagtttagtaatgggagagactagaaacagggaattcaacaagttaatccatgtagtagtaatccaggttaagggttgagtgataatgttggagaggaaactctgattatgaaatattttgcctgtgaagaagtggtatagctgagtcatgttttaaatttggagatgaaagaatgtcaaagaccatgcatagattccaagcctggggaataatcagaaatgaaaaaattgggataagaagtcattaggggtatggttgggtggggaatttgtccacgattaaataagtcttagacatgctaaatctcagatgatgggaaatcttgtaaataacattgtttgagggtagctgataatttagacctgaaatgggactgagcatgaatagtgaggatgtggattccattccaagatggccaaataggaacagctgcagtctgcagctcctagagtgatcgacacagaagatggtgatttctgtgtttccaactgaggtacctggttcatctcactgggactggttagacagtgggtgcagcccacagagtgcgagccgaagcagggcagggcatcacctcacccgggaagcacaaggggtcagaggatttccctttcctagccaaaggaagccatgacagactgtacctggaaaatcgggacactcccaccgaaatactgagcttttccaatagtcttagcaaatggcacaccaggagattatatcccgtgcctggctcagcgggccccacgctcacggagccttgcttactgctagcacagcagtctgagattgacctgcaaggcagcagcctggcagggggtgaggtgtccaccattgctgaggcttgagtagataaacaaagtggctggggaagctcgaactgggcggagcccacctcagctctgcaaggcatgctgcctctgtagaccccaactctgggggcagggcatagctgaacaaaaggcatcagaaacttctgcagacttaaacatccctgtctgacagctctggagagagcagtggttctcccagcacagtgtttgagctctgagaacagactgcctcctcaagtgggtccctgacccccgtgtagcctaactgggagacacctcccagtttgggcctactgacacctcatacaggcgagtgaccctctgggatgaagcttccagaggaaggatcaggcagcaatatttgctgttctgcagtgtttgctgttctgcaatatttgctgttctgcagcctctgctggtgatacccaggcaaacagggtctggagtggacttccagcagactccaccagagctgcagctgagggacctgactcgtagaaggaaaactaacaaacagaaaggaatagcatcaacatcaataaaaaggacatccacaccaaaaccgaatctgtaggtcaccagcgtcaatgaccaaatgtagagaaaaccacaaagatggggagaaaccagagcagaaaaggtgaaaattctaaaaatcagagcacctcttctcctccaaaggattacaggtcctctccagcaacgaaacaaagctggacagagaatgactttgacgagctgacagaagtagggttcagaaggtcagtaataacaaacttctccgagctaaaggaggatgttcaaacccattgcaaggaagctaaaaatgttggaagaagattagacgaatggctaactagaataaacagtgtagagaagacacctgatggagctgaaaaccatggcatgagaactacgtgatgcatgcacaagcttcaatagatgattcaatgaagtggaagaaaggctatcagtgattgaagatcaaattaatgaaataaagcgagaggagaagttcaaagaaaaaagagtaaaaagaaatgaacaaagcctccaaaaaatatgggactatgtgaaaaggcgaaatctacatttgattggtgtacctgaaagtgacggggagaatggaaccaagttggaaaacactctgcaggatattatccaggagaacctccccaacctagcaaggcaggccaacatccaaattcaggaaaaacagagaccgccacaaagatactcctcaagaagagcaaccccaggacacataattgtcagattcaccaaggttgaaatgaaggaaaaaatgctaagggcagccagagagaaaggtcgggttacccacaaagggaagcccatcagactaacagcagatctctcagcagaaactacaagccagaagagagtgggggccaatattcaacattcttaaagaaaagaattttcaacttagaatttcatatccagccaaactaagcttcataagtgaaggacaaataaaatcctttacagacaaacaaatgctgagagattgtgtcaccaccagcctgccttacaagagctcttgaaggaagcactaagcatggaaaggaacaactggtaccagccactgcaaaaacatgccaaattgtaaagaccatcgaggctaggaagaaactgcatcaactaacaggcaaaataaccagctaacatcataatgacaggatcaaattcacaaataacaatattaagcttaaatgcaaataggctaaatgccccaattaaaagacacagactggcaagttgaataaagagtcaagacccatcagtgtgctatattcaggagacacatctgatgtgcagagacacacataggctcaaaataaagggacagaggaagatctaccaaacaaatggaaagcaacgaaaagcaggggttgcaatcctagtctctgataaaacagactttaaaccaacaaagatcaaaagagacaaagaaggctgtgacatactggtaaagggatcaattcaacaagaagagctgactatcctaaatatatatgcacccaatacaggagcacccagattcataaagcaagtccttagagacctaagaagagacttagactcccacacaataataatgggagactttaacaccccactgtcaatattagacagatcaatgagacagaaggttaacaaagatatccaggacttgaactcagctctgcaccaagcagacctaatagacatctacagtactctccacccgaaatcaacagaatatgcattcttctcagcaccacatcacacttattccaaaattgaccacatagttggaagtaaagcactcctcagcaaatgtaaaagaacagaaatcacaacaaactgtctctcagaccacagtgcaatcaaattagtactcaggattaagaaactcactcaaaaccacacaactacatggaaactgaacaacctgctcctgaatgactactgggtacataacgaaatgaaggcagagataaagatgttctttgaaaccagtgagaacaaaggcacaacatacaagaatctctgggacacatttaaagcagcatgtagaggaaaatttatagcactaaatgcccacaagagaaagcaggaaacatctaaaatcaacaccctaacatcacaattaaaagaactagagaagcaagaggaaacaaattcaaaagccagcacaagacaagaaataactaagatcagagcagaactgaaggagatagagacacaaaaaacccttcaaaaaatcaatgaatccaggagctggttttttgaaattatcaacaaaattgatagaccactagcaagactaataaagaagaaaagagagaagaatcaaatggacacaataaaaaatgataaagggggtattaccactgatcccacagaaatacaaactaccatcagagaatactataaacacctctatgcaaataaactagaaaatctagaagaaatggataaattcctggacacatacaccatcccaagactaaaccaggaagaagttgaatctctgaatagaccaataacaggctctgaaattgaggcaataattaatagcctaccaacaaagaaaaagtccaggaccagacggatttgcagctgaattctaccagaagtacaaagaggagctggtaccattccttctgaaactattccaatcaatagaaaaagagggaatcctccctaactcattttatgaggccagcatcatcctgataccaaagcctggcagagacacaaccaaaaaagagaattttagaccaatatccctgatgaacatcgatgtgaaaatcctcaataaaatagtggtaaaccgaatccagcagcacaccaaaaagcttatccatcatgatcaagttggcttcatccctgggatgcaaggctggttcaatatatgcaaatcaatgaacataatccatcacataaacagaaccaaaaacaaaaaccacatgattatctcagtggttgcagaaaaggccttcgacagaattctacaacccttcatgctaaaaactctcaataaactaggtattgatggaacatatctcaaaataataagagctatttatgacaaacccacagccaacatcatactgaatgggcaaactggaagcattccctttgaaaactggcacaagacagggatgccctctctcaccactcctattcaacatagtgttggaagttctggccagggcaatcagacgagaaagaaaaaaggggtattcaattaggaaaagaggaagtcaaattgtccctgtttgcagatgacatgattgtatatttagaaaatcccatcatctcactcaaatctccataagctgataatcaacttcagcaaagtttcaggatagaaaatcaatgtgcaaaaatcacaagcattcctatacacaaataacagacaaacagagagccaaatcatgagtgaactcccattcacaattgctacaaagacaataaaatacctagggatccaacttacaagggatgtgaaggacatcttcaaggaggactacaaaccaccactcaacgaaatagaagaggacacaaacaaatagaagaagaatattccatgctcatggataggaagattaatattgtgaaaatggccatactgcccaaggtaatttatagattcagtgccatccccatcaaactaccaatgacttccttcacagaattggaaaaaactattttacagttcacatggaaccaaaaaaagagcccgcattgtcaagacaatcctaagccaaaagaacaaagctggaggcatcacactacctgacttcaacctatactacaaggctacagtaaccaaaacagcatggtactggtaccaaaacagagagatagcccaatagaacataacagaggcatcagaaataatactacacatctacaaccatctgatctttgacaaacctgacagtaacaagaaatggggaaaggattccctatttaataaatggtgctgggaaaactggctagccatatgtagaaagctgaaactgtccaggcatggtggctgacgcctataatcccagcacttttggaggccaaggcaggtggatcacgagttcaggagatcaagaccatcctggctaacatggtgaaaccctgtctctactaaaaatataaaaaattagccgggcatggtggtgggcgcctgtagtcccagctacttgggaggctgaggcaggagaatggtgtgaacccaggaggcagagcttcttgcagtgagtgggagatcacgccactgtactccagcctgggcgacagagcaagactctgtctcaaaaaaaaaaaaaaaaaagctgaaactggatcccttccttacaccttatacaaaaattaatcaagatggattaaagatttaagtgttagacataaagccataaaaaccctagaagaaaacctaggcaataccattcaggacatgggcatgggcaaggatttcatgactaaaacaccaaaagcaatggcaacaaaagccaaatgggatctaattaaactaaagtgcttccgcacagcaaaagaaaccaccatcagagtgaacaggcaagctacagaatgggagaaaattttcacaatctacccatctgacaaagggctaacatccagaatctacaaagaccttacacaaatttacaagaaaaaaacaaccccatcaaaaagtgggcaaaggatatgaacaaacagttctcaaaagaagacatttatgcagccaaaagacacatgaaaaaatgctcatcatcactggccatcagagaaatgcaaatcagaaccacagtgagataccgtctcacaccagttagaatggcgatcattaaaaagtcaggaaccaacagatactggagaggatgtggagaaataggaacgcttttacattgttggtgagagtataaactagttcaaccattgtggaagacagtgtggcgattcctcaaggatctagaactagaaataccatttgacccagccatcccattactgggtatataaccaaaggattataaatcatgctactataaagacacatgcacacgtttgtttattgcagcactattcacaatagcaaaaacttggaaccaacccaaatgtccatcaacgatagactggattaagaaaatgtggcacatattcaccatgaaatactatgcagccataaaaaacgatgagttcttgtcctttgtagggacatggatgaagctgggaaccatcattctgagcaaagtatcacagggacagaaaaccaaacaccgcatgttctcactcataggtgggaatctaacaatgagatcacttggacacagggcagggaacatcacacatgggggcgtgttgtggggtggggggcagggggagggatagcattaggagaaatacctaatgtaaatgacgagttaatggatgcagcaaaccaacatggcacatgtatacctatgtaacaagcctgcatgtcgtgcacatgtaccctagaacttaaagtataattaagaaaaaaaaatagtgaggatgtgaattaagacatcaccaccatggacaggaactagaagctttgaaactgagataacttcccagaatccaagaaagcaatggccacagactatccagtgacaccttggcctgttttctgaataattatctttcagcagcttgtttcagttttatcaacagacagaagtaagtctgctaagagcacaaatatattctagttaattgagaaagaatccagagtcagactggctatttcctggagcagattattgaactgcccttaagaaattattgagggatttagatcaaggcttaaaggtaaatccttcccccttccatcttgttacatcaaatgtaaattacaatattgagttatgataatccatatcagaagcatataccttcagctgtttttctgaagcttgtgacaagagacaggcttttatacattgctgaccatgttttgtaccatgtcatcctccactactttcacattagacaagaggttgattcttgacccaaagacagcctactttggctgctctactttgtaaaagatagcctgtaatatacacctcttccaaaaggctgttctgtgctggttgaatcaatttgattatttttcttagggagtttggactcaaagacacaaagatagaaaattagttggtaaatggcagaagagaaaattaaaacagatactaagagttaggtgtacatgagtagagctcatgagtaggggagaatggacaccaagatactaaagtcgtaacattaatgagtcactaggactattgtgcctggagggagagttgtggttatatcttgaatgatccttgggttctttgtgaggcctgaccatgcagctgctgaaacctgtttccttttcttctttacttctgcatatatccttatactaacccctcatctttgttttcttgcaagccatataacatgtttatcaaaagggttatagcagtagccaattaagtaacagacactccctcttttccttctccttcttccctgccccaagccactagtggatctaatttctctaaggaaaaagaggggcaggggaagtgagtggtgccacccatttgccccttcaggtacctgggtccgaaagacaaaccagcaatggaggagggaaacactttgaagcatatgtaagattaataattaaactacaaccagaaagttatggaatcttcccaagatgttattacaggacttgaaaggaagatttgacattgtatgtctgggagcaatggtgaagaaaaccaaaaaataattttatgttcataccctcactgaggtgagacttctcaataaactagatattaacagttatacatgccctttttcaaactacttttgcttttttaaaaaagcaaaaatatataatatcatcatataaaaggaaaggatgatacactcctcaatttgaaaagggtggttgtaataaggacacataagtttgcagcagtgtgcattcaaaaaatagggtggtcacacatacacacacacacacacacacacatacacacacacacacacgagatttattgtactttaaaaataatgaacaccggatcacctgaggtcaggagtttgagaccagcttgaccaacatggcaaaaccccatctctgctaaaaatacaaaaattagcctgggcgtggtgtcacctgcctgtaatcccagctacttgggaggctgaggcaggagaatcgcttgaacccaggaggcacaggccacagtgagcagagatcgtgccactgcactccagcctgggtgacagagaaggactctgtcttaaaaaaataataaataaaaataagaaacagttaagttccggcgtaaaaaatagaataaagttgttacagtaacccccacttatctgagaaggatacactccaagaccctgcccctctgcccctgccccagtggatgcctggaccctgtatacaatgtttttttttttctccatacatacatacctatgataaagtttaatttataaattaggcacagtaagtgattaacaaccacaataataaagtaaaacaattcagcaaaataggggttacttgtaaacaagtaccaggataccatgacaattaactgatcactgagatggtggctaactgactcctgggcaaggagcatctgtagcatggagacactgaacaaagggcaccatgctactcagaaaggcatgcaatttaaaatgtatgaattgtttgtttctggaattttccatggaatcttttcagaccatagttgactgtggataactgaagccatggaaattgaagctggataaggtgggatctactgttttgccttcctgcagttatgcaaggagttggcaggggaattgattcattatttaattttataatgaaagaaagaagaacattaggattcaaaagttggattaccaaatgatgacttgtcaactcattccctgcactccaagtatcagcaaattaagagtaccagttccttcatttgccacatttttatactccgtgggctgccattactattctcatgtgtcacttgtgttacagttacctgactgcactctcataaggacagttcttgaaaagccgcttccataccatacttgctttgtgcctgtgcttggcactgaagaagacacagatacacatttgacctcctgatggtgctctggaagccaaaatgattcctttccctctcaccttcctgattaggcttgtgtttgtgtgtcttatgaagatggttagctatattttacggtgttatattctgagatggcaatctagttgaagtccataggtaaggagctaggtcttttgtagagaagctgagtttattcagtgttattcagaggcagtctcagacagcaaagcaaaacttgaaaagcagatttccccttggcttttgaaaaacctctcttctcttttttgtgactgttcttttggaactggactttatgggctctaaaatgtaaattcagaaagaaatgaatgtgtaattgttgcttcattatcttgtgtcattcttggctttggctctccaaaattgctctcttcaattgcaagtagacttatattgaatgttgatgttctttccctccttccacctgtgatgaggccttgttttactgatgtggctggtccttgccaaggtccttcagcacctcaaaagcagattgtgagatccacacatatctgtacctagcatgatttttttttttaaagacacagcatctcactatgttggcccacactggccttgaactcctgagctcaagagatcctcccactttggcctcctgagtagtggaggctacgggtgcacaccaccacatccagcaattagcatatgcttgtcgttgacagtatatgctctagagcaggggttggcaaacattttctgtaaagggccacgtagtaaatattttaggctttgtgggccataaggtctcttactgcaacaactcaactctgctgttgtggcattaacacagctataaactaaacataatgaatgatcttggctgtgtttccataaacatagggactaaaatttgaattttgtgaaattgttatgtagcacaaaatattattctttttaaaatgtcaaaatcatccttagcacatgtgctggtaaaaaaccgccagtaggctggatttaatcacaagaaatgtagtttgacttcctctactcaaggcgtctcggggtcctaaagctggttctgtcacttcacaactatgtgaccttgaacaagttaattcacccaaattaccctcagtttctttacctggccaataaaataggttggtgtggaaatttcaatataaatctcttcgaacactgcctgccatatagtcagcattcaataaatggtagatattattaatattcctacctccaaagacatctttgttttatcttttcagagattaaactcagattactttggtacatcattttgaattgagttagatttgttctttttccaaatttgttttttacttacttttcccttcacaagccttccatgctcttagtaagtaaatgattctgataagacacacggagtatttcaaagctctctttgaaatattaattatttaaaatatcgaatgtgagatttttttttccagaggcataaactggtttttctggtaagcgttaacatttaggtttattgggtgcttgtttatttatagaatgtgtaatttcatctctcaatcttctagcatataggtaactgggaaaaaatgaataagcataaacatttttttaaccaccatttgctatcaaactctctcaccttatgcaaagtgtcaaaatgtgcctttggctgaaatgtttcttcactgaaactctaccattagaaataacaagcttctctttaagatatacatacattagggaaagttaactcaccaattcagttcccctaacaaacttttaggtaacacctaccatgtagacattttgggagaaatcacttcatccatccttcatcatttatcagtttggggtataatatccacttatgacccctaatacagtatttattccatggcaaaatgtacctaaaacattaattttaaaagtatttaggaacagtagtattcactatgaagtttatctgggatttgatgattcacctcactataggaaactgttaattacctgttctggcaaggagatgagatactagaatgaatgaactctctaaccgacattttcccctatggttttaactttaattgctctgagattaattttctttttagtggataccactgtgcaaggcctcaacctgggaatgtaatgtttttctgttttgttttacaaactttcgactaccacatcatgtaattactacactgcccctagctcatcctgtggattctagtaatttcttctaagctcctgtgtcctcttttccgtcttgaaagttttcttcttttgaataagagcatctgccttcattattttccatagaactttatactttctatttatgccctcttctaatctctttggaatatcttgatttccttaaacactttctggctgtaaataacttcatagactattatcttagttaccatctgttgattttccaagtcaccattaactccattcttcactcacttccaattaaaccacaaactaacaaaatcctcttgtcgcctaaaggctttctaggtgcttgtggactgaaatataagttgctgaggtttttttgatgactattgacacagtgctttgccaaatggtttgatttctcttatttctgattcatttatggttttactattactcttactgatagatattaaagtcttgcagaacgatgtgttattttcaccatattgtggtaaccttttacttagtctttattatctcctattgtttcatgttaaattctgagagttatttgtcagccgtgggccttcatgtttgttagatctcagagaagggatttttattttcctcttctttaataaatgagcagtcttcaattttgtgttatctacaaatctgtataacttgcagcacgttcttaatctggaccatgatagataccgtgaaaaagattgaatctagcactggtttttcttgcactccacttgtcatcgccttcttatgctgtcaacttccatttactactgctgatgaccttgctcacaaaacaattttgcgtttctatttattcttttaccaataatgaccaaattggccatctgactgtacctagagttctatgcagaataatatttgtcactgcaaatcaaattgtatttgtcatataattgatttctctcccaatctggtccactttgcatgctacggtgaggctgatcttaaatgccacctttgtcatgtcactgtcctgttgaagatcaatcagtgggtttttagagtccactgaagcacattcaagtttcttaaaatgatatccaagctcctttagaactttgctctgatattacctatccaactgtaactcctgtatctttcaactctgtttctctcctcatgctttatcatggataccatccatattttatttcaggtggctatgctgattcaaagtggcctcaactcttttttacccccttaaaattatgtgatataaatagacaaaactaatatatgatgatagatattcagacatatgtttcctctgagtgggcaaaagagaattttctagagagttggaaatgttcaatatcatgattgtggtggtagttacatggatgtatgcatttttcaagactcttcaaactgtacaattagtatctttccatttcaacatttgtaaatttacacacacacacacacagtgcacatgtatgtgcactaggagttcagatatttagattttattatctgtgaaccagtatgatctgttttttttttaaatctgtttttgtgtcttttacatgaaattataataaagtgctctagaaatgtaatgttttcagaggcttaagtcccatttcttccatgaaatcttccctaactcctcaagcccacagaaagcttagttttatttttaaaaatgatttcatatgtgcaagtattatctcacataaagaagggtcctactttcagtaagaagccttttgcttctatgggatcatttaacagtgattggttcatagcaacttttttcaactttgagcagctcaacttttgcagaaaactttaattatacaatctagaattcaaggaggctataacagtgaattaaaaccattatgcctcggttaagattttaggaaatgatttttatagtattggctttacttcagtaattttcaaggtgtgataaactggaatacagtcttaggaaatgagagagtccagggcacttggtgcttaagtgcctagaggagtaaggggtattctaattaataatgtttgataaaaaggaaggagagcacagagtaatttcaaaaactatgaagggtcagagattttgccctacttgcatgccaacaagttagcctgctgcagtttcagcgatgctggcagaacacacaagactcctgggtcagagacacataactcttgttattcattcatgatacagcaagcaatatgagcttcacgttcacattgttttcctttgccctccaacccccagagttggaaagcaaacctagaccagggttgggaaggcaaacctaggtggatgctgcactcacggtgggtttgtgtcattgctgaggaatccctgcttagggaacccaaatcttttataatggactgaacacaaacctgcctgacatttttcctagagggagatataacctgtctgcaaagcaaatgaacctgtcgtcttctctagaggaagacactgtatcttccaaggttgttttctgtaaaaacatccttgaaaagatagtacagaaaaaggccatcagtgcctctgttcacaaaatgtgcagaaatgtgagaaacccatagagaattgtctgtaagtaagtatgtgctagccaataggaataggcttgcacaaaggtatagcagaggtaattcatttacctagtgctaattgtaatctgtatcatctccaaacccttttgtgaaaattaagacaacacaacacaagtaaatgctgatactgaaaattaagcagcaggcattcggcatctactaaatgacaaatactaagggaaacatgaaaaagaaggtacaacccataccttttatttgatatgatgataagtagctcacacaaagcccacagatgcatgcagcccacctaagtccttagtaatatctgtgactttcaagctgagtagaaagttgcttctaaagtgttacctctcagatatgcccataagttattattttagtggctaaaagcattacaaaattttcccttgatattctttcactcagttaaataggtattgtatgttgtaaaaaacacattttttgcacgtgttcaataaagtttttgtcttttttaatgaaataaacacataaacaattttttttcttgaggttgaactcgtagaccaaaaaaaaccctactcactactaattacatctaagtaagaattaatggttctatgaacttggaagttctaagtgaactgtcaacctcaaattaaatcacatacaaaatttcactgaaatgcattcaaaatgaagagtaacttctttcaaaggatcatgttgacttccattttgttttaggaagactaactgaaatataatcaatcccatgattatattcataaaaccttgattcagtaaggttagacattttatgaaaaatactcagcttctttgaaagttatcgtggagcaaaagaaaaagtaatgggggactgaagcctacatttctttcctttaatacatcagtgatatttacaaaaattttttttttagcagaactatttggcatatatgttctcagaagggacaatattaccccaaaagggatgaatactggttcttgggaatgtgggtggaaaaacatcttagatattgcaatggtttgtagccttccaaaggaccgcggtacataaacagacgtacaagatatctgtggcattaaatgttaacaataggggtcattagaaaaaatatctaaaaagactcccagtgggaggaagacaataatgaaaaaaggttgagagacgttgctctagcataatatttcgacaagtatagtgaggtagcaactactaaattaagcaaaggtatttatttttattcccacttgactttatttattttgagacagggtctcactctgtcacccaggctggagtgcagtggcatgctcatggctcactgtaaccccaacctcccaggctcaagtgaccctcccgccccagcctcctgagtagctgagactatacatgcacatgccaccacacccagctatttttttttcttttgtattttttgtaaagatggggtttcaccatgttgtccaggccagtctcaaactcctgagctcaagtgatcctcccaccttggcctgccaaagtgctgggattacaggcatgagccactgcacccagcctcctctcaactttttgtcatatttgtttttccatctttttatctaattacaatataatagcattaaagaattttaataaaacaatatctataatgttatacatttttatgtttgcatattatttaggtaaatcataaatatattttttcagtaatttacatatatttacttttctacatagtctttataattatcatttttgtaaggatacataaaatttcacttgtgctgttgtcctcaccttcttgtacttatatatctctaaaaattccttccctgtcttctttgcaattctgcttctcctgactgcctgttaaaagttgggtttctctgattctggggaggggattaggaagacattagtcaaaagacacaaaatttcagttggacaagaggaataagctcaagagatctattgtacatcatggtaacagtagttaataacaatatattgtgtattcaaaaattgctcagagattttaagtgttctgactaccaaaaaatggtgacatatgttaaacagcttgatttagtcattccacaatgtttacatatattaaaacatcatggtagggtgcagtggctcatgcctgtgatcctagcaccttgggaggctgaggttggctgatcacttgaggtcaggagtttgagaccagcctggccaacatggtgaaaccttgtttctactaaaaatacaaaaaaaaaattagctcccgcatggtggtgcacacttgtaatcccagctacttgggaggctgaggcaggagaatcgcttgaacttgggaggtggaggttgcagtgagcctcgatcacaccactgcactccaacctcggcaacagagggagactcggtctcaaaaaaaaaaaaaaaatcatatactgggtgtgtgtgtgtatgtatatgtgtgtgtgtgtgtgtgtataatttttacttgtcaattaaaaattcttaaatattttttaaaaagttgaggttctctggaattgcatcttctattctatccttcttctaatatactttttcagggtaggtaatctcatccaccatccaatgacacccaaatctttagctccagcccagagttcacttttgcatttcggacccacatttccaacttctttttcattatttctacttatatatttcttagatatataaaatagatcacattttctcatacttgtttatccctggtcatctaaactcctctccttaatctcaccctccttctcttgcctgctaagtcctattgactgtattaatgccttcaaaatatccatcctctccattcactttgctctctgtttagttcaggatatgtgttatttagacaattatgctatgcacctaaaaatttccctgcctttttttttttttgagatggagtctcgccctgtcacccaggctggatggggagtgcagtggcgtgatctcggttcaccacaacctccacctcccaggttcaagcaattctcctgtctcagcctcccgaatagctgggattacaggcgcctgccatcacacctggctaattttttttatttttagtagaatcggggtttcaccatgttggtcaggctggtcttgaactcctgagctcaagtgatcctcccaccttggcctcccaaagtgctgggattacaggtgtgagccactgtgcccggctaaaatttccctgccttttgtctcaccatcctctgagtcattctccacaatgctgtctaacaagtctttctaaagaataaatctgatcaggttacttccttttgtttatagctgatatgcccagtacagtaaccaccatctgcatgtagctattgagtgcctgaaatgtggctaatctgaactgacgtgtgcagaagtaaatatgtactagatttctaagagttagtctgataagaagaatgtaaaatacatcattttgaaaatacatttggttgaatgtttacttaatgtactaaaaatcaatttggccaggcgcagtagctcacgcctgaaatcccagcactttgggaggccgaggcaggcggatcacttgaggtcaggagttcgagaccagcctggccaacatggtgaaaccctgtctctactgaaaaatacaaaaattagccgggcatggtggcaggcgcctgtaatcctagctacttgggaggctgaggcaggagaattgcttgaacccaggaggcggaggttgtagtgagcagagattgcgccactgcactcctgcctgttcaacagagtgagactctggctcaaaaaaaaaaaaatcaattttacctttttttattttttaatattactactagaatatttagcattatttatgtggttcacatttatggcctgcattttatacctagtgaatcctgttaacttatcgaatagtgttcaagccccatatcatagaattttcatctttcatcatctgggcactaattcctagttcatttcaacttcttccagctattgagcaaagagcactgggcttggtatcagactgatctgagttcatacttgggcctctccaccacagttgaaatacatatagttcttatctcagtatgttgtgaggattaaaatatctaacaactgtaaagtgtcaactgcatataatttaattctcccaggtacattctagccataccaaactaccttcaggtctttttttttctattgaaaagagcaggtgatacttcagatgtgtctgtgagcttaatgaatgttgttttgtttgttttgtttttgtttttgtttttgtttttgtttttgtttttgtagatggaatctcagtctgttgcccgggctggagtgcagtggtacaatctcagctcactgtaacctctggctcccgggttcaagttcaagtgattctcctgcctcagcctcccgagtagctgggactacaggtgcccaccaccatgcctggctaatttttatatttttagtggactctgggtttcaccatgttgggtcaggctggtcttgaactcctgacctcaagtgagccacctgcctcagcctcccaaagtgctaggattacaggcatgagccaccacgcccagcctcttaatgaatgttacaactacacaatcccctttccatgtttactcaatgggctctacttcatttttcctgttttcaccaaatattagacctgagaacctcagtgtttctcttcatttttttttttcattcaataccccatcctagagagtttattttaaaagaataaattattataacattggagaagtttcagatcaaatgcagaacataatcaaaaaatattttagcttgctcttgtcccataagaaaatgtattttcagctgggcgcagtggctcacgcctataatcccagtactttgggaggccgaggtgggcggatcacctgaagtcaggagttcgagaccagcctgaccaacagggagaaacctgtctctactaaaaatacaaaaactagccaggcgtggtggcgcacgcctgtaatcccagctactcaggatgctgagacaggagaatcgcttgaaccccggaggcagaggttgtggtgagccaagatcacgatcacgccattgcactccagcttgggcaacaagagcgaaactctgtctcaaaaaaaaaaaaaaaatgtattttcatttgtgatctcataccccatagttaattttttaaacaaagtaggatttagatttaactttggaatagcatcagaaacaatgtcctttccctcttccctccttcttctcttaaccctcttgcctgcaaattgtcatctacctcacactcacacatttagctaccctcaaggtagccacctatttagggtccttttcatcagctaggccagttaggaagagcaggctgagctcactggggattatgcacagtgtaatagagactttctggccattgacaccttgagacaaacactctaacaaatctttaaagtgtttttcatggctagagttgtcaaagataggaggagggtaaaatgttttaaatgctgtttctgttaggaatttccacgaacatcttctgagcatcccacttatggctccttaacagttctttcccataggaaaagtttagacacacagcagcattctaaaaaggaagtgggactctggctgatgtccctaaaagttaaaatgtggcctttcagataatgtggtcacctttttctttatacagtgttagcatctcaaaatggtaaaggatatggattaggtaagaattgaatgcaaatgtgttttgcaaatagtgttttctaagataatcgcagatgatggttgaatgccgaaagtattaatacaatcagtatttaaccttgtgtaactccgcttcatcaaatcacgccctgcacattgattgcattaagctgagtcagtggtttcttggttaggaatatcttataagaatcttaacaggaaggcagcagtagctgatcagctactgtttatttgcatactgagcgtgtcatcaataatacaaaagacaaggtctttaagttgaaagaacagtgggattggcatgaatttttcttaatggtgcataataagcaaagtagtctgtggtgccagaaactgacaggatccattatgttaaaacagatatatgtctttaatttaggggtattatgtaaatctgacaggagtttttccctttattttcctgtagtttaactttaattgctccaagattaattctgatttctccctttctccagagggtgatgagactggtgtgatggataatcttctagaagccctacaatcaggtgcagcattcagagaccgtcgaaagcggattccaaggaatccaggtaaaacacattccacctcacatagtattgtaaaatatgaatgttcagagcaaagtagcaacaccaaaaaaaaaaaaggaaaaataaaaatacttcctcatgaagactttttttaacagttgatctcagctcatgtgtgaaatctcagcaggcatctacatgattgcaagtttcaacttggtaaatgtatcttcaaataactgtagactttacaacaaaaatcagaaacaaggactcccactgtgtttaatattaaatattttaattgttattttatgagcatgtggtttaggtggaaagtagtttaaaaccataaatgtaattaaatcattaaaagtaattggccctaaggagatcacattagctattcacaggtaaggaaactgagacaatgcttgtttctagagaccgttttggttttgcagtgcagtctgttctctgtgatccatgttaataaagggaggagaggaacagatactccaagatcccctcaaatcccaaagtttttgtttttatatttgattagtaacagttaaagccacactatgaaaatagatctcaggggaagaaaaatcgtaaaagaagtaaaacaacctccctcacccaagtgaactggaaagttgtctactttctctgttcataccctatggtagaagtaaataatgtaatagctcctctaaggataatccaagtaggctgaactgtctacctcctctcagtaaagttttctatttgtagctcatatctttcttgaagtagagaaagaaattaggtatgttgattttaagactcctcttcatgggctgtaaagctatatggagaagtaaatgaaaaatggaaaattaatagtcaatatgtaaactctacttcatttagattaataagatttgccttaaatagcctgcaattccaaaaatattctctatttggactggaagttaccatgtgtcatttaatggaaattagtagctctcaaaaccattgtattgcaacaaacgagtgagagaaatggggcccagaacatagttgtccaggaaagcttttggcagtgatgaccttgatggcagaagacaatatatgttatattcatctttttcacatttgggtgaatcctgatggatattggataacattctgcctctgctatttatggatggtccctgagagattaacctaaagataagatttgattgagaggaaacaagtgttttggttggagtataagactacttttatgtatatgaatgcatcgtagatggcctacaaaaagggtggaagactggacgaaaaaaagaatggaagtctgtatttataagttcatattcattttgaaggtaatgctgcatggcagaatactaggagcactactcatctataactatgaggcagccattccacttatccgcagcctttgtctgtaaatgagaatgttctaccatgccatcaagcccctatcacctcttaaggaaaataaaaaccttcactgctctttcttgaactatcagagcaatagtagtcagtgaaaggtgaactgaaatcatttttgtatcaattcatttctctgttaagcagctgataagtgaaaacatgttattctgggccataaaagaactgccataatttttctaggctgtttattttaaaaatgcacatttgctaaagcccttgtctgattagtctcacacctcatactgattccagaaaaactgtacttggagagagagatcattccatggggtttctgtgagtttggtactcaagggaatatagtgttgtcaactgtgaaacaccaagaatatattcacaaactgcataattttatagtactgattccaagtaatctaaattgggatttcctttggtttgtagctggagtgcctccatgaacacatagggttaaaaatatcactcgatttagctgtggcagtcattccaagtggcagcagccaaagcaaatgtccagaggtaaaacgaaactcgaatgcagacagtggcagtggttgggaagcaccttggtcatcagtagaagagctggaagtgagggagtggggacagaaggcacagagtttacaagtctgccaaaaaactctgtctgcctctttctggaagaagcagaaccggggacttttacagatttcctccttgcctcagcccttcctagctagatcatcttttcctgctagtcccgttatttttactttcttaggcacctgatttgtttcctttccaagatcccattgacttggtattgttatactttccctgttcaacattgacattcttgatcttttccaacaacctccacttcagcatgatgagataaaagcagaaaaggctaattataaagaaggctatcttcccccaagtaaagtaaaataaaaggaaaatccaaaaaacactaaaatcagagtcaaccacaatcagcggagatgtacttactgctctgcttgccattttcattaccatcgcttatagatgggtattactgttatgtaaaatacagagctctaccattgtgtttctaattgtaatctttttatttattttttatttattattatttttttgagacggactcttgccctgttgcccaggctggagtacagtggtgcgatctcggcccactgcaacctccacctcctgggttcaagagattctcgtgcctcagcctctccagtatctgggattacagggacataccaccatgcccagctaattgttgtatttttattttatttttatttttatttttatattttgagatagagtcttgctctgttgcccaggctgcagtacagtggcatgatcttggctcactgcagcctctacctcccaggttcaagtgattctgctgactcagcctcccgagtatctgggactacaggtgcccgccaccacgtccagctagtttttgtatttttagtagagatggtatttcgccaggttggccaggctggcctcaaactcctgacctcaggtgatccgcccacctcggcctcccaaagtgctgggattacaggcgtgagccaccatgcccggccaaattgttgtatttttagtagagactgtgttttgccctattgcccaggctggtctcgaactcctgacctcaggtgatctacccacttgggcctcccaaattgctgggagtagaggtgtgagccactgtgcccggccatctaattgtaatgttttaaattttatatgtaaacaagatgaggtgatagtctgtattcttcattagaaaatcaaaatgttaataaatgatatgattagttgcctaaattataaatcgcccactctgagcctgtgccccctacccaagacctaccatatttagtaactcagaaggagcttccacatattgcctccagcccattcagcggatgtgctgtttcagttaagtaccaaaaggcatttcaaggtagactatcatatcagtagtgataattgaaaatatttttttttaataaaaaacaaaaaggctgggcgtggtggctcatccctataatcccagcactttgggaggctgaggtgagaggatcatttgagctcaggagtttgaggacagcctggacaacatagcaaaaccccatctctacaaaaaaatacaaaaaaaaattagccaagcatggtggcatgtgcctgtagtcccagctactcaggtggctgaggtgagaggattgcttgagcacggtaggcagacgttgcaatgagtagagatcgtgccactgcactccagcctggatgacagagccagaccctgactcaaaaaaagaaaaaaagaaaatattaactggtgtatcacaggccccagatagtcgaaatgtacacaggtgataaataacgactctggttgtactggtgcatactagctgaatattaacccagatcacaagctttgctgatgtcaaaatcagagattaggaaatgagcccctaaatattcatttattgtacatctgctgtgtaaaaggtactatgctgtacatgatgagggaagatgtagaaataattaagataagatttccttagttataagaccctgtgtattataggaacgataaaaagcacagaaagactacagaataaggcagaagataataagtatcatacaagaggtgttaataacatactgtgtgacttcagagaatgggacttgcatgcattatcagatatatcagaaaaataataatggaggaaaagactgaaggatgagtagggattccaacagtgagagctggagttagggatagtgggcattttagtcaaaagaaatgtcattaagaaaaacagaggcaagaaagttcaaagcatttttcaacaatggcaaacagtacagtaagaaaataggatatatatagtatagaagtataggggtaattctggaaaattaggtttgctccatatcagggagtgcttgaatgagagactaaggtgttaacttacaattctctaagcaatggggatttattgaaggcttttaagcagtggaggaacacaagttacgcattagaatatttaaaggagtataagtaatcaattaggagtctattgtcatattcttatttagagataatttagcgtgagaggagtagtcaagaggcaaagataaccctatggctttgagtatgactggctaagaagacatttgggttactaaacttttttttttttttttttgagaaggagtctcactctgtccccaggctgaagtgcagtggtgcgatctccgctcactgcaacctccgcctcccaggttcaagcaattctcatgcctcagcctcctgagtagctgggattacaggcacacgccaccgcacccagctaatttttttttaatttttagtagagacgaggtttcatcatattggccaggatggtctcaatctcctgacctcatgatccgcccgccttggcctcccaaagtgctgggactacaggtgtgagctaccgcacccagccgtaaggttactaaactattaagatcaagaaaaggagtggtgatagtagaagaaggtaaattcagttttggataagttaaactgaaagtgatagcagaacactgaggtcaagatgtccagaagatttttggaaatatagttacagatttcatgacaaaatgaattcttgagtgttctggatatagtgtggataggggaagggattgttatagggatttttaagagaaaagaaaaccaaagacagagacttggaaacaccttcactaaggggctaaaagaagatagacaaggagcaattgggcaggtaggagaatccagacattattgtcctagaaacaaaggaagagggaagtcctaagaagggaggagaggtgaacatttttgacaatgacatacgctctggtggaataaaaaagggtaaaaaaccgatgatttgctatttgggagctttctaatgactttttgaagagcatcctttcaatattgtgatggaactgggaagagaatacagagctatgcagagtagatggtgaggctatagggaaagatcatattcattcaacagttgagcagtcttattgaatgcctcctcggtgcattatactgagttaggtactgaggatacaaaatcaaacgggagcctagaggagctcacatactgtttgggaaaacacgaatataaaccatgtgatcaatttacaatgcggtcttctatatgctgtaatagagataggaacagtaagcctgtgcagcataggagttagagtaaccactcccaaccccccacctctctcctttgtgtctgtataatatgggctattctttctagcagtttggtgggtgaaaggtacatctcatttttccttcacaacctagtatggatttatcttctctgaattttgctaaatctttcttgatcctgtgttgttacagcctttgttaccacataagataataagttgcatacatttaccatctactttgtaaagaattgccctggctgtgtaattgtaagatcaaagataagctttggaggaaaaagaagcacatagagagacaccttgcaggagtgaaaatgactctttttttttttctttttttccttttttttttttttgagatggactctcactctgttgcccaggctggagtgcggtggcgcgatcttggctcactgcaagctccgcctctcgggttcatgccattctcttgcctcagcctcccaagtagctgggactacagggcctgccaccacgcccggctaatttttgtatttttagtagaggcggggtttcaccgtgttagccaggatggtctcaatctcctgacctcgtgatccaccctccttggcctccaaaagtgctgggattacaggcgtgagccaccgtgcccagccagaaaaccactcttaaaatacaaatacacaactccacatctgttttattgccaaatagctatagatacttagagcttgcttctctttcttcaaccaacccgacttttttattctttgcccactgtaagtaaatataaatgggcttctcagcaataggtggatatctaacttagcattttggctatgactggattttgatatatagttctagacattaaaaaaacacacaagagaagcattatgaagaaatgaaaccaggaaacaataaatgtattttggttttagaaccacacggggcaaccaagaaaactaaatttcaaaaatcaggagcaactcaggagacacatgatcctagttttatgtgtcagcaagataacagtataaatgagaaggtataatttaccatttgagaacagataggggacaagaaacaatgttatacaacagagaaaaagaaacctccgtatgtattagggaagaataatttcacagcaaaacaaaacccacatttccccaggcctcactgcctcatgtaaataagaaaactcaaattttgctggctcttgtctctacatacacattcagcacctcatctgctataagggatctatgaagcatttctgggagttatcagggggcatttcacagaaacaagcaaacaccaccgttcctccacctctgctataatatcatgcatttctacgcttgctgtcttctgtagcagcagggactcatggcttcacaacgccagagtttgacagtcatcattgacaaagtaggggggaaatgcctctctcttttcctttagtgcggcactccacctgtgtaccaagtagtactgcttatgcctcagactattacagataattttagagaaagagctttcaattttaaatgacaccctcccccgcccaccatcacagaggatttgacccaagatggcaagagccaaagacaagctcataacagatcccacgtaatactcagcatcatcttgatgaccaaggtctattgtggttttgtgcttgttttgttttattattactaggtcttgctggtcgttcattccaagctgtttacttctttctccctgaagataagttcttcttcatgaactttctcagtctctgttttataaatgtcagaatcttatactaccacactaagccccatttagtctataatacattcattatattgtaatatacaattaaaatctggttttagaaagtaatgcaaggaaataaataaaagcatgacattcatccaagtaatacttattaatcaaatactaggggccaggcagcagtgctagggccttggagtacaaatatgggtcttgcccttaaaaactcagagcctcatgggaaagacatatgatataaatttcataatataagtgttcaaaaagtgctaaaaagagcaactaaccgcctggagaattcaagagaggcttcatgatgaaagtggcctttgatctatgtttggaaggatgagtagtagtttgggggaaaacaagaggaataggcttttcagataaaggaaatgacaaaaacatgtgatggagatatgaaggagtaaagtggcaatgatgaaaagttagtttgttgtagcaaagagccagcagggggtttaaagtaaaggattacatgattttacacacacacacacacacacacacacacacacacgtaaatgagtttgaggctggagacagattttggggacatctgcacatatatatgtttattgaaaccttgggatcacccagaaaggacatctcaaatgagagggttgaggatggtacatttgggaattataatatttaagaggtaaatagagaaatcaacaaaggatactcagaaagaaaaaaaaattagggaagaagagaagcagtaaaaagtggtacctaagagctgggcatggaggcacgtgcctgtaatcccaactggcaagaggaatacttgagccctggaatttgagaccagcctgggcaacatagtgagaccctctctttaaaaaaaaaaaaaaagaaaaaaaaaagtagtacctggaagaccaagagtagagagaatttcagaatggagaattagtcaacatggtcacatcctatagaaaagctaggcagaatgacaactgataattgaccaatgggtttttcaactagcagattacacctgaccttttcccatgtactttcaatgtaattttgagggccaagaggcagcttcttgttttttttttttgtttgtttgttttttttttttttttttttttttgagacagggtctgactctgtcacccaggctgtagtgcagtggtgcgatcaccactccctgcagcctcaaactcccaagctcagatgatcctcccacctcagccttctgtgtaactgggatgacaggtgcatgccaccacgcccagctatttttacttatttatttattttttttgtagagatggggttttgtcatgctgcccgggctggtcttgaacttttgggcccaagccatctgcccgcctcagcctatcaaattgctgggattacaggcataagccaccacgccacaccaagagccaggatataatgcattaaataatgaagaatatattttataccttgaatgctgagatttgagggaaagaaaagtagttagaagacaatgaaaagataaattgtgtctcttttagagattctgacaggaaacgctagacacaccaaagatcttgaatggaattgtcaatcactaataattatgccaaattttactttcaaatatgtgatgccccctgcttaattcagttgcatttgttgagcatatactgtgtgatttagctaaactaccttagcatgcctagtgatttgtagttgtgtgatatgtaattcatagcctccaatgtagagttttactctcataagttaaaatgaagaacatttatggctcatacaaagagggactggattgagggtagaggagagatattcttgagttaacagggtagaagagggtaggatggaaaaggtgccaaaaatgaataggagttgggcacagtggctcacacctttaatcccagcactttgtagagccaaggcaggaggatctcttgagcccaggagttcaagaccaccctaggcaacacagggcgaccttgtctctacaaaaatttttatttgaaaattagccaggggtggggtgcggtggttcacacctgtaatcccagcactttgggaggccgaggcagggggatcacaaggtcaggagttcgagaccagcctggccaacatagtgaaaccacatctctactaaaaatacaaaaattagctgggcgtggtggcacgcgcctgtaatcccagctacttgggctgaggcaggagaatcgcttgaacccaggaggcagaggttgcagtgagccgagatcgtgccattgcactccagcctgagcgacagggcgagactccgtctcaaaaaaaaaaaaagaaaagaaaagaaaattagccaggtgtggtggtacacacctgtagtccgagctactcaggaggctgtggtgggagaatcacttgagtccaggaggttgaggctgcagtgagctgtgatcgtgccactgcactccagcccaggtgacagagccagactctgtctcaaaataaaagaggggcggggggtgggtggggccaccttaagaaaatctttgtcaacttcagaattaactggtttgcaaagggtgaaagtcaggagcaggtgggtggtagtacatatgtaattctcttgatgggagggaagcaggtggtcgaataggggcaaatcagatatccttatgctagccacttagttttctcagcagcatgagtccaggagtctcggagaaatgataaacatccaggtgatagttaataacatgagggtgggtcagataatctctggagaatgagtagagcagtgatcctaagacagaaccctggagaaaagaaacatttatggcagtgattctcagctctggccacacactggtattactttgaggtacttctaggaaatacccacgtccagttcctctctgaagcaatcaaattgaaatctataggattggagcacagatgatagcatgttcaaaaattatttagccaattttaatgtgcttccaaagttgagaaccaccaatttatgggactagctcggaatttggagcctatgaaagacagcatgggccaggcgcagttgctcatgcctgtaatcccagcactttgggaggccaaggcaggcagatcacctgaggtcaggagttcgagaccagcctggccaacatggtgaaaccccgtctctactaaaaatacaaaaattagctgagtgtggtggcagacacctgtaatcccagccactcgggaggctgaagcaggagaatcgcttgaacccgggaggtggaggttgcagtgagccgagattgcaccattgcactccagcctgggggacaagagtaagacttcgtctcacaaaaaaaaaaaaaaaaaaaagaaagagagagtgtgaaggtattgattatggagatatggggagaagaaagctattgtggtatcacaggggccaaaggagtagagcttttcaaagagaaagagcttaataacatcaaatatagcagagattacatggacatagagtgtggaataatagacatgggagactcaaatgacatagagtgtggaataatagacatgggagactcaaataggatgtaagggtaggaggggggtgagagatgagaaattacttaatgggtacaatgtacattatttggatggtggttacaataaaagctcagacttcaccactacaggatatatccatgtaacaaaactgcccttgtaccccttaaatttatacaaatttataaacatgtacctgagaggatgactaaaataaggattggaaaggatccactggatttcactaatagaaattcattggtgaccttagccaaaagagtttcaggagaatctgtttggagggaggcgataagaaaggggtagaagtaggctgggcgcagtggctcacgcctataatcctagcactttgggaggctgaggccgacagatcacctgaggtcgggagttcgagaccagcctgaccaacatggagaaaccccgtctctactaaaaatacaaaattagccgggcatggtggtgcatgcctgtaatcccagctactcgggaggctgaggcaggagaatcgcttgaacctctgtctaaaaaaaaaaggagtagaagtcagattgcattgagttctcaagtgctattagagaccacttaatttagtgtctttttttcatcacttcatatgaatcttctgatgaagtgtgtacctgtattggctatgtaatttttgtttgtttccattttctttttatttttaaatgaaaattaaattttacttttggggccaggcgcagtggctcacgcctgtaatcccagcactttcggaggctgaggcaggcggatcacgaggtcaggagatcgagaccatcctggcctatatggtgaaaccctgtctctactaaaaatacaaaaattagccgggcgtggtggcacatgcctgtaatcccagctactggaggctgaggcaggagaatggcttgaaccaggaagtcagaggttgcagtgagccgagatcgtgccactgcactccagcctggcgacagagcgagactccgtctcaaaaaaataaataaataaaataaaataaaatttacttttgggacagacatcacatgtattggctaataagatctagctttgcattaaggaagctagaaactgaagattgctatgtagtctatccttgatcattccttgacaattagagaacaaattgagcatggaccatttatcccctatttatatgcaaaattgttctaagtaagtattgatgatgttctctatagaaatttcaatcactcacttccttgtctgttctcctacacaatattatcagctctgctgcacatttcctcattggtgatccctgcaggaaaataggagataaggtcaattctagttgacttttatgagaatatgattatagcaggctttctttagttattggaatatgtgataagttaggacaaacaattatgcagcaataaatttatcttggttgttttaagttcatgtcaaaaattcagacatgctaatgttggtagctaagctcacacaactacctgcttatttacaaacttgcaattcaggaataaatgattgggatcttatatggcaagtgcatgatgccagtctaacaggagcagacgctctgtgcatttgcaactacaaaaaacaaaaagatactcaacaggttgtcataagtaccttaaaatttctagaaaattaagtgcttttacaactaaaggaaaataaacatttattctaattggtggccttgattatgggaaagtttctctcatacaggctcatttctatattattaagtattttcctaaatagggataagaaattttaagctctgcttgctttacagcagaatccatctgctttcccagtggacatcccaagacaaccagatttacctggacatgaatgtacttctgacccttcaattttcattaaacctttagatacacctcttctgtgtattaaaatttgaaccttactcctggtagttccttttcttgttgcccattaaaatgagaggagtggaagctgaaagaaggaaggaagaaagcagtaggtatcttaagcgccacagttgttttgttttgggttttgttgttgttgtgattgtttgttttgaggtagggtcaccctctgtcacccaggctggagcacaatggcatgatcatggctctttgcagccttgactctcatgggctcaagggattctcccccacagcccctcaaccccacccccagcctcccgagtagctggaactataggctcacagcactgtgcctggctaattttaaatttttttgtagacagagtctcactatgttgcccatgctggtctcgaactcctgggcttaagcagttcctttgcctcggcctctcagagtgctaagattacaagcgtgatccactgcactcagcccacagaacccttttgagatttcagttcttctattatttcttggtatcttttgcatttgcaaaataccttgaatctaagatagtgcctcacctattccgggaagccttttaaagttatgctcaaagtcaactctcttaaagatatattgatagatgatacaaagtataaaaatactatgcttataactatattctgctgttaaaagattgtgatttatttttagcatctagcacataactcatagcatatgcttttgatacctgcttgttgaatacttcacaattattttaaaaagattgaatctacacaaaagcctgtttaatatattatacctaaagctgtctctgaagtttgaaatttgagggatggaggaaatagaaattgtattctacatcactgtaaatgaaatcccattaaagctgagtttttatgagcaagctcgcatgtcctatgtatgttaccttcacgtgacctttctactcagtaatgtttatgcttgacaagtaaagaaaaatgccgactttatataaaaaacacaatgtaactgtatgccattattcttattcttacattcattgtgtttgcatttgactgctacccctatgtcattctcaactcaaatcatggtttgttccactcccacatggctacttagagggcaaattcctaaatactgccagagaaaataagaatagagtgacaataatacccttttgtttcagctttacatatgttctcgtcagtctttgcaaatactgtgatgctctataagatggggaaatagaagttagtgaatttctttagaatatcagtaagtaaataattgcttttccaactgtcacacttatttgctcagaagaatagatctttctcgtttaagggttttattcagttctacgtaatagtatgtaagactgttataaggatttgatctgtttgtttgagggacttctggaatccaggatggtattttccctttccacttgggaaggttttagcttcagattttaggtttactggtctgttctattgtttgtctagcatagatacagtataccacaagcaatacaatactctctgggcaatgaacaggaattttttttttttaatttcatacattattcacaaatctgcagtggtttcagaaagtcagtgtatatcctggacacaaagaaatgaaaaacaaaaacaagggtatgattttcatatagttctttggaaagttaatgctattgtgcatggatttcatttttatttcagttataatacctgttcgagctttagcagccttatagttattaatcaaaagtgtacatgtttatcttttttcataataaaccgatagattatctccaaatacttggagctaaactatgaaggaatgtttgtatcaggaggggtaagcaatatgattttctgtggataatccagtgtttattttaattatgtttgtgacatcatctcagttgtctatatcagtactaccttatgtggaagagataatgagaaatgacagcgctttgtacataatatttgtggatttaattctattgtcatatcatcaaccataaacaatcatgaattgaaaagaaaaaggactttaaaaagtacttttctagtacatagattttactttatggtccaaatttaaacaaactcttttgcacctggaagaacattataataagctcagttagtagtcctaaaaacccagaacgtggaagcacccagatgatgcctatccttagtgactgggtataataaattagtgagtaattattagaaattattagaaaataaatttagaaatgaagttccaacatcatgtgtttctaggaaattattagagaatcttttaaatgttgaatttccataggatacaggttgggaaggacaaatgggaagaaaaatgtcacatctaacaattgaaataatgtttttttgttgccataaacagtattgatcagtttgcatggcttatttagaactgaaacttcctggcagaggaagatgcaaagcactgagaaaatattatgggcaagttgaatgctgtccacacagattgtaagcattatagattatccctttttcacttttttcctgcttcccgtactttatggtcctgaggctttttgcgcactactttcctcactttgttctcctgattcagaagaattttgttttatctgtttatctccctcgtaacactgtttcttttttctttttcttttttgagaaggagtctcgctctgttgcccaggcaacagagtgcagtggtgcgatcttggctcactgcaacctctgtccccaggattcaagagattctcgtgtcacagtctcctgagtagctgggattacaggtgcccgccaccatgcccagctaatttttcttattgttttttgttgtttttttttttttgtatttttagtagagatggagtttcaccctgttggccaggatagtttcaaactcctgacctcaggtgatctgcccgcctcggcctcccaaagtgctgggattacaggcgtgagccaccacacccagcccctcacaacactggttttcacctccattgccccaacctgctattctacacattagttgtgggtaagaaaaactggggggaaaaatcaggaaaatataggtgtctaagcattgtttcaagtcttttatctgtcttaagtctcagcattctgtctggtttatgggggggaaaaaaaaccaagagcgacgatacacattactccaaataaaccctctcttaatttatgtaaaattgttctaatcttggtgggggtgggggaagaagcgtttaaaagggatagataaaaattcctggatgaaattcttggttgccagcctttttggaattatgacctcatcaccactggaatttacaagtgtttgtgatagtgagtaaggcatcaagtagataattaaccttttgtatttctatattaatgatttcatcaattagtatacacaattgcaaaatgactacataattattttgctctcaaaaaagtctacactcttaaaaaaactttaaaaggaaaaaatatcttttcataaaagttcctcaaactacagtgcatatttatttacatttgacaagtgtgaatgtgtttaatgaaaaggaaaaaattctgtatttcaatatgtagaacaggttggtaggtttagcattttttatttttgtctctccaaattcagtcaaaatagttcttactaaaacaggtcatacttaaattctactctagggggagttctttattattaaggcatgtaaaacaaagaaaaaaataatttaaagcactttccttataacctaattgatatgttaatgtttttctctaatattttgaaaatatacacctatgttcatccacgtgtttttgttttgttttgttttttaaacttggaggcttgctccaataaaagtaggactctgtagtgcatgtgtttatctgtttacctaaactgaagtatggccccaggaaaatagtatatttgattgattgtgtgtggtttttttaaaccaaatcatgcaaatcattttaattatgcataacttcaaactactacttaactcccattcttgacaattaaagaggttttggttctcctaattgggtgggttataaaagttaaatgttgcaaaaaaaaaaaaaaaactatgaaagaagctcaatttcgaagtatggcttcttttctgggccctataatatgtggtacatgtcctggcataattgaaggtaaaaagggtagtggttaggtggaattcatcacagagtatctcttcctctgtctccaaagctgcttttgcaccaattagctatgaccttttcttctagccttggggtgtaagattactaggggcaacaatttctgaaatattttctttctaatattagtttaagcaaatttccttgcagagctgactattctttcatggtttctggttttctttttcttttttttttcttccgtctgctgcttctttccactaagctgctaaatctttcgctgaggaattaaatgtaatgtttctagaaacattaatagcttgtgcccttttctgagtgtcctacttcagaaatattgcagctgcagtggtattacgggctatcatttcttcctgtttctctcagcagggaagttccagctttaaggtagatctgagttcttttattcctgggctaggtctcggagattttctttttctcaatgatgtgaatgccttagtcagggttttaaaagcctattgcttctttgtcaacttatttcacattggttcactatgcagctcatagtaataatggagaccgggcaagagtataaatgaataattataaatcaaaccctcctattggaaaagcaacccaaagcagggggctgtgtgggtactgtcatggtaacctcacctctagagatggtgggtggtgcgttagctctgtatgtaacagggaaaatcctccacaggctgtaaaatgttgaaagcacggttaaaataaaaacaaaccaccgttacattttttacggtagtttgggttataggactacaatgtggccaaatgaaaaggttttttaatttgacttgcgtgtggggcagagaatggcagggctttgttgaggctccctcccttgtttatttcttcccctccaaagcatgcctgttagatggttcttctttcttatcccatttcacttgtcattttatttgttttcaatttaaatatcacgctatttaagaaatagtcactgcttttgaagtttattttacagagctgtaagttttattgagacaaaataattttctaaaaatattagttgagaaaattagctaaatccttttcaaataataaaagaaggcagatttaacttattcaattttgacatctaatttgaatcttttgtgcttgttgtcctaaaagctactaccacttgttaaatttgaacaagtggagagaacaaaacagacatagtagaatattctacttaactagctttaaattaattttagattacacagaaccacatcttcattattaaagtcagaaattcaatatatattccaaattgttctactcttctaactcctttaataatgtcaagattttgtaacaggaaaacagggaattaatattttgttatggtataaatgtttttctttctaacctaacatgaaactaaaaattattttttcccacacttatgactcttaatagctaattgaaacagaactcacatgagtaatttatattaccgactacctgccacttaagcgttaatagagactgagcaagaatataaatgaataattacaaatcaaaccctccttttggaaaagcaccccaaagcaggggctctgtgaatactgtcatggtaacctcacctttatggaaagagaaataaagttttgaaataaaaggaaataagcctactttgaaaagattgtatatcattaacaatttttgtggtttatattttcctgaataagctagttttaaaacatataaacacattaagttggaagtgaatcttactaatgccagcactagttataattcatgattagcactggggcaagctgataatttgaaaatctcacagatttttactgctatttgtacccgtctatgttaactgtaccaatgataaaataataatcaaaggactgatggcttaatataatagctattgtgttctaaatatcttttatgctttgacattaaatgtctctcttgctttcgtatctgctttcaaaaatctactacccattcctgatagtatttaactggagttattagtcctttgacagtgctgcatgctattgacagtatcttttaatttgcttaatttcctgacatttgctatgttaattttttactttgggactttttaatgccagatttgtgcttaaaatagaaaagccctctactaataagatttagtcatatcacctaagtactacagagttgtcccagatgtaatagggagagataaagaagggatcacagataataagttttctctgctttccccacaaagttattactacaagctttaagtctcagcttttattgataaatataagtacaggttatctaaggaaagcctatgcctatttataatagcattcaaatctggtgttagtaattgctttaggccacaccactccataaacagtcccaaggcaatttgaaaacaggtatttgttgcataatctgtttttattacaaatgccttttgttttatgatttttgtattaaagtaatgaaactaaataatactttctggttaactagcaggtaaacgactttatgcaatatagatgtattatattttgtgaaactaccgatggtcattcaaagggaagattgttgggaaggggtggaggaaggtagtattttcaattggttacccggcttttaacaaaacaattcctattataatcccagggaatttcatctgactaaatctccactcagacgacaagcaaggagtgagagctgcagccaaagggacaaagagtggggggaaccagtggctgaatgagtcccaccatggtgccctttagtgggtcccattgtgccgtgggttagcacttctcaccattgcttatgaaaatactcagcattgaataatgctgtatgtcttacattctactcactaaaattgcttatgcaatttcaattggctatggtatttatcatttactgtcctctgcattatatagcatggttaagcctaagaagcagctgccttttttttttttaagtggatcaagcgattgttatgtattgtgtgaatatcagttcaagtttcttgagtgctgtagcatctagatgaagggtagtaaataaacattaggctcttaaaataaaaagacttttatgcgattcttcaaattctacattgcctggaaataaatagtggctattggtcccttttattttaataaaatttagatatatccaccagctgtgagcacatataaatctgcactttaatgttaatggaagttaggcatgggtatcaagaggtaaaaatcctagaagatattataaaatcatgttatgtagctcagtttttacagtggttcgaatgtaaggggtattctacatgccataaattactatgtatacaatctttaacctacaacatccttgaataaatagctttagaatcataagcttggttagtttcttttaaagtatagggaggcggtgaatgtattttaattataaaagcctcttagaaaatctgacatggtaaaaggagctatattatgtgtacacgtatgtagctcctttggtgtttggtaagagcactagttgccactctagtattttttcccattgtctgctcaggctgttttcggtctgagactttctcatcccgcagcccccacctctgtataacttttgccctgagtccttcaattgcatagactcttttctttctcttttcatttctgaggtgaatctgggagcccttatgtcccacaatttactgaagtgctataattatggcctttatcttttattaacatacctacatgctatgcttttctgtggtagcccagaatattaatgcaattagcacccttcattaagatgtactgtccattttgaatgacagctttaagtcacaggataagcctcctatacaatgggctacttttttttttttttttaaaggaagaagggaagatttgtaatttttaagaagtgaaaacttctagaaaatctttcattgctaatcctcccaaaccacccaaaaaagagcaagttttgacgttgaaacttcaggaaatcttcatactgataggatcttttccacactttaaaaagttaatccttaagttaatcacaatgaagacaccctgcttatttcctacagtggctaagaagataaagtgagatggtgaatgtgaaacttctttgaaacttttaaagtgtatttatttaaaatttgaatagagctttaaagtgtttaaagattattatcaatactatgttaaatcaatgccacttaaacccttcagtatcttcccatttcttctaggagaaatttaaattttttacagtagctcaaaaggctctgtgtgatctgacatgtatgtacattacctgccgcatctccaacagtccaacgctgtgagaaaatgtgatatccattacatttgaaccacaagactgttgttatattagaaagggaagcattgttttggtgcagatatcttctagtattcatctctcaaataagtctttttggtaaaattaagcaggattttgacattagaagacatgatgccgaatttaagttgtatgatgattattttgatgttattatgaaaataagtgcaatgttattggtttcatttatttctattatataattgattaaaataatgaacaattaaaatgtaagcaatgatttatggggtgcttaactcatagcagtaaatatagtatattgaacttacagttgcattgcctgttagacactatcaatatagaataagtctgatattttctaaatggaacaattagaacaaaccttattttaaagtgtgcctttccccatactccatgttccaaataattataagaaaacctactgcttctgttattacacgtttacaaagcaatagaaatattgcctgtaacctggccttcatagttcaactttagacttctttttttatgactacatctatactgtggaaaatgttttattttcctaggtaagctatgctattgtagtaaaatttttgaaaggaaaattattttggatcaaggacaagcaactctagcagttcagttgtttttttatctcattatttttcaatctaggaaaaatatttaaatatataacaccaatattttgcttggatagattgaagcttcagatgttttagttagaaatggactgcaaaaataatatctcttaaaaaaagaaacgaatatagtcaaatatgtgtctaagaaatacaacttgtgcatacatcctatagtatctctataaagatttcatcttgtttttctgattgaagtgttcattactagagacaaatgtatttttaagtcttgtgattagagggggccacagccatcatagctctattagaggcagaaatataacattaatattttagtgtttcatttgctttcatgaaacttatgaacagaagctatcagtgtctagggtttatcttcaaatgacaaatttagcattctgtaaaaagtgatactaggacttcctgctgaggtcatctagagtttgaccatccttagaaatgactgtgggtagattcttattctcaagtgctagaggttcttgttctctttttacattggattttgatggtgaccaacatgactgtgaaaaggaattgtaccacatgaagagatacacttatagaattacaaattggtcagtgccccttttctagtattccagaattatctgactaaaatgattttgtttagttccattttctaaaagttaaaacacaaaatacaatggacgtaggcttctgaagtgttctgagtcacccacgtgaaaagtcatggctaagattgtttatgtccctggcacataatatgtcgtcagtaaagatttctagaatgaataaataacttttccaaataaatgctctgttttatcaattacatatccctcttgtcttccttcttttcttggccaacttctttgaagtgtactgccatcatatatttttctcttttaaaatgttttccattattaaaggtaatgtatgttcattgtagaaaatgtgggaatgtgtaaaatataaagacaaaggaaaatgcatagtctcaacatccagaagcaaccacctttacattttgtttttttcttctatcttgtatttctatgcatattttacattgttcatattatactgtatacaaagttgtatatactacttttccacctaaatttataagcatttttacattaatgaatatcttgataagtctccttttaaatggttgtatattatttgaacgtaagaatgtatgatattcactccatccatcccttaaattagaaattgaatttgtttctttttttttgctaccataaataatgctgttgtaaacatctttctacatatagtacatatactatatgtagaaaatcagtacagcttttccctagaagagattcagaaagtaaatgacatgaggattttttactacttactagatgcaaagcatgattaacttgggtcaagtcagtgcataaaatctgtaatcactgatttgaatatactatatttacattctttgaacaaatattttaatatttattatagccaaagcctgatggtacaaagatggaccttaccccaaaggaatatactgtctagtatgaaaagagaaacacaataaattaaactgttaggttgagccatatgacgttgttgtttgacctatgaaaatatttatttcatgtgattcaatttaaaataatataggatgataaggataatattgaagcaagtacatggtggcttgggaacacagataagtaagtaattagatcttccgaagagagataacacagattattgctgcttattcagcagaaataaatttaaacgagggaacttttatatctgtgtaggtgtgtattagaaagctgctaggtcaggctcatgcatcagatttatggtattctgtaacattgcagcacaggaacacttcacctctctgaaagtccactcttccagcaactgtacctacctggaaatgctatctatctcttcaaaatatggcagtaaacctgaaagtaagcaaaaacaaaaatatccctcaacaggcgaaaggaatgtgatcaagtccttaaaaagcagcatgtagacttttatcaaaagagagtcttccaagtaccttactcaaaatctatttattatgttagacatagttctatcaaattggattttctatttttttcaccgtccagcaaatgggaaacagcatacataccaggattgagaggtagacagatactttaagactcactggaagcactaagacgtgatagttaatatcttgactatagtggaagagatgaaataattatcaaagcagataatatcttaaaaaacaaaaagcagaatacagactgtataattggtctcaactatgtaaaaaaaagaaataggtatatatatacgcagctgctaattaaaaaattggagtgaaatacaccaaaatattaatagtctttgtggctataccatggtatatgagtgatttgtacttccttcacattttttacaatattcttcagtgactctctgctgattatatcattagaataaataaaataataattggctgggtgcggtgactcacgcctgtaatcccagcactttgggaggcctaagcaggcggatcacgaggtcatgagatcgagactatcctggccaacatggtgaaattccatctctactaaaaataaaaaaaattagccgggtgtggtggtgcacgcctgtagtcccaggtactcgggaggctgaggcaggagaatcgcttgaacctgagaggcggaggttgcagtgagccaagattgcaccactgcactccagcctggtgacagagtgagacttcgtctcaaaaaaaaaaaaaaattaaaattaaatttgtaaatgaaaaagatctttgagcatagaacagttttggtctatttagagaagaaacaaatagacacacctcaaatatgccctacagaccttgtaggtacagcacagcacagtatttgatgttcatgataattatgcgaattagcaaaaatgtattttcaatagattgtccttacggaggcagcaaagtgtacaatatatcttcaaaatatttctatacaaaatggctaagataaaaattgttgctatttaggacgtatagactctctgctatccagatcaactcactgtgtgaggtttctggatagctgagatcctattttagcttttctattttaaaatgaaattactcaacagctatttgtcctattaaattatgcaatattattatatctaagcttcctgttctaagtgtccatagctatttgttgaggcattattctcagatgggcatggaaacaaatatttatctgattattcttttgtaaatggcccagttatatgttaaaatatatcttttttcctcaaatgtgatgtttctaccgtttgatgttgcctttgttcgttgacccttgcttttttcagactttcactaaataagagactatttacatatttccaaacgattgcaaaatattaaaatcaaatcataaattattcaagctattggggaagtttcctgtgaaaacatatacaccataaagaataatgtatttagaatatctccctgttggtagtattacaattgaagcacagttgttgttactcattcctctcctcttacatgtaataatcaaataatacaacaacaaaaccaaatatagtaaaaataaattcactgcccgtggggaagaatcttaaatattacctttattgtatatgtttgaagtatgtttgtagctttagttgcatcttcatcactccttagcagtctccttgttcattgtttactgaatcatatgcctctgctattcttccagattttctctattctctgtagtccctcaaactgaaacttgcacctgacagttttagtaaatgaccatctttttcaagttcccttcatttccctcagtgtcacttcccgaggcaaactttgtgctcctaatctcattcctcttacctccttcagaatcatgcttctttccttcttaatgtctttctttaaattgacttctttctacagaaatgctcatgtcctccttgaacttaaaagcaatcctcaggccgggcgcggtggctcacgcctgtaatcccagcactttgggaggccgaggcgggcggatcacgaggtcaggagatcgagaccatctggctaacacggtgaaaccccgtctctactaaaaaatacaaaaaattagccgggcgtggtggcgggcgcctgtagtcccagctactcgcaaggctgaggcaggagagtggcgtgaacctgggaggcggagcttgcagtgagccgagatcgcgccgctgcactccagcctgggcgacagagcaagactccgtctcagaaaaaaaaaaaaaggcaatcttcagtgataaaccaaacaataaataaacagagtatgtccctaagttactatcctatgtctagctggggagaaaagacatggacacaccaaagaagtaagagataagatatgtatataacaatatttgtgtaccatgtatgaatttgcaggcactaatacccattgatgagctctatttggctattgggactgtgcctctcctaattgtgtggcttggttggaattgcttcatctgatgtggaacctcaatagtcagtcaatgatttgttgtctctttacttattcactctttattttgaaattttcaagtatatacaaaatacaataatataaaaaaaactcatgaacccagcttccacaatgatcaattcatgatcaattttgttttctccatactgctactcttggatattttgaaacagctctcagacattatgtttttttcatctgtgaacgtttctgtaagcatccacaaaagatgaagactatttctaacgtaaccaaatactattatcatatcttactaagaaaaaaaatccttaataacaaatatctatttagtgtttacatttccctgattatctgctttggtttttttgttttgttttgtttttttgttttttgtttttgagatggagtcttgctctgtcactcaggctggagtgcagtggcactatctcggctcactgtaacctctgcctcctgggttcaagcaatcctcctgccaaagcctcccgagtagctgggattacaggcacccgccaccatgcctggctaattattgtgtttttagtagagacggggtttcaccatgttggccaggctgttctccaactcctgagctcaagtgatccacccctctcccaaagtgctggaattacaggcgtgagccaccacgcccagccaattatctactctttttggttagtatgaattggaaaccaaacaaagttgattcattattatggttctgttaagtctctttttaacaatggaatcccccttgtgttaattatcaattattcatcaattgctgcataacaagttacctttaaaacgtagaagcttaaaactacaaatgtttattatttcatagtttctgtgggtcaagaatttgggagcagcttagctgagtgatcgtttcagtgtctctcatgagattgcagtcaagatattggaccgggctatggttgtctctgggtctgaggctagaggatctactccaagatcagttcttcactatacgggcctctctatagagcttcttgactgttgctatggtctgaatgttttgtccccccaaaatacatatgttgaaacataatcccaatgtgatagtattaaatggtgaggcctttggaaagtgattacccttataaaagaggctcaagggagcatgtttgctccttcagccatgtgaagacacctagaaggtacctctgtgaaacagggaacgagcccttatcagataccaaatttactggtgccttgatattagacgtcccagcccccagaactgtgagcaataaataccactgggtatgttgttatagtagcccaaatggactaagacaagcatctttacaacatggcatctggcttccccaagagtgagtgatctaagagagaaagcaaagaggaaaccacagtgcattctgtatcctagtcttggaagtgatataacaatacttctgtcatattctgccaatcacacaaaccaacccagaaacaatgtgggagggaattacaccagagtatgaataccaaggggttgggataattggggggattcatcttggaggctgactgctccaccttttcatctatctctcctttttttcttgtaattttcaggggttttttttccattttctttttctttcttttctttcgttctttttttttttttttctcaaaatcttgagctcaagcgattctctcaccttgacctcccaaagtgttaggattacagatgtgagccaccatgcccagcccagtttttattgttgaagcaaccaggtcatttgtctgattgagtttatattttgttcattgcatcccactgtgttatttacctgtttctttgcctgtccccctactccatatattttctgtaaatttatagttagataaaccaagccactctaaagcttgatcagattcaggttttgtctttttgtcaagatgtcctttttttgttggtgttgtgaggttttatattggagcacatgatggctagtttactctttttgttatattagcagccactgatgattctctagctccattagttcaaaagagtactattctattattcctcctttaattagtttgattacttcataaaaaaaatgccccctcatcaactatttgattacatgaaggtacatttcatataatgaagggatgagaagtacttctctctttttgtcagtaagttgttgtctctctagaatcctctaaaggtaacaagtgaggtctgggaaccaacatgggtatgctgaagcagagtctccagggataggtgctggtcatggggatcttgaaaacgcttcctatgtgattctaatttggtcctctattaacttctaccaatctccattcccagagtctgacttaggtatgggagggggccaaggattctgtttttgttttttcttttaatctctagatactcctcttcagctgacaagtttggggaacactacactagaaaacacctttttaaacttactgtggctatatgcatctatgctattctcacaggccatgggtgtctcaagtttactctcaagccagctgccatgttgtaaagatgcttgtcttagtccattgggttaaggagagttgagagtctcgcttagtgctatagttatagcaaacactatggagttagactgtgtgggtctaaatcttggctctgccacttactagctttgtgaccttggggcagtgaattacctttctgcctcagtattctcacatgtaaaatggaaatgatagtaggattttcctcgtgggtgttttgagaactatatgagttaacattgtgtttagaacagggttttgtaaggatttcttaaatacataatagagttatctccctctgggagcacttccttggaacgttttattgataaaagccaaatgtggtggttactaatctcatcatgataacattgtcatttattggatgtttatatatgccaggcatgatgggttatgtatattctgcagttcacataatcctcatatcaatcctacaaaattagcaatattattttaattttacgtatcaacaaactgagtctctgagaagtaacttgctcagtgtaatagagctcataagtgatggtgtagatatgacatatattaaagaggcagcatgatggttaagagcacagaatctgaagctaagctctctgggttcaaatcctggcactaccacttcctagttgtgtatcttgggcaagttatttaacctatgtatcagtttccttatctgtaaaatgaggataatagttatacctacctcatgggttattatgaggattaaatgagttaatactttctaagcacctaaaatggtccctagcacaaaatgttgcagaactcttccttagttcagctaaagacagagttctttgtcccacagccacaaaaattcaggcccgcagacaatttgaatggtgaacaagcagggttttatttggtgaaaaggaagaaaagggggaaacatcctgctagagcaggatgttagaatcccaacttccacacaggaaaaggaggggccaggctcctccccagtgtaaacttaacgaggctccaccttagtgggcaggctgtttggagtttctccagggaccccctcccacctgactgtctcaataataaatactttgtatgtactagctcgttattattactgctattattatttttattagttagagtttaaagaaaaagcagcagtaaaaaaggagagactgaagttgccaataaggaagggaatacatgtatttcaataaatgccttaataaataaataaatcttcaggaggagagaaaaggagagttgtctcgccacaaagatgagcagaatagaaaacagttgatttctaggcgaaggcagatgattaaactcctgggagatagattcatttttacaaggtagaaatcaagctaatcctttagaaatgaagaaaggaaggtagaattggaagcctgtggaggcaggggaggtctggggacacttggggagtcaaaccacagagcacgcactagacatagccaagttgtgttttgtcaatgcttgatcatggctgaattccttgtggctaaaaaaaattatgcctggtggaggggatagctcagcagcctagtgacagcaacaagttcagacatggttgaatgggatggttatgatggtaagtagaagtgaaggagcgtggaacaaggaatcaggagacttggattcattttttaactttagtatatcaactagcttgtatgacctcgaatagttcgcttgacctttggatctcagttaattcacttgtgaaataagagagctacatcagtttatctctaacattacttctaattccagaatgtatgaccctacagggccgattctagcatctagctgcaccagaaaggagtcaattgaaatggcaagagttaagaaagtaatgggaaggcccagggaggttgggatgcaggttcaataaaagtgaaggtagatgagggaactcgtgtcagtctctcagtctttctgcctttaagatttttcttttctgcactcaaaattctaagactagtttgtcttttttttttttttgtagcaaatatcattatggctattgtgaatttaataggctatgtttgacacacacaagagtaaatgttattttagttttacatatctaaaatgttcattaacacatcagaaataaacagttcacttgtagggagttattttttttcttttaaacagaacataacaaaagagtattttatgctttcccgtgcccataataacattacattttggagtagctaactaggttgcttgaacacgctgttacagaactggttaatccataattcagcaggttcttggcttccaagttgccttattgacaagcctgaagaaagtggatggaactaattagcactcagcattataaaataggaagaattagataaagcagcttcaatattaaactcagacccctatgaagatattccctttagttatggggattttgaaatgatggacaggctaaaccaaaactcataatcctattacagtctcctacacccacctaataagcttcaagagccgtttccttggagtctgggatattgccatcttcctctaggcttttctgtatatagcttataaattctttacttgtttccactaaatactttgttatttaaaatagcataaaagagagtatataagtatatatacatattgaggtattttgactgtaataatacccttggcctgtagggaacttcaaattattaataatttcagaggaaagctttttaagaaaaaagctccaggcttagctgtaatgaggcatttgaaaaggaggaggggttatgtttatgtgcgtaatgaaaatattgaaccctttgggatgttatgaaccatggtgcactaataaatgatcttcccatttcagtgttccagcagacatctttgtacccctgatgtactcttgcaaaatgcctatagctcacatatccttttaaatatttctatctcctaacattcgttactgtgggtgggggtgcaacaggataaatctgatggagaaaggaggacaatacaagaagcagacaaagttggtggtttagaataatgagcccattttcagctgagctgtgtagttcatatgaattaattaaccccttacaaacatttgtctgacaatccaaattctcattcagttcaatgggttttatcattatcatttaactaaatagcactaagaactgttcatatcctgacattaaggaagctttgtcgaattctttttctgtaaatcatctgaagttgtttacaatttgcagtagtcttggtttgtgctcaggttgctgttttgctgctttaaaaaatattttcagggtgctaattatagaatatgctctagagtttggttagctttgtaagagtagaagacctttgtaaagaacgttttcacattttaattggaagaatgtaggcttaagctattatctgtcatgttaaacaaaaggaatccgatgatgctcaatggatatagaatgattaattactcattcttaagacctgtgccatttagttcctggtgataagatggtgataaagcactttttacccagaaagagagaaatgagagtattgtgatgaccatgctgcaacagagtgtgagaacacttaaaaaaaaaaaaagtttgaaatgagaagcatctgggacctcccttctatgctgttgtgtatgtaattgcttttaattttgtacaaaaagttaaggtactattaataagcattttacttcattgagtgtcttctgattacaaggaacaaaaagctatttaaactgggtgttcattgaacagatacagagaggctcaagggaattcagggcaggatgtattatacacctagacctagagccctggaaatgggatctttgctctcctttcaaggtggctctgtggtccttcacatcatgagttcatgggcctttaatctagtgcttgaaacgagacttcacttatcctcatctaactgctccttctacctcctgacaaagattcttgggtcccaattctatgttcctgtgacaggaatgttatctgaatccttttttttttttttttgcaccaggccccaagtctttgacaagcctaggatggttcccctgtaggtcggggtccttccctgattcaatcagctattaccattttatttatttgtttatttttattattatttttttgagactgagtctcactctgtcaccaagctggagtgcaatgaggtgatctcggctcactgcaacctctgcctcccgggttcaagcgattctcctgcctcagccccccaagtagctgggactataggcacacactaccacacctggctaatttttgtatttttagtagagacagggtttcaccatgttggccaggctgatcttgaactcctgacctcaggtgatctgcccacctcagcctcccaaatgctgggattatgctcccggcctctactatttgtattatataataacaaatttaatcctcacaaaaatcctattaggttaagtactattactatattcccttttatagtgggggaaactgaggcaaggagaggttaagtaacatttccaaggttatgtaactccagggtctgtgatgagttaggagatctggtttctaatgcttgacccatcactgtgcgaatgacttgaagtgaatcacttaatctccctgggcattcagccattccatgaacagtttaaaaattgtttttctaattttttttattgacaaactaaagggaggaatcaggtccactgccacattgtcataggcactgcttggttgtatggaacagaaatctacataaggtagcttgagtgaaggggtatttatttaaggatgtgataagcaaccttgtggacatccaaggataggaaacaacagtgagaccacagagtgtcttaggctggaaccaaaatggaaaagttagaaatataagttgctctcaggccgggggtggtggctcatgcctgtaatcccagcactttgggaggccgaggcgggcagatcacaaggtcagatcgagaccatcctggctaacacggtgaaaccccatctctactaaaaaaaaaaaaaaaaaaaaaaaaaaaaaattagccgggcatggtggcacacacctgtagtcccagctaatcaggaggctgaggcaggagaatggcatgaacccaggaggcggagcttgcagtgagcccagatcgcgccattggtttcctttgtttgaacatgactgccacaactatgatacagtatgttgcttacttcaagtgcctatctttatgtgacatgggtctctccaagttcagattcttgtgacagaatctgactgatccagctagcctgtgaatttgtttcccttaagtcaggtgttcattctgtggccaatcagccagagcagagataagatcacatggtgataggactgtcaccttttccaggcacttgatgaaagagcagattctctgagaagggtatgggaagggctggcaaatagactgatgtttgctacacccataatcctagcactctaacacaattttaaagcatattgtgtatttctccatagatcatcattttggctacataaatatatatatatgtatgtttttgttgttgttgttttgttttgtttttgagacggagttttgctgttgttgcccaggctggagtgcaatggcacaatcttggctcactgcaacatctgccttctgggttcaagcaattctcctgcctcagcctcccaagtgctggaattacaggcatgcaccaccacgcctggctaattttgtatttttagtagagacagggtttctccattttggtcaggctggtctcgaactcctgacctcaggtgatctaccctcctcggcctcccaaagtgctgggattacaggcatgagccaccgcgcccggccatggctacataaatattttttaagcacttcactgtataccagggactttactaggactacactagcttcaggccctccatttcctaatttgtaaaatgaactatcctgtcttgctttagaattcacccacacacacacacacacacacgtttatgcgtttatctatattatactgaatacaattgtcctttcatatccgtagattctacattcatggattcaatgaaaggcatatcgaaaatatttttaaaaatgacatctgtactaaacatgcacagacttttttcatgtcccctaaacaatacagtataacaacttttacatagcattaacattttattaggtattttaagttgtcaagagatgattttaagtatacgggaggatgtacataggtgatatgcaaatactatgccatcttatataaggaacttgagcatctgctaattttctggtttctgaaggaagttctgtagccaattcctcatggatacctagggatgatggtatattgcctttgttaccaaaccaaccggaattttgtttgtttgtttgttttgaggtgaagttttgctcttgttgcccaggctggggtgcaatggtgcaatctcggctcactgcaacctccaactcctgggttcaaacgattttcctgcctcagcctcccaagtagctgggattacaggcattcaccatcacacctggctaattttgtatttttagtagatatggggtttcaccatgttggtcaggctggtctcgaactcctgacctcaggtgatccacccacctcagcctcccaaagtgctgggattacaagcatgagccaccacgcttggtcccagccagaatttatttatccaaatgaatgttgtgcagtaccctgaatttgagctagagaagaaattcagtataatttcttcagttacatctagtgtttaaccaaactttagtattacccaggttacttattgatttggctctgaaatatttgttttgtaaaacaaatctattaaaagtcaaagacttgctgtcatcaaaactatttaaaaggctgtgaggcctactgtaaagatatcccaaagaaggacttcacaaatgttttttgccaatgatagaatcattccttaattctgtagctcctaaagtaactaccttgaagagcacggatcttaccaacatatgtaggttgtttaaaaaatcattcatattatgtacagaatcaaagatttaaaaaagtatacaagatacaaatacccagttaaatctatagttaggcatttgagacttaaaaaacaatttggtgggactctttactgaagtattaaaaaaccagaattctatctcacatctatttcacctactgtgacccagtatctaaatatgtcagtatacttctcttcttatgctcacataggaaaaaattggattgaaatgcttaggacacactggaaactagatgaatttagagcttttagaggaaaaacaccttgccacagatctcccctgaaccagccaagttaattaatcttggtttttgttgttgctcttgctgttgttttaccatagttatgcaaaagtaatgctgcaagtacagaccaaagccccagaggaggtagttgaagttcagcaaaatagatttaccaaatccatttgtgtttgcctggttttatgttggcatttagagtctatctttattttggtagctttgtagcctgagagtgagagagaatatatgtgtataggtatgtttatatgtattgctgacaaattcaaagacatttgattaaatatgctttatgtaagaagtgaaaagtattgtgtatattttttctttttctgtggattacaatatcttcatttctgtggttactttttgcaaaagattagtccagattcatcactctagtttctaagaggaatgaaagacaatttaaagctaaattcaaattctatgtaagtagtataatctgatgaacacacccttttatcccaaatttagagcaacaaatgttttatttaatttgagaatatgagataggaaaagtccatcataaaagtggtttcagaagctcaaaatgttaactatagcttccatgcgttacagtcccgtgatgctcatttaattctaaagtaagtcactgttgtttctagaaaactagtcatagttagactaattcctttttgttgttgttcaaagatttgaaataaatgcacaaagtcttccttctttgtagtagactagtatcctggtttctgcatttttcctgaggaattatactttaagacctaagataaacaatgtagaagaatcctctaaatgtgacttgtggattccctttgtacaggacatattctttggtgttaatcatgatcctgaatcattcctgccccagccttttgtctcatcttccctattgtacatttacaaattggccctaatgggtaagaaagaaacagacaactaaaatagctataagatgaacagcagttttttaaaaaactttaaaatatttttcacactctacaggggaataagcagataatttgcatatacacttgtggctctgtgatgttttcatataccagaatttaacacctttgcaaaatcctagcagagaccatggggatacacaattagatgcttaatctaaacctggaacaatgtgatttgggctgatttgcagagagactgtaaaagctgaaaaatcagtttgacaacgttcctgctgggattggcctgcaataaatgtttgcagtggtatttggaggccatgccagtttattcagatcactggggcttaggagatgatgcctacagtaaaacttgagttcactgcttatcagggaatgtgtgaaggctcccaggctgaaggttcattaggtcagtatgtaagagctgtcaatcagaccaagctgtcaggggaatacttttttaaaaaacaaacagaagtaaaatttttctacttaggatttttccacattgcatcccttctgccatcatatcgtccatacaagagacagcccttgtgagagagtagaatattagcccattgtaatgttccgaatgtcagcctttggccaccatcacctatgagcacggctgctgctcttagtaatcattgtggtcacttaggatgaatgggatagaatggttgtccaaagtacataagtctttaaggagttaaggacttgcatcatattcattagccccagtattttaccactgtgatggaaacatagaaggtgctcagatgtttattgatctcaacatcaagaacagaaactactatatgaatctagcatacatatggcctttaccgccccatttcccattcttggctttaacaaaatttgacaaaattatttcctgtatttcttccatattgtcaagcgtgtattgttttatagctagaaaacctattatttaggtttgattttggtgtatttactgattgagcatgactagaagaatattcgaaaggtctttgtgaaaaaaaaaaaaaaaaacatcgtattacttgtaaaggaagccaagaaggtttggaggtgcaccgtttattaggttttgtgtgaacatttaacactaaaacattagttaatatatattaaccatttagatgattgtaaaacattatatccatgtggcaagtcactaaatcaaaacacaggtaactggaacagactgacagaaaacacagttggcctcatcagatacatagaaaccatagtaggatgaccaagataaacagtatagctatgaaaacatcaagttgatgatagcatagactctaattattatcatcgatagaatgtgaatgtataataaagtgaattatatagtttttgtttaactcttgttttaattagcaccagattcagctacagttgtatttatgaatctatgttaatttctaataattagaatgaattacttcttcctaagataatactcttcctagaatggaaatttagaaaatatactctattaaatatcagttgattttctttccaggtggcatccattaggacaaacattatgaaaaggccactgaccaaaatgttgatttcctagctgacacctggaagaaaaataaacttatgtttaatggaatagactgtctaaatccctgttttgagaagagttcacattcatgaatatgtattcattgctgaattcaatagattcgagtagtgaaggacatccgtatcatagaaagtcgcatctattcattaacttacaactttccaaagaaacaagcaagaatgcagcttgagatggagtgctggcaatacgcagttcattcctttattatgtgacacgtttatcatgacctgcatgataactaatgaaataaatatgagatttgtgtattatctgtggcctaatttgttgaacttctcattttaagttacagtagcacaatcctaaatcagtattataaatgagctgtttatggttttgtcttattcagtgttctaggtgcattatgtttttttatttatacatttcaaataatttttctctttatttcttcttttctgcagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatgatattcattttgtctggtgctcttttctttctgcctaaggctttctgataaaatttatgctatatgccccttaataccgatttcatgatggttaaccatatctatgcctggaaagaaaatatagacttgggaagaaaacagatatatagtctacaatgaatatttctagcttgcattcaagatgactgtgttgtgcagaacattctgccaggcattaagtgggatacaaaagcagtctaacatatgatctctgtcctatgaatgtgtttttaaaatgtatactagtcattattggagtgactattatataaagacaaaagccactagggtagccatggttttttgccagttattagccatatatagtgcgtgcatgcacacatacacacacacatacatatatgtaatatataattttagtatatttaaattaatccatattttcaagaacttcattaacttgaacactcagaaataccctgagtgttttaagacataattgcaaataactcatgtaatgcgtatatttttatatctttgcatgtatgaagtttatacattcaggcttgtgcaaatgtgtttatatcatttgcctaagcccttgattatttacatgttcctatgtgggatcacagtccttcagatatgaatcatagcacagtgatttctttacatattcgtattctactattgagatactttaagaatcctgtgagttgtgtacctggaaatataaaattgatattattattaatccattcagaaatcatattgggcaatagcactactacatgtacatttagtagcaaacatagatagaatatttggagataatgaagatttcaatactgtgttaagaaaaaaaaaaaaaacaaccacgcaagagactcggctcttggctctcagctccaaagcatgtgaaatattcaacttaataagaacataactgcaggaagcacttctaggtcatgggagttgctatgcacaaaagaggtatggttgttctagctcagagaagcttccacatatattatttattgaggaagcctcattttaatgctgtatagagaagcccgaatgacatactcttcacaagtggcagtattggtattacagcattccaagggtgtgagacttagtttggaaatgaactgagaaaaagcaaataatatttcttaactattgtagaaaatggaggtgtcgctaggaaaattatattttcctctggtctttctcaccatttatttattccgctcaccaaggaccctggcttttgaggagaggtccatggctgagagaacattaaaaggaaagagtgaaagtggagaatgcagatgcatatttggattcaggaggaaggggaggttcaacaggtgccttctatagcagagttggttgttaagtcacactacccacaacatgctacccacaataaccacagaagaaaggttacacatacataggtctgttctcccttttatgctcacttaccacacaaatgacatctttgtgcctgttgttcggggtcattgcctaaaaaagttgagttgaaactggcaatgaagaaagaatgggccgggcatggtggctcacgcctgtaatcccaacactttgagaggccaaggcgggcggatcacctgaggtcaggagttcaagaccagcctggccaacatggtgaaaccccgtctctactaaaaatacaaaaaatcagccgggcgtggtggtgtgcctgtaatcccaactactcgggaggctgaggcaggagaattgcttgaacctgggaggtggaggttgcagtgagccaagatcgcgccattgcactccagactgggcaacgagagtgaaaatccgtctcaaaaaaaaaaaaaaaaaaaaaaggaaagaaaaacacagaaagagtggaggactttaacatttcttgagtacctattgttttcctggcatgttctaggtgtcatatgtacagcatctcattgcatcttcacaacattcctgagcattaggttttcttttcccaggtttacaggggaagaaatggaagattagagaagttaagtagcttgggcaaggtcgcagctggtgaatggctgaatcagaatctgaacaccagtttgtctaattctatcctgcatgctatttccttacaatgttccctttcacttaggggctcatgcaaaagatttatgatttccttcagattttctttggtcatagtgctctaaacacttgtagctgaatttttagttcttacctcaaataagtctgataacactactacatttttaaaaaatgagtgatataatttgtagaaatagtcactggaatgcttttaagagatttcaaatcatagagttgaaaattcatgctgtgctctaggcattattgatcctgagccatctcatgcaggtagatataaatcctcttcttaaagatctctggtgaaaaaacactttcaggcttttccatagtaatttacctcattgctgaaaatgtttacagataggtgtatgcacattgttaggaccaatgacataatgcccagttgcagtgaatcaagctaataaaataataatcctttttaaaattataatcttcaaagggtttccgaaaatcacttataggaagtttatgtgattttgctgtttctctaggaaaggcagttacgtttgaatatttaaatgatcaggccttgtgtgggtcacacagggatttttattttgcatttggattccctttatggtttaaatcacagatctctaccttaaatgcaaatgaatggagtgttgagaattgacataattttttaaattgccatagttatttccagggagctttatacctcagtataagtatcttatcctgtattataattgcttgcttgtttgtccttctaacaagaccatgagcaattggaggacaaggattgtgccttactcatcacagtatctctagtgtttagcataatgcttgacacacaggagtgatcaatagttatctattgagtgactgaattaatttctccaattgattctgcttagacaggcctttctcctacattcccccaaatgcaacctgctaattcacatttctctatcctggtttatgttatttctctcaactggagtgctctttccttcttttctccacttatataagtccacctagttcttcctggtacaactagttgctacatgagtcctgttctaactattccagatctcatagagtcatgtcctcctcatgccttgactcttttagcctatgggatgccccacacactttagccctttattatgtgcagctttatattatttgccaatttaaaaaatatttttgtcttgttttcccaaccattatgaaaagtagccatgtgttgtatcattttctctccccttcatagtgacttaagtgtggaagagaccgttggataacaaactatggcctataagccaaatccagtccaaaacctaagaatatttcttttttaaaaaattaattaattaattaatttatttttgagacagagtcttgctgtgtcgcccaggctggagtgcaatggcgtaatctctgctcactgcaacctccgccccctggactcaagtgattctcctgcctcagcctcctgagtagctgggattacagacgcccgccaccatgccctgctaactttttgcatttttagtagagacggggtttcaccgtgttggtcaggcttggtcttgaactcctgacctcgtgatctgcccgccttggcctcccaaagtgctggcattataggtgtgagccaccacgcccagcaagaatatttcttatgattttaaatggtaagaaaacaatcacaagggctgggtgtagtcgtcacgcctgtaatcccaacattttgggaggccgaggtaggtggatcacttgaggtcaggagttcgagaccagcctggccaacatggtgaaacctgtctgtactaaaaatacaaaaattagccaggcgtggtaccaggttcctgtagtcccagctactcaggaggctgaggcaggaaaatcacttgaacccaggagacagaggttgcagtgagcagagatcatgccactgcactctagcctaggcggcaaagggagactgtctcaaaaaccacaagaaaaacaatattttgtgacatgaaaattatatgaaattcaactctccataaataaagttttttgcaacattgccacgtttattcatttacacattatttatgcctgcttttgggctacagcagtagagttgagcaattgtgacagagactctgtggcccacaaagcctaaaatatttactatctgaccctttacagggaaagtttgccgactgctggagtagatcatcaatgagtacttactggttaaataattcattgtcttatgactctattctattatgaaacaagatagtctgaaagtactgttaattatgctgtcttgccttacataaagaaaaatagtaataaaagcaacctctggagaacagattatttttatcttttagttggtgaagtataaaaattttcattttctcattctctggtaaagtgacttatagtgcccttattagttttaaaccttttcaaatatgcagaacctcttcctgcagagattttaaagaacagggtaaggccaggcatggtggcttatgcctgtaatcccagcactttgggaggccgaggcgggtagatcacctgaggtgaggagttcgagaccagcctggctgacatggtgaaaccctgtctctactaaaaatacaaaacattagccgggtgtggtggcgggtgcctgtaatcccagctactcgagaggctgagacaggagaatccctcgaacccaagagacagaggttgcagtgagcagagatcgtgccactgcactccagcctgagtgacagagcatgactccatctcaaaaaaaaaaaaaattaataatagtaataataaagaacagggtagatgattatcgttctgggatggactagataacttctagtattgtgcagcccagtgattccttgaatctcctctaaatgtaaaccttgctttattagaaatgagaaatctgatttgtggatatgaagtctccgcatcccccataactccttgattctcctttgccaggacctccccccaccctccacttttggtttaatctagttcttctaattaaatatgagataattaaagttcacagagtttaaacccagcaggtttgatttaatgataaaaatcttggtttgtcagcttttcaaggcataatcctggctgctgccttatctgacaggtagtcagcctagcaggtctgaggatgaaaaccagagcatctcatcttttcaggcatgacttgctatttatcttctgaggcataatttacaattgccctatagaaaatgggtagggttaaataagtagaaaaggtctccttttgctttggctcaattaattcatttcctatgcggttgtcgatgactaggcttacaaagtagacagatgtatttcaaatgaggagaaaatgccccaaacatagcatatttgattattgtaaattattcctttactcactgaatatgtaaagtatgtaaatttagtcctgctgtcaaaaggtagctctgtaccattagtttctgcagcagacaaggcctgctgcatcctgtactgcattttcagagagataattctaatgacagcttgagcaattgccttaatgagccagaaaggtgttcttttttattcgtgtttagctgcttagagtcatctgaaatagagatcatctgtagatattacagagtgaaaaaagacatgggttatcttattaatgtgtttctccaagcatgctaagaatgaaccatcaatcaggtatttgccaagaaaatagcttgttgtcagttctgtataggtgatatggcaacctgaaatgcaagtttaggttctaattatcatgctagctaagtaaaagagttgtcaagttgcatctataagtcattttgggaaatattgtagggcttaccaaattgatcacaaaatagcattaatattgtaaacctgaagtgaacaacataaccagttttttaaaaataaggcactctacttgagtcatcaggaaaacattagaaatctacctatgtgcatcatattatatgtaaaatttagtttaattggagctttgtgttgttagaacccaacacattaatattaacatttgagacaaatttcctatcatctgagtctttcattctaagtgaaatgtccatattttctcattaatttgggtctatttaaagatcagtcacatcacagtaacataaagattggaaaagtaatgttcacattttagttaaagtcatgaaatatatacctataattgactatggtgttttgatttggttataaagtatagctgtaccttccacacggagttaagagaagtcctggcttaacacattagtggtagaaagtgtaagtttacacttaagccactccccagccaaggatttgcataaaaaatgagtgaagttcagcttgggtttatgttagcaaaatggcaaatgtagaggcacgctaaaggtcctttctgccacccttgtatacaatacatgtctgcatcttgcctaatcttaattaaatgtctttattaaatctttattaaattaataaaatgtcttctgggtctgaggactgaaattctgaaatgtaaccaatatttaagagcttaaacagtgcttctgtatagaacttgtagtatgaaatatgacttcaaaaaagcctgagctgtagaattaattttttcaattgaatgagtaatactgctttaaaaaatatacatggccgggcgccgtggctcatgcctgtaatcccagcactttgggaggccgaggtagggagttcgagaccaacctgaccaacatgcagaaaccctgtctctacttaaaaaaatacaaaattagccaggtgtggtggcacatgcctgtaatcccagctactcaggaggctgaggcaggagaatcgcttgaagccgggaggtggaggttgtggtgagccgagattgcgccattgcactccagcctgggcaacaagagcaaaactctgtctcaaaaaaaaaaaaaaaaaaaaaaaaatatatatatatatatacacacacacacacacacacacacacacacacacacacacatacacacacacatcctttttatggcctcgtgcagtggctcacccctgtaatcccagcactttgggaggccatggtgggcggatcacctgaggtcaggagttcaagactagcctggccaacatggtgaaaccccatctctactaataatacaaaaatcggccaggcatggtaactggcctctgtaatcccatctacttgggaggctgaggcagggagaattgcttaaacctgggaggtggaggttgcagtgagcagagatcgtgcaactgcactccagcctgggcaacagagtgagactctctcaaaaaatatatataggccgtgtgctgtggctcacacctgtaatcccggcactatgggaggccaaggtgggtggatcacctgaggtcaggagttcgagaccagcctgaccaacatggtgaaacccgtctgtactaaaaatacaaaaattagccaggagtcccagctactctggaggctgaggcaggagaatggcttgagcctgggaggcagaggttgcagtgagccaagattgtgccattgcactccaacctgggtgacagagcaagactccgtctaaaaaaaaatctatctatctatctatatatatatatgtgtgtgtgtgtgtatacatgtatatatatacacacatcctttttagtttaaataatccattgtattagaaagaaaaagttacactagtgaatcagctctacagttttcagaaggtgaatcaaataattactaaattgaagtacagtaagatgaactatcatgtgaaattatatttccctataaatttcttatgaaatcttgcattgatttgtgcatgtgtgtttgactaatgaagtgaagtgtgggactactatagaatttagatttaatgcctaggtaatgggtacttgtccaattacaggtcttcatgaagtttctaatgaaaaaaacactaaagagctcttcttctcagctgtatcataaatgacaaaaatctcagctccccaggcctaagtcagtaataagtggaagagtgactcttctagttactaattcatttgtggagttttccaaagttagcttgcattgtaagtttcttataaggaggatcatttcatgagagttggttttttgctattgtcacaattgtgtaatcgtccccatagaagcatgatatgcatacacttaacacattcaatttgtaattcttcttgctagtaaagccaaaaattctatcccatgcttagacatccatggaggtgatcattataatgcattatttgtcaaattttattctttttcaaaactccaaagaaaatgtgacattctactatgtctttgaatctctgattatatacatttgtttatgttaatctataacatgttacttggtttctttgaagctctgttttctagttgatgatgctaaaatttatgttaattcacatctaggtgtacttgaaatcacctaatttgaaattgcagttcttaaacagctctaagaaatataattatgtaaagaatattttgaatgaaattttgaataaattggtagaaacatagttaattgttcgctgcatcccaaaacagtaggcttggaaagtgatgcttttctactttaattttaaatcttgtacattttataagaaaggagtaagcctatccccatattaggcaagtcagattaaatgttagttccattaattcagagaaaataagctcagttaatgatgattcaatgccagttgaaaaataaacagatatgcaaaatcttggtttcttcctgtaatttcttaccatttttttcagtttctttgttgttctgttaaatctttagttaggttatggtagaatgccgtggtacctcattgttctttaactctagtgattggttgtttttaattacattaatggtagttttttgttttttttgtttgttaattttttggtatatcaaacattttctgttaaaggagaaaggaaagaagagctttgacttacaaactgacttgaaagctattccagcaattggttgtctttgaagtaggcaatttaccctttttttcccttcaaaatcagttatactacatatttcctttttgaagcaggaaagaatgaactgtgcatcacagttctgttatctatagcaaatctgtaactcctgaatcctttcttcccgaccccacccaccctgggggctacttctctaccattagtttatggtcatcagagaattacaacaagtagagcagcacagccttgtgctttctactctaaaggtattgcttccccagacaactgaaacttgagttaagcccatgccccaggaaaagaaaggtcaggaagttattttgctttctggaaggctacagagatgagagcaaaggagatgaagagccttggcatctactccagaattgcttttgactgccagacttcgatctaatctctatggcacatcatcagcattcactgtgtacctcatacacaaaagcagaagagtagctggatttctttaaaattgtgcccttcatttgtttcccttgcatgttctatttccccaattaactttgtgagccctgggcaaattagttaacctcactgggcctcaaaggcctcatctataaaatgaatggtttagaatagatgatctttgatcccttccattgcaagcattctatgctgtgaaacctcaaggctgtaaactatatgagagtaggagccaatttttttttttatcattttttttatctccccacagggcctaatgtaactttgactgtactaccttgctttcactatgtgaagtagattttgaagacagctctaatatgtactaaactcgattagaaattagacatcccattttagttgaaagtcagcttattaggtagatgttatatgaacttgcttatttcaaaaggaaaaaaaattctgggaaatgaatcattgggatggaattaagtaatcccatttaggaaaatagtactttaataataggctatgaaagagttatgggttgaattgtcacccaaaaaggtatgtttaagtcctaatccccagtatctgtgaataggaccttgtttgtgattggaggctttgaaaatgtaatcaagttaagatatggtcatactggatgagggtgcaccctaaatccaatgactggtgtccttataagtaggccatgtgggacacaaagacacacagggagaatgccacgtaactgtggaagcatagactggagtgatgcgactgccaaggaatcccaaggattgatggctaccataaaaagctaggagagagaagtgcaacaaattctccatcagaaccttcaaaagaaccaaccctgccctgtaccttaacttcagaattcttgtgtccagagctgtgagagaatacatttctgttattgtaagtcacccagtctgtcataatttattatggcagacctaggaaactaatacagaagatgtggacactggcctaggaaaagtccccaaagaatacataaagctctggactggaacagtcatagcttgcaactaccgtaggacatctactttcagcctaggatgtcttcatattttataaaatataaatctagatagtaatagaacattaagatctttggagcaactcaccattccttacgagatcaggaccgatcttatacaaaccctgatcagctgaattaggatcacatttgttataattattaccgatcccttgagagccacctttgacccagcatatcatacccacaagcctaagagtaagctgcagaaagactgtttcttagaatggttgtccattattgactaccctcttctaccttatgcatgtttcttttgtccttttttcgttaaccatttataaagttagatgctaaagaatattgagctcagaaatagtatttccaaataaacaatgtgtaaatcaatttaagctgtttacttccccattgggaataatctctcttactttctacctatgaaaacttcacccaggctttcaccatgcatagctcagatcccatctacctcatcaaggcttcgttgaattccccatttgaaagtaatctgcttgctgtaattacataacttatactctctatgtagttctgttgacacttagcaaaaagtaccctatattatagttttgtttttacatctctgtgttttattgttaaagaaaaaattattctgacacttgttaaatatggtaaggctgacttcattcagagggactactacagtggaattttgtagtacggtagtgagattaagccaaactccacacacaagaagtaccaagtggacatttatagccatgaaccagggtgggggtcgattgatggaaaattactaagaggaaacatcaggcctaagggcattccagctaaactgacttgacaggattcttgctgaagtcagaccaagatgataagatatccagagtgaggaataaggaatttgatcagataatcaagggtgagggatctgcactaaactaacccagtagtatttttgctaaaacaggactaaatgagccagggacagagcctaagtttgggtctagttaaaaagggagctcagaagaatctgactcaagtttggtcaaaggagagagtctgtcattatctcctcaatgagattctagagaataggaattataattcatactcttttgtatctctactccctactgcccccacccccatgaaaaacagtgtatgcatgtcataaagtagtttgtaattgagtatttttcattgatggttgactaattttgacagagccgacaccttaattcaccagttaaattggctctaggcacagccttgcacaactcatcattatttgactaaatgaagacaatatattctaagactctggtacagaatttctggttaacagtggttggcataatttattctcttgcctgccattttcaagtgatgttactgctttgaactcattttttaaagtaatatttataaatataactggtaaaagtgtggcatctttggccaatgaaaagaattgctgtcagcttgagaaaagaaacgtaaagcactaagtatactagaaattgcagacatcctcacaaaagtgatggattaatgaccacatacagcattatgaaagctagttatggtttgcttaaaccagtctctctctttatggcattctcaatctttttaaacagctaggatataataacattttaaaaattaaagtatttcacataaccaagaacttgatatgaaatgagcaacattaagcacaaaacaattgaagcttcaaatactggagcaggcaagaattttaaacagcccgaatgaataaggatgcaacattgttgtgcttcttcagatgcaggaataatcaggctcagaggttagcagaaagagattttatagcaataatggctccccataccatttttctcttgtgactttgactcacaaaggtgaagctttcatttgaagatttgatacaatgcagctgccaacagcaggggggagaatttggccaaatggctggactctctcaaacatctgtgagggacagagattgagagggagagacagggagaaattgagagagatataaaaggaaaagaggaggggaccaaaaagaaaaaaaaaaaaaaagatttgcattaccaatgacaaatcaaagttgaaagtttgcctttcctgttgtcattcattgccattcatatttagaaagcagactgctgtgataattgatttgatggtccagcttgagtggaagcacttctgggcatagcagcctcagagatgccaaaaaagaagaaaaggtgggaatgaaataatgcactactttctcctcagaggcatgtggcccagtttttaagagcagaaaaacatgctctggggtggggggagtagaaacctaaagaacttagtaataaatacaaaaatgaccatatagctccagtcagataaaaataggcattcaaaccaagacaatgagaggacatattttactgacaagtgaataataggggagtgtggtggaaataatctgatttttaacagactctgtcctttgggagtaccttttttgctcttcttttatatagagacaaaagtgatttcttttctaaaaagccttttaatttttaagcttttcatactagattgatagttcagaaggagaaaaagaaaacaataattgagactgaaaagctatatatgtgcccggattatgtaaacatcactgaatttccttgaagcaataggtaataatgaagcttgtccttagatttgtgagtagaggttggtgttcagccattgcttcctgctgatatgaataagttaggaaactaaagtgccagttgaagggggcaaaagagagagagagagaaagagttttttaaagtactgaattcactgcctgacctcttaatcacaactgccaattggattgtatgccctgtcattccatttaagaacctaaacaaaccagataaaagacatagctgtcaaaacacaaattttaatcagaacctgtttgtcttttgagagaaatatacttgtgttcaaaagtagatcagtcctttaactttgttacctttctctcttttcttccctctcccttctatcttcagttctcctttcttcatttacgtacctagctagctgcctctacttatacctacagagaaagcctgttgtttggcctcattgaatgtgtcatacatatgcagctgttatgcaaatatcaataccgtcccatcacaatttctgttttcctggtaaggttctcaactacagtgagacattaaattttctgagttaaaacaacaacagcaacaaccaaaaccctcaaatgtatgacttatttttaaaagattcatccaaaattaatatggaggaaacagtgttagctgtcagtataatgtatgacagtatttctgaaaatcttttaaaaaaatcatgagaattacctgggaaacttactaaaattcattatacaatgtatacctatatcaaaacatcacgttgtaccccataaatatatatagttattatatatcaatcataaattgtttaaaaatttagagtatcagaccataccccaggtcttgaatcacagtatatagtgctcaggaatctacattttaacaagtgcccagatcatttttctacatactactgaagtttgaataccagagacataatagttaaagagcaatatttaattacatcaactggaatctaattccgtttttaccattactagttgtgtaaacttaggcaaattatctagcctttctaaaacttagtttcttcatccatgaaatgtatgtaacaatgcctacctaatagggttattctgagaattaaataacataacgaatataaaacacagcacagtagctggtgattctaatatcaatacatagtcaatattattgatattgtttatcttttatgatttagaaataggttcttttctatgggttgttcatattgcgcccttgtaaataatagtttctatttccattttatattaacatagacggtacttttccatgtctcaaggatgtataagattaaacatcaggccaggtgtggtggctcatgcctgtaatcccagcactttgggaggccgaggcgggcagatcacgatgtcaggagatcgagaccatcctggctaacacggtgaaaccccatctctactaaaaatacaaaaattagccaggcgtggtggcacgtgcctgtagtcccagctactcaggaggctgaggcaggagaatcacttgaacctgggaggcggaggttgcggtgagcgatatcacgccactgcactccagcctggtgacagagcgagaaaaaaaaaagaaaagaaaagattaaatatcatccccatcacttcatcttacccagtggggaaacaaactattttaaactaaagtagtagcacatgcttactggcatagagcagaacattcttattaataccaactctatgtaaataactagatatatacattattcacatctgaatgtgtaattaaagaccatttaggtactgaacttgatgaatgagagggaaaaatgtctgggatgtcaatgtgatactgtaaataccgaaggcaattcacagtgtgactagtagcaccacctgtctcacacccaaagataattcatcaaataataccacgtctaaactggcagattctttgtcttcatagcctaaaatagagaaaagatcactagattttttttttaaaaatctaatcccaaaacttaccagctctgttacttcagacaaacctcttaaccctcagtgcccccatctataaaataaggataattatatttgccccacctcacagccttgaagtgaaaagaaatgtggtaatgtatccaggaagcatttataaactaaatgctatacaaacaaatggtgttatttcatacctattcaaatggactgaaagtcatttgaaaatgttatcaacttttgaccgtgattgtattctcattttccaaggaagtccaaaagatagattaaatttgaattcttcattgttgtgccttgctgatttttgcttgaggtgatcacactgcattgatgcatttttacacagcttttgttgaatattccttggtccaaaagctttcagctttatggctttgaagctccaattccctgatcaatgtctgaacttgtgaagcttgaaatttgtcatttggcattgacttatgtgtaaatctgagtcaaaattcagtgtcctttaaacatctcggggcaaattttcagcatggcctcatttttactgatatgatcatgtatttgtaagtacagattgccacttttgtcctcaagagagcacaaagtggtcattgcacctgccatgaggtaattgaaggtgcaaaaaatcccacttctacaaaaaagtctttataacactcccttcctttacacccctcccttctgttcctctgtgtgtaccgaaaataaaaaaaaaaaaagaaataatgctattagcaggctatgaatagagatcagcatttcttttcaagaaaaataaactgcatttaatttgggcttctcttaaaaaaataagatacccggtgtaatttaaaataaaaatattgatggaaatggcaatgtctttcataattattattcaattgcaatgttatatactccataacttaagcaaatgagtagttttgactactggaaaatagcatttgaaagtcaattatggaacttccagcacacctatagttttagtgtcctaaacttatcctctaaagttactctagaccaaaagagtaacatttgtttttgatacacccttctttgtgccagtgttctctaagtactttttggattctcgtgctagagaaaaagagctataagaaatgaaagataaacctaacctagggttttatctgttaccagaacagtatatatgttacaaatgacttataaaattacccaggcagtgggagcacttcctagccatttcctggtgtgctacctgtggccattctaagcattgactaaaaattattcacagaccttgattttattgctagtgatatatttacacatactatttagcccagattattcatatactacatatatgcctactagcccagtgcaagtaggtagtcacttgtttacctctcagaaacagcaagctgttatttttcctttttaaaaatttggctatatttgttttttggttgtaggaagaaaacttaacaagagatctaccctcttatcaaatctttaagtgcacaatacaatattgttaactataggcactatgccatacaatagatctctagaatttattcatcttgcacaaatgaaactttatacctgttgaacagcaactccccactcctccttctccccagaccctggcaaccaccattctactctgtttctgtgagtttaactattttaaatagctcataaacgtggaatcccgcagtatgagtctttgtgtgcctgtcttacttcacttagcatatgtctccaggttcaaccatgttgtcacatatggcaggatttctttctgtgtttaaggctgaatcatattccattgtacgtacataccacattttctccatttactctattcattcactgatggacatttggattatttccctatcttggctgttgtgaataatgctgcagtgaacatgggagtgcagatatcaatttgagatcctgctgtcaattcttttttttgttttttttgttttgagacagagtctcgctctgtcacccatgctggagtgcagtggcgtgatctcggttcactgtaacctccacctcctgagttcaagcaattctcctgcctcagcctcctgagtagctgggattacaggcacgtgccaccacgcccggctcattttttgtatctttagtagagacggggtttcaccatgttagccaggatggtcttgatctcctgacctcgtgatccgcctgccttgacctcccaaagttttgggattacaggcatgagccaccgcgcccggcctcaattctttcggacatatccccagaagagggattactggatcttctggtaagtctgtttttaattttttgaggaagcttcatactcttttccataatggctgcatcattttacattcccactaacagttgtataagggttccaatttcttcacatccttaacagtgcttgttaccttttcacatccttaacaatgccttttacattttttttttgttgttaaatagtagacatcctaactggggtgaggtgacatctcattgtagtttttgatttgcatttccttgattagtgatgttgagcatcttttcacatacctgttggccatttgtatgtctactttggagaaatgtctattcaaaacctttccttattttttaaactggctatttgggagcttttttgttttttattttgttttgtttcattttgtttttgagatggcgtttcgcccttgttacccaagctggagtgcaatggcacaatcttggctcaccacaacctccacctcccgggttcaagcgattcttctgcctcagcctcccgagtagctgggattacaggcctgcaccaccatgcctagttaattttgtatttttattagagatggggtttctccatgttggtcaggctggtcttgaactcccaacctcaggtgatctgcctgcctcggcctcccaaagtgctgaaattacaggcatgagccaccatacccagctgttttgtttttttgatcttgagttatttgagttccttacgtatttgacacattttgcatagttagccctttatcagatatgcagctagcaaatattttctctcatttttgtaaattgccttttcattttgattgcttgctgtacagaagctttttagttttatgtaatctcactgtgtttttgcttttgctgcttatgcttttggtgtcatatccaagaaatcattgcccagaccaataccatgatgcttttcccctttgttttcttcaaggagttttgtaggtttaggtcttacgtttaaatctttaacccatttttagttgatttttatatataatgtgggatgaaggtccaatttcattcttttgcatgtccatatccaattttcccactaccatttgttgaagagactttccttttctcattctgtgttcttggcaccccatacaaagatcagttgaccatatatgcatggatatatttctaggctctctattctgtttccttggtctacatgtctgtttttatgtcagtcccatattttttaaattgctgaaggtttgtaatatattttaaaataaggaagtgtggcgaatccagctatgttcttctttctcaagatttctttggctattcatgctcttttgtagttatgaattttacgatgggtttttctatttctctgaaaaatgccattgggacatttaaagggattgcattgaatctatagattatcttaagtagtatggacattttaacaatattaagtctttcactgaatatcttttcatttatatatgttgtctttaatttgtttcatcaacgttatgtagttttcgccgtacaagtctttcacctccttggttaaatgtattcctaagtatttcattctttgtgatactatgcaaatgggattgctttctcagttttgttttcagtactttattgttaatgtacagaaatgcaattgatttttgtatgttgattttgtatcgtgcaactttgctgaattttttaattagttttaacagttttttgtggaatatttagggttttctctatgtaagatcacgtgtcggcaaacagagatagttttacttcttttttttttcctcccaattttaatgtcttttatttttctttttcttgtctagttgctccagctagagcttccagtactatcttgaatataaatggtgagggtgggcattctttccatttcctgatatgagaagaaaaactttgtgttttatcattagtttgatattagcagtgggcttttcatatatggccttaattgtgttgaggtaaattccttgtatgtctaatttattgatagtgtttatcatggaaaggtgttgaattttttcaaatgctttttctgcatctattgggatgattgtgtgatttttatccttcattctattaatgtggtgtagcacattaattgatttgcatatgttcaagccatcctcacatattagggataagtcccatttgatcatgatgtatgattttttagaacttagtgttgaattcggtttgctaatattttcttgggaattttcacatctgttttcatcgaagatactggtctgtagttttcttgtagtgtctgtgactttgtattagggtaatactggcttgattgaatgagtttcgaagtctactctcttaaagtctttaaaaagtgttggggttaattcttcattaaatatttgataaaattcaccactgacaccatctaatgctggatttttctttttgcagagggttttgattactgattcagtctccttgtttgttattggtctgtttagattttccatttcatcatgatttacccttggtaggttgtatatttctgtgaatataaccattgcttcgagattatccaatttgttggtgtataattcttcatagtagtctcttctgatcctgtttatttctgtggcatcagttctaatgtctcatctttcatttctgattttgaatcttttttttttttttagtataaggatttttccattttgtttatattttcagaaaaaaacaattttctgtttcactgattttttttctactgcttttctgttctctatttcatttattttgactctagtctttgttatttccttgcttctgctaatgttgggcttctcctaaatttgttctttttctggctccttgaggtataacattagattgtttatttgagatctttctacttttttaatgtaggcattttatcaccataaatatccctcttagaattgcttttgctctatctcgtaagttttgttatgttgtattttcatttttgcatgtcttaagatattttctaattttttttttaatttcttcattggcccattggtttttaaagagtgtgttgtttcatttccacatatttgtaaattatccaattttccttctgctattaatttctagtttcattccactatagtcagaaaagatactgtgtaggatttcagtcttaaattcgttgagactttttttgtgacttaacacgtgatatattctggagaatgttccatgtgtgcatgagaagaatgtgtatttcacaactgttggttgaaatgtcttctgtatgtcttttagttcctcttgctcttagtgttgttcaagtctattgtttccttattgatttttttttttgcctggatgttctattcattatcaaaagtgggatatgaattatcttaccaataccatagtgctgtctgtttcctacttcagatctgtcagtgtttactttgtatatttagatgctctaatatttggtgtatatatggatttataattgttatatcttcctgatgaattgctttcattattatgtaatgacctttttcgcctctatgtcggtttttgacttatagtctattttgtgtcacataaagtatagccactcctgctctcttttggttaccatttgtgtggaatatctttttctgtctctttactttcaggctatgtgtgtcctcaaagctaagtgttgtctcttataggtagcatataattagatattgtttatttatctattctgccactctgtgtcttttgtttggggagtttaatccatttgcatttatttatttattttattttttttgagacagagtcttgttctgttgcccaggctggagtgcagtggtgcgatctcggctcatggcagcctccgcctcctgggttcaagtgattctcctgtctcagcctcccaagtagctgggactacaggcgtgcaccaccacacccggctaatttttgtatttttagtacagacagggtttcaccatgttgcccaggatggtctcgatctcctgacctcatgatccacccaaagtgctgggattacaggcgtgagccaccgcaccaggcctccatttacatttcaagtaattattgatagggaaggacttactattgcccttttgttgattgttttctgtttcatagtctttttgtccctgttttcctctcttgctatcttcttttgtgatttgttgattttttgtagtgatatgctttggttccttcttctatttcttttgtgtatcttctatagttaatttctttatgattaccatgaagcttgcatagattgtcttacagttacagcagttctatattaagctgctgacaacttaactgcactcacatacaaaaaccttccacttttacttctccctcaccatactctgttattgatgtcatagtttaaatctttttatattgtgtatccattaacaaatttgtgtagttataatcttaatatttttgtcttttaactttaatagtagagtttaaagttatttacagtccaccattattgtagtatccgggctgggcacagtggcttctaatcccagcacttcaggaggccaaagtgggcaaattcattgagtctaggaattcaagaccagcctgggcaacatggcaaaaccctgtctctattaaaaatgcaaaaaattagccaggcatggtggtgcacaattatattcccagcttctcaggaagctgaggtgggagaatcagccgaggctgcagtgagctgtgatcatgccactgcagtctagcctaggcaataggaatgagaccctgtctcaaaaaaaattatctatgtctatatctatattatatatatatagtattctgtgtttgtctgtatgcttgcccataccagtgtgttgtattctttcatatgcttttgtgttactgttttagcatctgttcatttctactggaagaactcccgttagcatcatgtctagtggtgatgaactcccgtgccttttgtttggaaaagtctttatctcaccttcacttttgaaggacaattttgccagatatagtattcttgattggcatttttttttctttcaacactttgaatattataagctcactgccttctggtctgcaaggtttctgctaagaaatccactgatagtcttattgaggactcactttacatcacgagtcacttttctcttgctcctttaaaatttttctttgactttgtgcaatttgattatattgtatctcagtgtagacttctttgggtttgtctaatttggcattctttgggcttcatgaatctggatatccatttccttgcccagatttgaaatgttttcctccatgagttctttatataagctttttcccctgactatctctcttctcctttgagattcccataatgaatgtattggtctgcttgatgatgttcagtaagtagcttaggctttcttcattctttatcattctttgctttttgctcctctggctacataatttggatgacttgtcttcagtttcactgattccttctgcttaatcaagtctgctgtttaatcactgtagtgatttttcagttcagtcactgaaccagaatttctgtttggttatttttatttatttatttatttatttattcatttatttattcatttatttattgagacggagtttcactcttgttgcccaggctggagtgcaatggcacaatctcggctcactgcaacctctgcctcccgggttcaagctattctcctgcctcagcctcctgagtagctgggattacaggcatgcgccaccatgcctggctaattttttatttttagtagagacggggtttctccatgttagtcaggctggtctcaaactcccaacctcaggtgatctgcctgcctcagcctcccaaactgctgggattacaggcgtgagccaccgcacccggcctggttatttttttttaaataatttctacctctgttagggccagatgtggtggctcatgtctgtaatccagcactttgggaggccaaggcaggtggatcacttgaggtcaggagatcgagaccagcctggccaacgtgatgagacaccatctctactaaaaaaaaaaattacaaaaattagccagttgtggttgcacatacctgtaatcccagctactggggaggctgaggcaggagaatctcttgagcctgggaggcaaaggttgcaatgagcccgagattgtgccactgcactctagtctgggtgacagagtgggactccatctcaaaaaaaaagaaaaaggcaactcaaacaacaacaaaaaaaccagcctgagctgggcatggtggctcacacctgtaatcccagcactttgggagtctgagatgcgtgaatcacttgaggtcaggagtttgagaccagcctggccaacatagggaaaccccatctctacttgaaaaacatatttatatatatgtatgtatatatttgtgtgtatatatatatatttttttatatgtatatatttttttgtgtgtatatatgtatacacacacacacacagaaaaattagccgggcatggtgtcccatgtctgtagtcccagctactcgggatgctgaggcaggagaatctctttaaccagggaggcggaggttgcagtgagctgagattgtgctgctgcacttcagcctgggcaacagagcgagactctgtctcaataaataaataaatacatacataatttctacctctgttgacattctcattttgttgctgaattattttcttaatgttgttcagttgtctatattctcttgtaactcactgagcttccttaagatgattattttgaaatctttgttagcctattcatagatctccatttctttagagttgtgtattacgatttaatttgttcctttagtgtaatgtttcactgatttttcttgtttcttatacttttgcactggtgtctgcacatttgaggaagcagccacccttcccattctttctggacttgtttagacatggaaagagcttaaccaattcactaggctagagattctaggagcctctcaaaccttttctatgaatgtgtcttctctggatttgtgtgggaggattcctaattagatggatttacccctagcacaattcatagagccatgctaatgtcttctgaggcaggacagaatccagcccgaccctggtggttcactgaggccagattgttgggaacatgttccatttctctcctatcacagtggaagaagcatcaggctctgtgccttctctcaatcttgtagagctatgctcaccacagtaagctgcttgccctttttcctttgttcttaattgccctgaaacatccaagctatttcttttctatcagtgtcccatgtgaggtgagatagaaactagcccttcaggcagtgcaccaaaaggctggtacattggaagcattctctactctgtattttcccctgagaaagaaactgtgggccaaagtgatatttttcagtgctgagctgtgatggcttgggggaaggggctaatactagtaaagtgaaattgctccttactcatttcagtagagttttttcagttttgtgtttctctggtgtactgcaacctcttaaaaggattctggtcttctcataaaggtattgtggtctacattgttaagttggtgtttctatgggagaacaagagatggaactttctatttcaccattttgatgatatcagcaagctattatttaaatgagaagtttcctttacttagatgagcaatataatttaatgcaagtttgtctatggatttctccttgagtgactacattacaaaaggccatctggaattccctttctacacatcactgttaaagcaaaaaactatatttaagtggtaccaaggtatcaggattccctgcagacagtttgagatctaatataaaatcaaaaaccccttataggccactggtctaaatgatgacagtaaaaaattcccaagactattaagttttattaatgaatatgatggaaaataagatcttggaatgtgaattaaatgtttttaaggtgatgagtgggtaagaaagagaggtgataaaagtttttgaaaacttgttttcaaagcaatactattacatattaaatatacagtttaaacttttctcatcctgctgacaaatacatacctgagccaagattactgttttgtttcattttaaccattcccctacatggtaatatctatagtgaatgaccatttctggagagttttactttgatatgttagcacatcattacctgttaggtagccccaaaatgtaaataaattatacctcattccatattgtcaaaacatagaaacagcaacaaagatacctaaatgaaagaagctgtgattgtttttcaaaaccaaagaagagaagtgtaagaaaagcattgaatttaaggggcagaaactatcccagaaagttactgctagaattcaaatactaaagaaagtaatagaattatacctttataaagatcaagggtaacaaatttgaattggtacctttttttttttttttttttttttttgagaaggagtttcgctctcgttgcccaggctggagtgcaatggcgcgatcttggctcaccacaacctccatctcccgggctcaagagattctcctccctcagccttctgagtagctgggattacaggcatgtgccaccacgcccagctaattttgtatttttagtagagacagggtttctccatgttagtcaggctggtctcaaactcctgacctcaggtgatccacccacctcggcctcccaaagtgctgggattacaggcgtgagccaccacgcccagcaagtaccattttcattcttaaatttgttcatatgttaaaaaaaaagaaaacataagcatgctttagttttccatcttcacattaggtaacacaatgaatgaatgaatatagttattttctaatactctcacacagattggttcttccatgggtaaatagttctctgtagccctgaattagattttttttttttttttttttccgagacggagttttgctcttgtcaccaaggggggagtgccatagcactcaccatgtctcaccatgttggccaggctagtctcgaactcctgacctcaggtgatccgcccacatcggcctcccaaagtgctgggattataggcatgagccactgcacccagccatgaattagattttgattgatgaaaagggagataataattccaataatcttatgttccataaatgaaattttaaaactgatacatttttatatttaaaaacttcaaaataaatagaaaaatacaactttgagttgtagttttttttagtggtcaatctgatgagcttgggcccgtataaggtatgttggacaagaaaacactatcctaatcaatgttgacttaactgaattcattcagataagtggaaatattgttagatttgttgactggaaggaagtctgagtttgattagtccaaaggtgatttgaggaaaggtggtaagctgaacatgacctcccctgagtattactgaaaggaaggagaatttgaaccaaattttaagatttggccaggaccaaataagatatcattgcagaaaatctgtgctatatgtcaatgacccttcagaaaataaaaagtaaagataaaatggagttggcactccatctctggcctgtgtgtgctgcccccacccccacgcctcccttctgtctctcaagttttgagatcacccctgttaacctcctcttctcttccctggctcagccaatttgtaagctctgatcacatttttttttttttttaccacattctctttgtaccctatcttttgctttcttatagttgcttaatattgtgtaacggaggccaggcacagtggctcatgtctgtaatcccagcactttaggaggccgagtttggcggattacttgaggttaggagttacagaccagcctggccaacatgatgaaaccccatctctactaagaatacaaaaattagcgaggtatattggcacatggctttaatcccagctacttgggaggctgcagcaggagaattgcttgaacccgggagttggaggttgcagtgagccaatatcatgccactggtatattggaagcattctctactctgtcttttcccctaagaaagaaattgcgggccaaagtgtgtaagggaagggttaaaatgagtgagtgagtctctctctctatatgtatatatatatcatataacagtctttttctaattccaaggaatagaggcatgctaaagtttttaaaggtaatatagggttaagaaaatatgaggaagaaatatcacagtggtctcccagccatggctcatcaaaactagaatgttctgactacaacagtggctctggaagtctgacagcacctctgacatattgaccaccctgctggtagtcttcctttaggagcaggtttgtgcttgattccagttgtaacttaccaatccttctattcttatgatttgccattatggtgtctcagctactgcatttttatttttctgtctatctaattcttcttttatttccttaacaatgaatgaactctctgttctcctttctatatcagggtatctgcttatttatggtttctactgccatgtggcttttaacatcctctctctcttagcttctgcttctgcctaacatacatatccgtttctgcatgtgtctcattaagttaccccaagaaaaatttggtttgtttggttcagagcagagattttctgctggaaaaatctctcatggcaatctatagatagttttctttggtacgtactcattatctaatctcttatgattggggtcatacgaaaccaaacattgtgacctatatgtaaagtacctctttagcaggagactctaaggtatctcagaagagagtagtacaacagagatattatttacagaatattctgtatattgagcccttacatcaggagacttgaggtactagatgtttacttttactatatatcattgaatcaaagatagtatcaatcataagatattacattaatttatttaccattgagaaaggaaaagatgctgccaatgaaatcacagcacaccaatgattgttagatgcatctcagtctcagagatgttaaaatgtgaaaaaagtacatttttaaaagatgtaatgtggtgtcagtagcatatctgagattgtctgaggatcaaagcaggtatagtgaacccccagagaagttccctgaggactgactcctagagtggggtaaatgctaaaggttacaggttggattactaatctgacagaccagagggtagtgtctagagactagatagccagctatctgtctgcaagtggagaggaggccagtcactggtccagagtgtggtttgcctcagggacttggcagatatcagaaggtagatccaaggagaaggtgaattattcctgtattgatttaaatgacatgaatatattgggaatttctgtttctcttaattcctcatttgtgttctgggatcaattcagttgtgtctcttatcttctagaatatctccttgtttattacttgtacattaactatatctctggatgtagggtcattttataaaccaaatgctgtattttgtccatgaggcacctaaaatagcacagccagggatagctaagcttacagttgtgatacattaatgaataacctctggttgttgactccctttttgttattgggagagttaatgtagcttttttcaaatttttagattcagcgggtacatgtgcaggtttgttgcataggtatattgaatggtgagatttgggcttctagtgtacttgtcactcaaatagtgaccattgtacttaatagatttggagatttctcagagaactaaaaatagacctaccattcagccctgcagtcccactattgggcatctacccaaagggaaagaaatcattctatgaaaaagacacctgtactcatatgtttattgcagtactactcacaatagcaaagtcatggaatcaacctaaatatccatcaacagttgattggataaagaaaatatggtatatgtacaccatggaatactatgcagccataaaaaagataactttaattataattatgaatcaacatgtctttctttccatttctactatgtaaatagagcagaaatcccacattaatgtgattagcatagaagaaagtcctcactgaattccccttgctctcttaccaactggctggacatggcataggtggttatctaagaatactcccatgaatcttcacagcattcagagatcagtttactctgggtttgttagatatgcgatatgggctagctgtttgttagaaccacatttcccaatgtgtttccactgaacacttattttttctgatgttgctacatgtcttgtgtaaaaagcattgggtaaaagtgctgggtaagttaaagggctctgataactctatataatgtatgtagatttctggctgaatctttgggtgtttactgctcatgggttccactgctattacagcccaacacagctggtatgatttgcaggttggtctcttggggccctttcaccttctgagctctgaaagcctaagataagcaatttttcctttgtccttcaagatgactgtggtctcagcttagactcaagagaactcgtttgaaattgaacaagagcaagcctagctcaagaggatagcaaagtgcctagttttatttgtcactgcactagaaacttcctaaggaataatttttaaaagggggccagttttgtttctgagactcaactagactttcactcatgctctgggggaaggaattcaagtctccaacattgtccttattgtacacctgtagggccagactgattatcctaaattttacatagcctaagaatgagcttagatttcaaaataaaaagctttctctgcttttgcgtagaacatttctatctattatttcagttaatttatccttgttatcaatattgaagtaccgcttgctatacatattctagacatgggtaacaatgtctagaagtacactctgatttcacaacagccattcaaggagatatatatatatatatatatatatatatatatatatatatccttgcaagtgcattctagggctgctgggacatgtgttcttaaatcctcctttgccagttctccaaatatgccaaattgttttgaaatggcattcttgtcttgtcttgttgaatctacacttctattccttccttttgctttttattccaaccttccattttctatcctttaattaaaaagatggctaatatatgggagatgttgtagtccgttgttgtctaaaatgaatttagcagacactcccccaccattccccctccccaagttcagcatcaggaataaaagtctcatcagtccttttggcagcatttaagtgaatggcccccagtggctttatgcttgctaatttgagtactctttttacgtacagagctagtcagattgacagaccacactgtacgaagatatatactagtctttgagtcatagattttgtaaataaactgagaacagtggctgaaaatcagattacctgaaagtctggaaggaaaaaggcatagaatgacctcatctagtctcttttcaaaagcactatatatatttcaaattttagagtttctagagacaattagcaggcagtagttgcaagaataggcagaacccctgtgagatgtataagctgtatgatcttcattaacttatatctaaaagtttaacaaacatatactgacattatttttaaaagacaagtatgttaaggaatttgtcttctacatagtgacaggtatcaaagtgaagaatatggccttttgtttttttcttactatatactaaaatgttgctttatattaaaagatcgtaatttatttccatgaatcaaattctgtacttaaaactgacttctgtttatttatatactgttgtgtgatagaaattctcttgggggaggcaatagaaatattacatgccttttaataaagcgggcttttaaaataatttaattcaacttttcacctcttatgaaatttttgaaaagatattttctaatttattttattttattattttttatttttgagacagagtctcactctgttgcccaggctggagtgcagcatcgtgatctcggctcactgcaacttccgcctcctgggttcaagcaattctcctgcctcagcctcccgagtagctgggattactggcatccaccaccaagcccaactaatttttgtctctttagtagagacagggtttcgccatgttggccaggctggtcccaaactcctgacctcaggtgatccacccaccttggcctcccaaagtgctgggattacaagcgtgagccatcgtgtccagccttatttttttttattttaaatagagctctccaaataatgtctgttttgtattgaaatgaatgaattcatgaacttgctttcttcgcagcatgagggactaacagctagaataaaaataatcaacctaatatttcttgttgctggaaaataattatgagaatattacacagaggaagccatgcttaaaataaaggcttcatattgcatttaaaactcaggcgggactttcaaggattctgtttagtagaataatatattgatgaacccttggagaaccaattatgttgtttcacatgaattacaaatgcatcatttagctgtattatagtcttacatgtgtcctttacaattaatcaccattaaatgttagaaatgtaaaatttaagaggcaaagaaagcatacttctttaacaaagtggcccaaacaaataccagtattttaatttgaggtctgtaacaggtctacagattttattttctcattttgcaagatcagtgtatgaatctgagttcttttaatagatttttcttgcaaaatcttattgttaattgcaaatgtaagttgtgacagtaatttttagtataccactttagacttacttctggaatttgagcaacagaaacatattattagaactttttattatttctgtagctatcttttcaaatatttccaaaacgtatggctttttaagcctttgcctctgcaagtcacaatttcaagtaggcgctgaaattctagtaacgtgagcagtgcaacagtacattgagtcttaccagtaagttttagtgaattatttaggaagtgaacgttgattcccttatgagtcagtccagcctctttctgaaaatagtgttgttcccattatgtgtaccattttgcaggaaaatattgtattccaaggaactgggtgttatcagtaattaagtaggcagaacccatagatattgaatagtttaagttgtaaatgtgataaacttctataatacaaatatttgtggacagaaaatgctgtgagatatggaagcacaaagtagaagtagcatttatgaactgttactaagttccagacattttactaagtgctgaggatactgagataaataagaaataatccctttcctcgggaaattataccagtggtagaaatactccaaagggccaacagtgaaggaatcacaatgaattgacatattatgtactaaatagatctgctcacatcctgaggtctccaggcaaggtttacatgcacttgaactgccctgcataattgctattctgctgacaaaagtataggtgtggtatggtagagctcaaaggactctgagaagtcatatagtccaaatccttcattttccagaagaggagaaccaggcccagagagggtgaagggattttctccaggtcatgtagcaaactaacgacagttgggactataatgcagatttcttgatcctcagtccaatctttcaagtggagataacctcaaacctttttgtttccccattctctactttaagcaatggcacaagaagtccatgggaaaatgaaattccctaaatggggaaaagaggaccttgatagaacgctcatgagatcaataaagaaattaaaggacagggtgaaaaaatgtttaaaagtatgtagggagcacatatagaccagaaagaaaattaagaaaatcccagtggcaaaaataagagaattgcaaagaaagggctgaaataattatccaaaaacaattctttttatgggtaaacaggctaaaatgccataggtctaattttatgcattcaacctgcttcagaattttttttcaaactaaatagtcagctatgttaagtagcctcacattaaatggaagaactctctattatttagcacatttgtatagttgcaacgtagtgatgagtgatgtgtctaatgatggccccaagacagtgtaatgccccaatgtaccttttgagctattgaaaaatatttctattatgttcagcctagttttatttttaactatatttaatattcaaaatcttggaaatgggagctatgtttataatatctctggcaattatctataaatacatctaagttgatcgcagcacttcatatcttagataggctgtatagtagagactttactgtaacgagaaagatcctgaattgttaccctacttgtcttcccagatgttttctttgttaggctttttgggatttctgatttttcttgctctttttcttataaaatgtgaaatatatagcctgtgataatgcttggctgccctgcccaattattgaccaatgtcgatccaattatgcttttaaaagtatatattatgtaaatagattattttaccttctgctgccttataaatctttttttgtacagcagcaagggaagattataatgtcattggctgtcaaaatgcccttttcatgtaagtcagctgccaggcaaggatcctacatctgttttctagcatccatataaatgtctgtgataaataagtcattgctcactggagctgcctttgtgaagcagatcctgtacttactgtttctttcacatgcaaaatgacagcagtcaacctaattgactattacttggtcagtttctgtgtcagaagtgatgccaggtaagtaggagaaatccaaacttaatgcatttctgtttaaacccagaaagatttagtaatagaaaaaacagcaccaatttcaggtttttcagagatgagtgtgttcccaaaggatgaacttgacactactgcattctttctcacaacctaaactggattcttctatgaatctctgagtgaattcttagtagacacattgacatggtataaaatacatcacacggctgtaataaacataggttagaattgtggttcagttttcagccaaatgccaggataccattttcatatgtagtctttcctaattggaaatctagaggatggggtacaaaatagtcatcctaatctgttcaaacatcaatggacaattatgtctctaaaattctcaatactttgcaattaaagagtttttgattcctacattgcagagcaggcctcttcttctgtgactgatgctgccctctcttttctatgtcatctctgctttggaatcatcatcattacggggcatgataccagtcatgttaggccatgctgctgacaatggttactttcaacaagggggagtaaccagggaaaggacatccatcattatgtaatgtaggggaaaaaacccaaagactcagaagccatgttaacaaacacagctggaagcaaggaggcatttgagtaggattacaaacatcttagattgtgcagattagtactagatttagggaaaacatgaattgaacaacctcttttgcacaaatgagcaacctggagtttgcagtaatggagccaatagcctcatcacattttgaatccatttggatgtcatgtaaagaatgaacatatgcagtacttaataaagaaaggtcaattctgccatggtgatcactgaagcataatgcagcaaatgaggtagggcttttttttttttttaactcatcaatcctagaacatttaaatttatcttttcagtaagttgagggatttttttaaatctcctgcatctgttataacctaaatgaacagcagttcaaagccaactccacacctgtactgacatactaaaaatgtcaaataatttgtataaaaatgctgagatgcagtttcactaacagtctgttttgtcagtgtcctccctatttatcagattctaagaggattgttgggttgatgtggctctgtatatttccaattccctcctatttttggattgtactgctttgattatagttaacaaccaaccttgcaagaattcaagatttgtcatagctacaatactttttccacctcatagctttaacagtggcatttgtatgttacccaaaccaaaccactgagttcatcattttcatccaaagaagagtagcttccttgattttcagcataatgtttctggctatctagtgcctttttttttttttttttttttttttttttgagatggagtctcattctgtcgcccaggctggagtgcaatggcgccatcttggctcactgcaacctctgcctcccaggttcaagcaattctcctgtctcagcctccagggtagctgagactacaggcgcacgccatgaagcccggctaatttttgcattttttagtagagatggggtttcaccatattggtcaggctggtctggaactcctgacctcaggtgatccgcccaccttggcccccgaaagtgctgggattagaggcgtcagccaccatgcccagcccttttttttttttttttttttcagatggtaaactaaaaggaaataaaattgtaacctcagctggtgccataattctttcttggcttatagtttctgaaaggtgttgaaacgattacatatttatccatgagttccaaaattgcccctctaattcaagtcattagaaccttcttccacctacaactcatttgaactgtttttcattaaaagtcatgtccaagagtcagttcgagtgtcacgttatttggtcattccagctttcctcctgagtcttgtaaccctgactatcattagtgctgtatatagttctgtccacttgtctccttttcttatccagtagttcttggagggcatcaactatgctatctttgttgttttcacattgcttatacattgtggagattgaatacatttttgatttttaacaaacgttcaatgtgctcttactaaagcttggcaatgacctagatcaggggtttgccaactatggtcagtgggccaaatccagcccatggactagagctaaaatgttgtttatatctttaaagagttgtaaaaacaaagaagaatatacagcagacaccatatgtggcccacaaaggctaaaatatttgccatctggcccttcacaaggaaaatgttgctggcctttcttccagatgctgaggatacaccagtgaacaaaaccgacaaaaaaaaaaaaaaaaaaaaaaaaatccctaccttcagagagcataaattctatttttttacaacaattttatgcagaatacgcatcttatttttgtaaatatgcacaatatttacatatagtacatactcaatatttgtgaaatgaatgaataagtcatagagtccatcatccaatattatataatattggcaaatatttccatatgatgtaataaaatgttgcattttttaaatctttatatgaagaatttttccctagataatttttagaccaaaaactcaaacactacttacttgtcaagacattttattctggtacttagtaatgatttcccatcttaatgtaacttttattcatgatgaggtcctgattatctagcctccttatgagaggtaatcataattatatttgattctgaaagctttctgaaatggtgattctttcataagagatcattttgtatacgtgacagttaaaacaatgagttagtttttcagagtttctatccttgaattctacaagtttgtgatgtttatagcttgaattcagataaaaccattttgctccacatttgaaacgacaaatcttttgcattagactcagagttgactaaaactatggcagcttttcataaagtcaggctatagatgtccctaattcccccacagagcccacagccctttgaaagtgatgatagaatactggggatggatcagagagtgctgagaggagagtggaagggaagaagggacaaagggaaaggaatccagagtgggaagagttggattcgtagagccagcagatggtgttggtgataaagaagattacgtgactcatttctgtaacccatgagtgtcaaagttctccactcagtgccatgtctccatcccattacccccacctaaataagttatctgttctaacacccatctgtccccacaccaaaccatcattaccagcaagcaatttcttgtactgtcctttatcttttaaatattaaaaattagaagtaaatgagatgtgagatctaaaaaaaaaatgacatgaccttttatttatttccactggtcttttaatctaggctgcccttactcctcatagactatacactgcctcttagatactacactgctattagtctaaatactttgctttattatggaactgctcatttcttattccttgcatagatttagggttgataaactgagagtttaaaatgcagtaatggagaatcttaattataaatgaaggaaattgaaacatactactgtatgtgctgatttactttcagattcttgacctttgtcaagactaatgagattacacatctagtatagagaatggatagaaattttaatagacctgcctaatttacattgttaggaattctgtaaaactgagagttatgccagcaaacctacatgtgctgtctttttaattgcatttctccccaccaccagcccaccctcattccctaatatctgtggttagtacctatggagtcattacttacattatgaagtgacaaacataggaaagcatggctttgttctctgaatgcagataactcatatccatcaaagtttctaatttacagagctttcctttgaaggaggctagaatgctgagtaatgatgaaaaagcaacatttgttaaatctgatttggcgcaggacttctttttctacaaagcagtctttcataataccagcttgaatctaactatttctcttacgtagtatagggggaaagaaatatcttttcttcccatcttagattcatagctaggaccccttaacaacaacaataacaacaacaacaaaaaaaaaacagattacccgactaccaagagaaaagcatacaaagttatttatttatttatttatttatttatttatttatttatttattattttttgagatggagtctcgctctgtcgccgaggctggagtgcagtggtgcgatcttggctcactgcaacctccgcctcccaggttcaagcaattctcctgcctcagcctcctgagtagctgggattacagatgtgcaccaccatgcctggctaatttttgtatttttagtagagatggagtttcaccgtgttgacgaggctggtgttgaactcctgacctcaggtgatccacccaccttggcctcccaaagtgctgggattacaggcgtaagccactgtgcccagcccaaatttatttaatatacgtaaattttatgtgacacaggaaatttaattaggaaataaagacccaaagaaacaggaaaacctgtgtgttcttttttttttttttttaaattggcattcatgttgctttttttttttttttttttttttttactattaggaacttttattattattatactttaagttttagggtacatgtgcacattgtgcaggttagttacatatgtatacatgtgccatgctggtgtgctgcacccattaactcgtcatttagcattaggtgtatctcctaatgctatccctccccactccccccaccccacaacagtccccagagtgtgatgttccccttcctgtgtccatgtgttctcgttgttcaattcccatctatgagtgagaacatgtggtgtttggttttttgtccttacgatagtttactgagaatgattatttccaatttcatccatgtccctaaaaaggacatgaactcatcattttttatggctgcatagtattccatggtgtatatgtgccacattttcttaatccagtctatcattgttagacatttgggttggttccaagtctttgctattgtgaatagtgccgcaataaacatacgtgtgcatgtgtctttatagcagcatgatttatagtcctttgggtatatacccagtaatgggttggctggatcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattctaactggtgtgagatggtatctcattatggttttgatttgcatttctctgatggccagtgatgatgagcattttttcatgtgtcttttggctgcataaatgtcttcttttgagaagtgtctgttcatatcctttgcccactttttgatggtgttgtttgtttttttcttgtaaatttgtttgagttcattgtagattctggatattagccctttgtcagatgagtagattgcgaaaattttctcccattctgtaggttgcctgttcactctgaaggtggtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattaatttttgtttaaggtgtaaggaagggatgcagtttcagctttctacatatggctagccagttttcccagcaccatttattaaatagggaatcctttccccattgcttgtttttctcaggtttgtcaaagatcagatagttgtagatatgcggcgttatttctgagggctctgttctgttccattggtctatatctctgttttggtaccagtaccatgctgttttggttactgtagccttgtagtatagtttgaagtcaggtagcgtgatgcctccagctttgttcttttggcttaggattgtcttggcaatgtgggctcttttttggttccatatgaactttaaagtagttttttccaattctgtgaagaaagtcattggtagcttgatggggatggcattgaatctataaattaccttgggaagtatggccattttcacggtattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactgctgaagttgtttatcagcttgaggagattttgtgctgagacaatggggttttctagatatacaatcatgtcatctgcaaacagggacaacttgacttcctcttttcctaattgaataccctttatttccttctcctgcctaattgccctggccagaacttccaagactatgttgaataggagtggtgagagagggcatccctgtcttgtgccagttttcaaagggaatgcttccagtttttgcccatttagtatgatattggctgtgggtttgtcatagatagctcttattattttgaaatatgtcccatcaatacctaatttattgagagtttttagcatgaaaggttgttgaattttgtcaaaggccttttctgcatctattgagataatcatgtggtttttgtctttgactctgtttatatgctggattacatttattgatttgcatatattgaaccagccttgcatcccagggatgaagcccacttgatcatggtggataagctttttgatgtgctgctggattcggtttgccagtattttattgaggatttttgcatcaatgttcatcaaggattttggtctaaaattctcttttttggttgtgtctctgccaggctttggtatcaggacgatgctggcctcataaaatcagttagggaggattccctctttttctattgattggaatagtttcagaaggaatggtaccagttcctccttgtacctctggtagaattcggctgtgaatccatctggtcctggactctttttggttggtaagctattgattattgccacaatttcagagactcttattggtctactcagagattcaacttcttcctggtttagtcttgggagggtgtatatgtcaaggaatttatccatttcttcaagattttctagtttatttgcgtagaggtgtttgtagtattctctgatggtagtttgtatttctgtgggatcggtggtgatatcccctttatcattttttattgcgtctatttgattcttctctcttttcttctttattagtcttgctagtggtctatcaattttgttgatccttttaaaaaaccagctcctggattcattaattttttgaagggtttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgatgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagggctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccattattaatgtgtgggattctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgccttttgttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatagtgttatgtgtgaatttgatcctctcattatgatgttagctggttattttgctcgttagttgatgcagtttcttcctagtctcgatggtctttacattttagcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtatggtttctgccgagagatccgctgttagtctgatgggcttccctttgagggtaacccgacctttctctctggctgcccttaacattttttccttcatttcaactttggtgaatctgacaattatgtgtcttggagttgctcttctctaggagaatctttgtggcgttctctgtatttcctgaatctgaacgttggcctgccttgctagattggggaaattctcctggataatatcctgcagagtgttttccaacttggttccattctccccatcactttcaggtacaccaatcagacgtagatttggtcttttcacatagtcccatatttcttggaggctttgctcgtttctttttattcttttttctctaaactttccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggtttttctagttatacattcttctaaatttttttcaaagttttcaacttctttgcctttggtttgaatatcctcccgtagctcagagtaatttgatcgtctgaagccttcttctctcagcttgtcaaagtcattctccgtccagctttgttccgttgctggtgaggagctgcgttcctttggaggaggagaggcgctctgatttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgtggtgtcagtgtgcccctgctggagggtgcctcccagttaggctgctcgggggtcagaggtcagggacccacttgaggaggcagcctgcccgttctcagatctccagctgcatgttgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctcccccagcctcgctgctgccttgcagtttgatctcagactgctgtgctagcaatcagcgagattccgtgggcgtaggaccctccgagccaggtgcgggatataatctcgtggtgcaccgttttttaagcccgtcggaaaagcgcagtattcgggtgggagtgatccgattttccaggtgccgtccgtcacccctttctttgaccaggaaagggaactccctgaccccttgcgcttcctgagtgaggcaatgcctcgccctgcttcggcttgcgcacggtgcgcgcacccactgtcctgcgcccactgtctggcactccctagtgagatgaacccggtacctcagatggaaatgcagaaatcacctgtcttctgcgtcgctcacgctgggagctgtagaccagagctgttcctattcagccatcttggctcaggaacccaaacctgtgtattcttatgcttaggtttgatgaagaagtggagggtagtggagaaatatgactggacaaaggggatatgatctaataataataaagtgtgggggacttaacaaggcctgtgttttctgattcttttctgtgtccttgtatcttcagagataaggatgttcctttcctctgaatgtggggtttgggggtacctctggaatgaaggttttatggcctgcttcaagagagaagggcaaggggaaggtgagagtgaccttgcttctgctattttatcaaatgccaaggtgacatactgttggtagcgggtcttgaaccccatcagtagcaaaacaagggacttctcactctgaaaagctggtagattagtgaattctacatctgaaggattatactcataataataaacatataaaataagccataaggccgggcaccgtggctcatgcctgtaatcctagcacaccgggaggcggaggcgggcggatcatgaggtcaggagttcgagatcagcctggccagtatggtgaaaccccatctctactaaaaatacaaaaattagctgggtgtggtggcacacgcctactgtagtcccagctactcaagaggctgaggcaggagaatcgctggaacccggaaggtggaggttgcagtgagccgagatcgcgccactgcattccagcctcagcgacagagcgagacaccatctcaaaaaaaataataaataaaaaaaaagccataaggccatgaatgtactccatcaataggtatttactgaagaaatactatgtgcttagtactgtgggaaatataaatgtagaaagcttgctctgtttacttgggtaatcaagacttataaaaaataaaagaattatatgcaaaaacaaatatgtaccaaaatgatgttctataggtttcatatatcctagaattttcaaaataatcaaaattcattatcacatcacatgtttacatttttagtgcaaaaaataggctctgtggcaataggacctcagagaaggacaagatcactatagtttgtgatactccaaaaagtcttcacagaggaggcaacgcagcttgtttatcctacagatattgtgtcatctcttttcagataattgtctgattatacctgtggctatttccccctgaatttcttactagttggtttttggttttgtttctgtttttcaggataaggtcttgctctgttgtccaggctggagggcagtggtgcagtcatggttcactgcaaccttggctcaagtgatcctcctgcctcagcctcctgagtagctgggactacaggcatgcgccactgtatctggcctgtttttttcttttatcttcttttttactcattcataataatgcagaattagaagcaatcccatgtctttgttttatctttatcgaggtataattggcaaattatgtatattcaaggtgtacagcatgatatttttatatgcatatacattgtggaatgatttctacaatcaagctaattaacctgtcacctcacatagtgatggagtccatagtgatggacctcacaggtttttttcgagttaatttttgcattgcttcaacactgcttctaccagagtccccattcaaacacatatcactatggtagttcacagtaacatggaagaaatcattacagagcatttgaactggataattttatttattcattgtggtcagacagcaagtctaattctgttgtcatttttatacaggtgatggtttaagaaaaaaaattatttacagacctcaacagcctatctcgatttctgtatttttcttatcaatgaaataataaagatgagcgcttcaaactatgcctctcacaactttcacaaagcatggcaataatctataatttatgtcactctcacctgtaaggctgagaatcattgacagaacctaaagggagggaaaaaagtcatctttctagataaagtgatgatagtttttcccagcttttaaaaaaatatatgcaaggaatttgtggtgaaatacaatagcattttaataaattgttattaacttgtattactaataaaaatttaagcctattgatctcacctgagaagcttaaaacattgaccagctaaggctttagtcacacatattcttagagtttctgagaaaccaatagcttttatgattttaaaaaatctatttacaaacatcatcttcacattcctctagccctgctttttttaaaggaaaccctacaggcaaaaatgcaatttttccaaagttggacatatggctgatgtcagaaccagcaaaatcatgttatacaaagccaaacgctgagttaaacctcccaatgctgatgttcatcagaccccagaataggtgtctgttacaggatgagcaagatgttagtcatagaagtagaactctgtggagatataactactcacctgcaaaatcaggtggctctgaaaatgaatagcactgtagcgttgggccaattcctgctgcccttggcactgggaatgcaatcttgtatggcaaatcaaatgagcagaaggcttggggccagaatactatcaagctcttctcaaactttaaatggatgagaagtcctgctcactgccatggaacatggcatggattttaagtgcctagtaggccattttattttgttctgttctttcttatttttggtaagcagagctggcagtatgagataaacttacataaacagtgagttcttgatttttatatttctcatatagatccaaaatcagcagcttcatttacacgtagctgtaaaactagaggagataaagtaatagcgtaggattatgttgaaaaatcaggatggggaagaatccccagaagagcttgacattttattaatccctactgaaaaacatgttccaaaatttttaaaaatgtccttctaatagcatatatatatgtatgtatgtgtgtgtatgtgtgtatatatatatatgtgtgtgtatatatatgtttgtgtgtgtatatatatatgtgtgtatatatatatatagttttttccatctagttttctctcagtagtgtctatttaatctagaaagcttctcaagccatgaacttctctatggattagattctgtgtattagagcgcaagtgagtatagctttagtccttgaatgagcagggaaactcctcaatgagaaaatatgggattttccaagaaattcctccagggcccttcctattcttaatcttttctctgtagctgaggataatagctgcataccttctagctcccccaattctagaaacaagaataataaagccttgacaatccatgagaagactttaatctgccctcaggattcccgattccagctcagtttctaatgttcctggatggtgactcatatctcaaaggcaattttggatttaaaatggttttccaaatctacataaagaatttctggattgtttgctgttttaaattagccaaaccaccctttctctctaacagcctgtataattgagagttggctatacattgtttgatacctgtaaaaagtaattgaacattctgaatagtgtattttgatgactgcaatttcaggtgcccaagcttgaccaggttgcttcgtttttgctcacagtggtattcagatatgcccctatttaaacaacccaataaatgaaaataatattttacaagattgataaatgaaggtgatttttttcccctcagagatctcttacttttaaaagagattcattgtattgttagtcatgtcctccgttgcattgaaaacatctgtttcaaaaaaaattcacatttatgggttattttcctcaaattattattttcctcatattgtaagtcacctggatctacaaaaataggctaaaagacagttattaccacgtgtcatattcaccagttctctcttttctttaaaaatgcttagatgtctttaaaatggtttttaagtgtttaaaggaatagtagtccatgcatagccctcagtatacctaagaagatgaagtatacttgtgactctgattgataagaatgcctgtaattttcaacagaggttactgtttcagtggtggcccagatatccatctgtcagtctttgtcaaatagcttatttgttatttttctgtagtctcttaaactgttattttttatttatttttattttttatttttattttttttgagatggagtctcactctgtcacccaggctggagtgcagtggcgcgatctcggctcacctcctccccccagggtcaagcgattctcctgcctcagcctcccgagtagctggcattacaggcgcgctgtaatttttgtacttttagtagagacgggttttcaccatcttggccaggctggtcttgaactcctgacctcatgatccacccgcctcggcctcccaaagtgctgggattacaggcgtgagccacagcgtctggccccttaaactgtttttgttctttccatacattcattccctacccccctgctttttcccaatgttccattctaaaagtgaataaaaaaattcacctaccaaatctggataacaagaatgttatttcattttactttaatctttgctattcttagaccttcttttcttcttcatcttttccaattgaaataaaaaagatttttgatgtatgtacaggctatgtttttttaaaagaactgttaaaattgtgcaacttcaaagcgtttccaaatgttgcattttcaaaaatgttttatcatatttttctttaaatttcctgttgctgtgtagtctcaatgatggctgaaggcactgaattttacattctatattgctttttgtgttccacatctagttagtagttataacttctcccacacaataacagtgcttttgtggaaataattactcaaagatgatttatttctaatgattttttcatatcatgattttaaaatatcttctaatttccacttacataaatgttttccttctctatttagatagaacacagatacatgttgattacatcctaatctatccttcatctacttcccagaaagatttcaggtggtttttgcaacaaaggcccattaaagttaaattaaaagttagagggaaacttttacacaattattccaaatatgtaaattaaggctagttactattattgagcattaaatttagctctgagcttactggaagccaatacagaaaagaaaacatgttatgttttataattcttattatctgacgaaacacagacagtttaaaatggaagacgaagtacaacattgtctttggtaatagttttagagatgatccaagaacgttcttcatgatcacttgtttcatcaacgaaccactttcatactgcctttgtgttcatttatgaaacacaattaaatattgctgttttggtctaaatgtgtctccccagaatttgtatgttgaagtctaccctccattgtgattgtattagaaggtggggcctttgggagttgattaggtcatgaaggctctgccctcatgaatggaattagtgcccttacagaagaggcctgagggagcttgtttgccccttccaccatgtgagggcacagtgagaaggtgcagtctatgaggaagcagtccctcaccagacactgctggcaccatgatattattagacgtcccagctgccagaactgtgagaaataaatttccgttgtttacaagttacccagtctatggtattttgttatagcattccaaatgaactagacaattgcatttatggaatacaatttgcaacacattgtacaaaatgatgtatattctggaatgagtcctcttcccactccttactcccctttccttacatacacattccttgcctttcctcacccccaacaatagttctgggacaggaagattttcatttacttctaaggaggtataaaatcttgatatggtttggctgcccacatctcatcttgatttgtagttcccataatctccatgtgtggtgggagggacccagtgggaggtaattgaatcatggcggtggtttcctccatgctattctcaggatagtatgttctcaggagatctgatggttttataagaggcttcccccttggctctgttctcattctctctcctgctgccctttgaagaggtgccttagccacaattgtaagtctcctgaggcctccccagccttggggaactgtgaatcaattaaacctcttttctttataaattacccagtcttgggtatttcttcaaagcagcataggaatggactaatacaaatcttaattcttcttgtaaacatttattgaacaccaactttgtgcatctttctcttttcaaattataaattatttcaaatgtacagaaaatgttatccctagaactcttaccaaacagactttatagaagtttgtgattagtaactatctgccaatagaagtcatttgcacataggtcctagaatcatagaattttaaaggtgaaaatgaggttaaagaacattcgctaactccttccttttacataaacattaaggacttatataggttcttatacctagttagtagaaaagttgatgacagaacttacgtcctctagtactttttctactataccataatatagatttgctggattatatatacattcaaactgtgcttctattcctgtatgtgataaacccaagcctcgtgtgatcttgttactctctatacagaacttacatccttgattagtatgtagactatcagtttgtttatttttttaagagatggggtctcgctatgttgcccagcctggtctcaaacttctggactcaagcagtctgcctgcctggtcctcccacagtgctgggattataagcgtgagccaccacacatctggcccagactttcaagtttcatagtgaaagtgtctggcagattaatgagttgttgatgcattcagtcaagaaatacttctgaactatgaggttcataatttgaggtttatctggttaaaatcatgactgctttcattagtgctttaattagttgaattctgtatttcagagaggcaaaactaggaactgcattttactgataaaattgagttatactatgccttttaggcaaatggaaccctcatttttttttgtccttatggtcattattaatattttgtttgttcttatttttgcttggagaaggagaactatcattgcattactgcaaacagtatatttatttacctcctgcccatgaacacttctttccctatttggagaaataagatactgtttgttcacagacctccctagtggtctgtctgttaagcagcggcagtcctgaactaagggcacaagaaaatggagctggtaatcacaagcaaataatgcaagacttttaacactttacatgacagattcaggtggggcttgcctactttattatccaaggtgttgctatttcctttcatgcctttggagatcccagaagaaggggagctagctgagtcaaacctctgtctcacagggctttcatgaacaatgacaattcatttcagcctagaggcaaagagggtgccttttcttacgagacttttgttcttattgcctggtgaatttttaaatcaaattggtggaaaattggaatgttttcctctcttttgtccttttgcatctccatacctccctccctcccagtatttttgagaccagatagaagcagatagactcatgggggattcctttgtccctaactcctatctagagtacttccttttcctaatatatatagaaatgatttgaaagaattctaactaacctcagatatggagataatgaccacgattaaatggactgaacatctcattcttatcaattccaattcataatcctattttatttaagtggttatctttgtcctttggaattccaatcagccaaaggatgccagtactgttaataataccgtatgccaagggaaattatttcctctgcttccacgactaccagggttcactttgtggaagctgtgtgataacataatccctcttacccaccacctcttttgggcaatatttgaaaaatgaaaaagggaaaagagctgggggagaaatcattcaagtaaatttacgatagtttcaaaaccagatttgctcattaaaaatagtacttgaaatagatagcagctgtggtttccattttgtaatttttttatgatctatttcatttctgttttctaagctacttaaaactgttgtaagctattgataatataattttccccaaattatttggctcctcatttcattttccctgctgtgttttataaaatttcatatcagaaataagaattaactagatatttttgaaatcatgagtaatttttattcactgtagaattagatttcttttaagaaaaagaaagctagtacagtaaaaatcagcatttcagatgtgggtggcaagaattaactagattttagagtaaaccgtagaatagtaccctcctctttgctccttaccatactttgttttctgagcatttatcaccacccgtcatgtatttatttgttcatcatttgtcttctgctccccactgaaatgtaacctccatgagagaagatgctttaactcctctagttacccaaagactctccagtgcctagaacagtgtttggcaaatatttatagtagttgctcaatatttgttgtattagtgattagcctgcatgagctatctggcttgcccatttcaagtgctgtgatgaatattctatgccggagaaatcatcctccagactggatcgttaccattatcttcatttggcattttattaccaacaagatagtaccccaggtaccatagtaaaaatgacttaagtgctttccatgtccatgtgcctttatattttacttaacaacatatattcttcacattgacatacattcattcagtaaatatttgttgaaaacttacaatgagtcagacacttacttgcccagaaatagaggcatagataagatattgcacctttactgtaactctactagaacacaaccctagaaaaaattcagaatctgtcatctccatagttgtggatttctctacaaagttgaaatttattgttgtttttgtgacaacaacatacgtttcctgatttttctgataccttttgattcatcctcatcattgatgtttctttttctccttgtacattaaatgcttttgttcaccaaggttcaaccctcacactctacacaagaatctttctgtgtgatttcacccactctcatatttttaactgtctatatgcaaatcatttctaactccgtagctatagcctacagttcttcctggaacttaaggcttgcataatgaaatgcctgctggacaattctacctagatgttcaataggcaccttcagttcatgtcaaaatcttaactctgctttttcttctaaaatctattccgtttttgattctttgtaggcggcaccaccatccagctactcactctagcagggaactgggtgtgaaccttgattcttccttctctataaatctccacatctcacaatctctgtatcctgcccgttttccttcctaaatatttcttgaatgtgtcacctctgtggcttcctaactaccattgtcctattcccatgttttaccaactgttgctgagacaactgcagcaatcttctaaatggcattccagcttccagtcttgtcccccttcaaatccctgcattcttttataattttgcccactgtgtccccctgcctggactgccctcccttgttcttttcattggatgaactcctgctcatccttttaaaactcaattcggccccatcaccggggggctatgaatatactttctcagttcttgcatggtgctttcagcatgttgttcccactgaattcccacactgctttgtctttgtttctttacctgcctgtctttcctattagatagtgagctcattgggagcatgtcttatttatctttgtagatccggcattaagcatgtcattgggaacttaataggcccttcagacatttttgaataaatgagtagatgaatgaacaaaagaacaaacagcaaacaaagggtagccttgaggtacagtataagtatatcaaagaatacaatattcttttactttagatatcaaccttataatttattaggagaaataaaaacacaaaagggcagtaatataccagcccacatgtagtctcatattccagtacagttttatctgactttgcctttttgatactgatgacacagggagcatctggggctagataaactgctcatgctctgaactatatgttgaatattttgatagaaactctttttgcctgtggcttatttgtcatatgccgcttgagtgtgaacttaatttgcatgactgcaataaatgaaaagtgtttcttatttcctactttgagtacataaatttgaccttgatcaatgtcagcaaaccaggcctctggcaaccacttcacaattttgactatccagagaagttcatcatcatctttagacaactttaccctggaatggcaggtttagttagtatcagtggagtcttgtcagacgtgtttcctaacaaaaatgacctcaagcaggagtgtgtggttttctctgagaaagcttttcttcccctgagcagatcatagcctccacaaatgtctttgaaacaggcatgcaaagattgctctatacagaagattgtgacaccgaacatgaggttgcttcgaatggttatcctaaagtgacctgccaaactgaagggcaaaaatgccactgctcttgaagtcttaaaatagtatctcttcttgttgaatccatgggaatagaaaaaagaaattgtggtcaggccatatgagaaggaatgccaaaaaaaaaaaaaaaagtcaccaaatccatttagcacttggtaacaaaaggtaagaatagacattgaatactgtactatttttagtatccattccagcatagtgctaagtatgtcttgcctccaaagtgtgttactccttctaccttctccatctctaacagtaataagcccagtcacctaagttcaaactctgagtcaactttgactcaagcttctcattgattccctagaaccattggttaccaatttagatttcattatctcttgaaactgttgtacctccaagtactctaaaattctcttatttgaacatgtccacttccttccacctttcctagtccacacccactctgcttctgcttttccgtttggtattctacaagcctttttcccattcaacttttccatctatctcatttctgtccctacccaactatgactctgctgtccaacatgtcagtacgtactcaaaagcactcctcattcattctctacccaattctcagctgctcctagccccaaccctgcaaataaccattgtccattttctcctctactgttcccggactaattaatgctggtaggcaacgacatataatagtagcatgttgatcaggcccactgcaagcgaaagaaaaattctaaattcattagttagaattttgaaaacaaaacatctgtcctaatacatctacttggttctgaaaaactgtgattactgtagttattgagaggtttctgtaacccaaatacttaactgggtcgtacatgaaaattatttttaagattaaaagtagagcatatattgtactgacagaattttctttaggatttacatgagtctaatctgatagaatggaggaatgtaattgaaaactaggaagagaaatctaggcatggaacttcatcatccaaacatttttttccctgattaaaagcaacatatcagcgtgtgtttttcaaatacaggcagtccctatcttacaaatggctgtagacagatgtagggcatattattgtttgaatcctgattacccaagtgggaaaactttgctttagatgtcagttgtttggaatccagaaagcattttcctaccaaggcagtgttataaatggtggttgggctcccctaggatagccaataatgttactgaaatactatacatttgcagtgaaacagtagtgaacacatttatcatatactactaattaaacaaaagcaataacgttgaataagatcattttatattttgggcttcaatggtggtgcttgaggaaaaacaggtttaattataagaggatgaaaaagtagatggagactgtgtgaaatctcaaaatagggctcatgagcatttttgaagacttcaaatgacacgtgttctttatcaagtctaactgattttaaaacttgtgaacttttacttccctttttgtggttctaagtgttttgtagtacaactgttgtgctatgattctggtcagtttttgactagtgatgaaaataaaacaagggaagaggataaaggaagaggatatggtgccagaggaaaattttgagaagagggggcttatatgcaaatatgaggattaaaaaaacaactttatactttagcaccacaagcattccacaagcaccagcaaccaaaggaaaaggagttctttcttgcttagttcttaggccatcctatataaatgtcctaaatagagataaaagttgcaataagttaaagaggctaagttgagccacactataaggagatgatatgtaaaccgcaaagcttgcatgagctgaggtaggaagagagttatttatttgcttttgttgttgttatttgtttttttgtcttcagttgtgtcttaatctgtttagtgttgctataaaggaatacctgaggctgggtaatttataacgaaaggagatttatttggtttacggttctgcagactgcacaggaagcacagtgccagcgtctgcttctggtgagggctttaggttaattccatttatggcagaaggagaaggggagctggcatgtgcagagaccaaatgacaagaaagagagagggaagggagcttacaggtttttgtttttgtttttaaacaaccagctttctcaggaactaatggagcaagaactcactcattaccacaaggaggacatcaagtcattcatgagggatccacctccatgacccaaattcctcccatcgggccccacttccaacattggggatcaaatttcaacatgaggtttgggggataaacattcgaactatggaaagttgtatggactatatcttggaagacggaaggatatgttggaagtgtgctaccttctaagtgtcaaaggttgagtcagagaaacatagagaaaaaaaggccaaggtgggcagatcacaaggtcaggagaccagcttggccaacatggtgaaaccccatctctacaaaaatatatatatatatgctggacatggtggcacgtgtctgtaatctcagctactcaggagactgaggcaggataatcgcttgaatccgggaggcggaggttgcagtgagctgagatggcgccactgcactccagcctgggtgaaagagcaagacactgtatcaaaaaaaaaaaaagattttagttctgttgcacattataaatggaatcctcctttgatatccttggaaaggatttggtaactacttatattgtttttcagtcatgttttgtattcacattcatttttacttggatatgactctgtactggtagggaactatgaggcaacttggctttattcaagttatataggtgtgatagatttcccaagatcacattaattgagctgtcagtgggggacaaaagagtatgattactctaaagaggaagaatagaggaggtagaagaagacagatatagagccacatagttaattctctttgctgtttaccagctgatgaaccaacaattattcaacaattttttactgtgctgtgttctaggcaatgtgctaagtgcttagagatgcagtggcaaagtacttggaatacagtagtacacatgatattacatctgccctcatatgttttacagataaggggacggtacagataagtagataaggaattataatgaattatgttaagtgctaatgtggaggtactgttgggtattaagggcatatatagaaaaatcacctaaatctgactttcagaattagcacacatcctagagcattctaaactgatatagaaagatgtgtcagagtgaaacaggaaaacagaagttaggcaagaggcaaatattcctgaaagaagaaataatgtttaagattcaatcatacaacaagaagcctagagagagtactgggaaaaaaaaatagccaaagagagatttctacttctgaaaattgtatagtaacttgtggcagaacaatgctctgccaagaatatctacataagccagataacagacaaaaagtctgtttgaaggcattggaaagtagccaagacagccagggcttgagaagttaaaatctcaagcaaggaaaactacagagaaatgaggcatatttccttttggggcatttgccaattcttacagcatgatacagagaagtcaccagaagttccagctatcttataggcttagagagagaggaaaacattgagggctgtcaaggcagtcagtactgaagggggccaaaatcctgaagagagtggatgagtagagaaatgaacttgcactcagtagttttaacctccaggcatttgccaaatccttaagctgttcatgggatgaaaaagcctaacccgtcaagcagtaagtgactgaaaagcagagtggagctttcccactcatagtataaaagaaatagaaaataatgttcagggccctccacagaggagcagccccaagaaacaccccagcatttcatttgggactcttaaagaacctaccctttaggaattggtatgaactaaatatagactgaacttttgaaagactgcaacttcacctatttgttcgttgattccttgattagattaaggtgatctacctctactccagctgcctataaatgatagagagaaccctctctggaggaaaatatcatctagtggctccaagatttctgcaaacaaaatgtctatatttaatcatgcattaattggcttatgaagaaactgaaccaagggaaaaatcagacaatagaaatagacctaccaatgagtcagctgttgacattctcatagacttttaaattagcatgattttttaaattactatgattaataagtttgagaaaatagatgacagtattgagaatctctccaaggaactggaatccattaaaaaataataaagaggtaggaggacagtgacaattagtgaaaactgtttcaataaggaaagagtagctgatactgacttatactacagtgaggtcctttggatatagtaacaaggagcacaggtactaagaagtcctttgggtttcataggtagatcgttggtgagtgcaggttcagtggagtggtgggtaaagaggccatgatggtgataaggtcagatttgaggtgagtagggaaggtgactatggaaacatgaaaggtatgatgggcttaaaattttggtccattaatttgtagtgtcataaatctattatatacgactctttaattttctctagaaacactcatcgacttgattagaaataatagagataggttgtattgttctccttccgtcttccccctttcccattccttcctctcccttccccttccttcttccagtcgttttccatttttacttccttttccactactattttacattatttttctttattcttctttccttttcttcctttctttgttttctaatagaagaaatagaaataacatttgtagattgaggagagagagcttgtatattgagagacctcgttagactcaaagcatgccatcataaatctgagatatttagaatatgtattccagtaaaatcggctaactaacttaatttttacagacatagcatacatcacagttaaaatgccttttagaggcccattctgttttacaagaccaaaattaaatgtatatatgcttatatacatactaatgtttatctgttatgtgcacatatctgtgtgcatccatgtatgtaacaactcagtgttttactgaagtaaatttttaggattgaaagaaataggtttctctagttgtatagactgcttatgagaacattacaattcgatatgtagagagatgatgattacaatttattagtccatcaccatttggaacaatagatggccaaatgtaattaaccattgaaagaaatacattttacgtgtcctaaatttcatttctaattacttgtaactgaaactctctagaatcttaaaatccattttgtcttatgaaaggcttcattgcttatccctgttgttgcactattactttagattagagtaacttcattttaaaattacatgtcaaatataatttgctattagtaacgtggaatgtgtggcttcactctgagaaaaaagcctgttcagcattttttaatatcatatacctaaacagagcttccacgatgattagatcacatctggcacaatgtagatctatttgtacttgcataatgcatgtgcatgtacacactgtgatattttacgactatttgggtacattgatttttctataaagagaactattatccacatctttttgcacagaagtacacttaaatattggcataggtaaacaacttactaaaataaaactcgtgcttggcacaactattactggtgtcacagattttacaactataatatttctgaaaagctagcttgaacgctttggaacatttttttctgagtgaatgcagaggcagtttggtgagctgtaaaacttctacttttcattttgtattctagtctaggccaaatcttaagtgtcactaaatctgattctatcttgaattgtggcccagtgtcatccccagaaggaggcttctccccagcactggctaggtaagcagcctatgtgaaacaaaggaagcggctttgccagcaagcaactattaagaatgggaaagagtttgaaataggctaacgaaatgcaaaaaagtaaatccaaagtccaaaagtagaggcagctttaactctgcactatttttatcttgtgatcctgtttgaagaaatgtctcaattcattataactgaagtaaaagtcactagcataatatggaaacaatcttaaactggtaaatattccttctccttacttaacataaaataaaacccatattaagatattagttcctcctcgtcagcaggggaagtctctgtatagactgtctgaggacatggcagttgactgacactagagtgggcaatcccagagactggaaattgatgtcaaaaaatttggttttgcccgctctgtttaatctgtaattagtcaaatttaatcttagtggataaggtatctgaattgggttcccaaaactcatctttatttctatttttttttttacattttgcaataattatgaatattttgaatatttttgaattttgaacataaaagttgcaagaatagtacttggaaatccctgtataccctttgtgcagattcaccattttaaacatttagccacattcattttgttatgcctcttaaatttttaatacttcaattactgtttcctaagagcaagattattcttgtaggtaacaatagcaaagttaccaaattcaggaaatgtatcattaatgtaatacttccatctaatcaaccatccatgttccaatgatgttaactgtctcagtgataccttttatagcattttctcctccaatgcaagatccagtccagaatcacacattgcatcgagttgttatgtcttcttagtctcctttaatgtggaacagttcctcataccattgcatacactgttaaatatgaagaaaactggtcagttattttatagaagattcctcaatttgtatttacctcatgattagattcaggttatgtacttctgtcctaactactagataagcaaagtatgtccttatggttcacatctggaggcacaaaatgtctctctgtccctcactggtaatgttaacttcgatcatctggtcaatgtgttgcctgataccttcattttataggtattattttctctgtttcaactaataagcaatctgtggaaagacactttacgaccatgtaaatatattgctctacatcaaactccccctctagccttaactactattgatgattcattcctgaaccaatctttaccacaacagttgcatgtcatcttgtattaatttcttttggaatgagaagaaaaacaataatttactctggtaattttctgaagaataccgttgatttcctttgacaatgttctaataaaggaaattgctctctatggaatcgtagtgatctgtatcctctgagtagtttactcattctaactcaaccaaaatgagcagaaattaaaagcaaatgatttttgctctagaatcaatacttatgttcacagtcagtatatatgctctgcaacaagttgtactctgggtatacatatacaaaatttcagtgttgcttaaaaaaaaagcatttttattgacttaaatggaagaattctatagttttttaactactttagttttctggaatttgtttactttaaaacttttcagcctttgcttttccatctctttaacaaattatcacctcattcatttagtcatgttctatttaatttatatatttttattcttttgcctttccacattgcctaaatccttgtggctaggattacttaaatttttctacatggttttcattcacccccattcttataaattatgtgtatcatttatttactaaatatcttggtcatgttcaagaattgaagatgagagttttcagttatcacattgaaaaagattaaaatttattatatacatataaatattatactataaaaatccttatgtaagttctgcaaatcagtattttatatatttagtgaactgcacaaaaggcaacttctattcagtgtaataaccctaattttatttcttaattttaaaattttaatcttttctacttaacattctccataaatagcttattgtagtgttacaatgaaagaaaaattttaacatcctcatgaatcctgactacttagtatatacatatgtaaggtgaaataggttaaatagcttatgtgactattttctagttacttcattaagtctctaatgccttttggataaacaaaaatgatgaaaagtaggtcaattggctacctcagccaggtgatcaagatcaacatcattagagatagtgataagacaggtagataatatgttctcttcatgcaatgagaatggcattttgcctctgtcttccccgagaacatataaccccagtctaattatgcggaaattgtcagacaaacccaaattgagggacattctacaaaatacttgaccattactgctcaaaagtatcaaggtcatcagaaacaaggaaagtttaagaagctgtcacaatctagaggagcccaaagagatgtgatagctacatgtgatgctgtatactggctgagatcccgaaacagaaaaaggatagtatgtaaaaactaaggaaatttgcataaagtatggacttcagttaatgatgacttatcaatgttggtttatttgtttgacaaatgtagcacactagtataagatatttacaacaggggaaagtgggtacagagtttatgagcactcttatactatctctgcaatgtttctttaaacctaaaattattctaaaataaaattttattttaaaagatatgtgtattgggaaagttaaatgttatatgaacagtgatgttggattcttaaaatcagaaagtccctgaaagtataccataaaatgttttttttctaattgtatttatttatttttttgagacagagtctcactctatcgcccaggttggagtgcagtggcatgatctcggctcactgcaacctcagcctcctgggttcaagcgattctcctgcctcagcctcccaaatagatgggattgcaggcacgcgccaccacacccagctgatttttatatttttagtagagacggggtttcaccatgttggccaggctggtcgaactcctgacctcaagtgatccacctgcctccgcctcccaaagtgctgggattacaggcgtgagccactgcactcggccaaatggggtttttaaatacttggtaaagaatagatcatgcccaaggtcactatcatctagctttatattttttaaataacaaagtatacaaatatatactgattattgtttcaagtactatatgttatagagaataagaataggaagtgattaaaagactatggtcccagtacatggtaacattggtgaacacaatttatacaaacaacagagaatagagtcttcattccaaccttttacacatccttagggaaagtgctatgtaaatgatacaattgctttatacttcatagggataccacacaaagggaacacttttaatatcaaaggattctaagaatttcaagaagtttactaaatgaggaattagaggaagatgcaggtaagtatatcataaggaaatataattttaaaagcttatcagtgctaactcaggctcagctattataatatgtagcatcttatggacaaggacaaaataaatctcactgaaaacttaagaccatttttcaccttgaaaactcaatgtggaattttccatgaagagcccttgtcatcaaagcactcagatatagtattgaccatatgaagccacactagtacttctggctcattggaatgaaaatatcatatgagtcagcttttaaattttttaaaaattctattattctgatcttaacacattattactacatgaaatttatcctcaacattttgactagctctttttaagtagactattgtacaggtatgacaagtatattaaaatacacataacaatttcatatttgtatcagagtatatcaaattaccaatgtcttcaaatattccatgctagaaatacctgtttgtagaatttctgtactggatcacttacctcttctttctatagcattttggcttcacacctttctcccataaatccaacagttcagttacacttttttcaagtatgtttaaatattggattgaaaatcatgtaccctgaaacctcataaaactctgtcaccaaagagcatgtcatcagattgagtgggatacaatacagacctggattatataaaaattatacgaaattgtacacaagcaattaagtctaaaatacatttctttactgctgaattataagcacggtattgtgctaggtactgtaagggttgaaaataagctgaataaaccataatctctgttttcaaggaccatatagttcattggaggaagcaaacatatatattcacatatttttattacactatatattcatatttcacaatagaggtaaaactgaattatatggacatatggaggagagaaggattgaattttactagggacatctcagaagcattaagggcagaaaaagtatttgaattgggccctaaatgaatgcaggaaacgtcagtaggtaaaaatgggctaggaggatagggaggtatttcagatagagggggcataaagatggaaaagcatgcaatgtttacaagtagcccagtgcaactagagtgagaagtcagatcctggaaggccaaatatatgactggggagtttgaacatcattctgtattagaggtttttgagtggtagaatttcaaaatcctatcttatatttgaatgtctattgggcaatcatgatagacgggaagagacagaaaccacttaagtgatgctataataaggcttgagtttatttaagtagatacgttcacttaattttaacaggttagttaggtgtggtaaacagcctctaagatagttccgaatgattcctgcctcctggtattcatgttctttgagtttggggttggcctagtgactggcttctaacaatagaaggagaaattgatgggatgtcccctctgagattaggttataaaaagaatgtggttcccttccatcttctgtgctcactctctgtctcacagatcatgagcttccatgttgtgaggacacttaagcagtttatagagtgggccacatgtccaggaaaacctggttgccagcagccatgtgaatggacttagaagaaggtcttgccctggttgaaccttatttgaaatcgaagccttgatcagtggcttgactataacctcataatagaccttgtgccagatacactacttaagctaagactaaattcttttttttttttttttttgagacagtctcgctctgttgcccaggctggagtgcagtggtgcgatctcggctcactgcaagctccgcctcccgggttcacgccattctcctgcctcagcctccccagtagctgggactacaggcgcccgccaccgcacccagctaattttttgtatttttagtagagacggggtttcaccatgttagccaggatggtctcgatctcctgacctcgtgatctgcccgcctcggcctcccaaagtgctgggattacaggtgtgagccaccgcgcccagccaagactaaattcttgacatatagaaactgtgaggtaatacatatttattgttttaagccattaaattttgccataatttattaggcagcaatatgtcattaacagaagtcaaatccaatatctagcctggtttatctttgtactaaattattgaatattttatttctatcatttctatacataatatggcttaaagattactgaattataaataaaatctagaattttctccatattgcttagtataatcttaactattatattgtgaaagctttgtgatcccttgcatttacagcttttagagaaatgaaagatacaggatttatatgtaagagaggtcttagaaacctattttgaaattaaacatttttaatattttctgttaatcctttttaggaaaaaaaaatttgtttataaagtttttactaaagttaaagaacactaactttatggattcactgcagctttgataatgaaaaaactactggaaaataattaaagaagttgctaatcagttcattaatcaagtgtatctgctgcacattatactgaaacaaattgaaaaggatgctgtgctagccagaaactccctctcaaataaagtcaaaagtgaagataaactaaattgacttttcgtttgtggttgatttctatctaagtagatccatctctaaaacactgaataaagaaagttgccccatacatagattcaagactccactaggattctgtatcttaatactactgagaataacttgaactatatttaatcagtctgtctttagtttttgtttttcgttttgttttcatttacaacccacagaccactttcatttttaaatgttaaatatacttagaaagaagaagaaaaaaacaacatcaccttgctcactgcattaagacaactggttttgtaacccgatcaaaagaattaaatagctttctatatagcttaccctcccacaaaatctttcaatgcacaaaatatttgtcagtggtcagaatgattccagtccatcccactctctgtggtgccttaactataaaaatggcagtgaggcattgcagcttgaaaaaaatacagtcagattttcaattatgattagagtagatctcccagagaggtctccacagaaggcccaaggttctctaaagggtaaaaggagtgacaaaattctgacataaaacaatgtagtctttcctctcttttcttgataccgaccttcaaatattttggggtttttaaaagccaaattctagaagaaattgaaggttcaaaattggaattcgcttgagtttcattaggtttaagccagataccagcctatgtcattttctaaaagcagaataatttagttttaaagcaatagtacaagacgaacaaacaggtacctggcaatcacattaagactcccttggtgtagacagatatgtataacttcttttgacaggttattttgtttattcattcatttaattttggcacttaattttaaaagagcttagaaatcatagtcttttgatagatataattggtatgaatctgaaatcagtaaactaagatgcataagaaatgtaattttctttattttcttgtaactgaattaattctatcttaagaccctattctactggaaggtaccatggaagataagaaaacaaaccacaaaaaaatacacaaatttatacttacttcacatactgtccccaccatgttataaggatataatactcatccattaagacatgagttgcatgtttaccccattatagattatttaggattatgctgaatttacaagtgaaggaaatgagcaaagaaatgccactggataaacagtgttttgctttccagaagcattaatttaagtgactggcccatgattatccatctgctctatcagtgaaagatccctaaagacaatgcttgtcttctatccttgtcatactcagtacactgttcacattagcaagtatttgcccaaaattgctcaatttgggatacagaatagaaatatatgtacagtagtgagtcactgataggatctgagtgaaaattttttacatttttttaaggcttagatgaatggacacagttttctattgttttgtttacctttgtctggtttcccttcccacccccatgcacgtgctcatgtgtgtttaattaaacaaagaagagttccaggaagttgggaatgtcaaatgggaacagacaccttcgcaggagctgagaaaatatgctatatcatttatccttgtggaaacatgcaaaccagatttgaatagtttttaattgatttgcaaactttgcagtagaattttctggtaattagcaacttgctgagattaagtgaagtcatagttagcttcacagtggtttaaatcatatttcattgttttgcatgttttaaaagtcatgttgtaaattaaaaacgcaaagaaaaaatcaccaacttattaatagagaattgatcattatgcaaccaattagaagatataaataaatatacaaatcaatcacgtataaaatggtaggtgctgcagaatgttaacactgtacaggcaagtgcttgacaaataataatgagctataaagatagactagaagcaaaacagtaatgtggcagctttgttggaaatattttctagaaatgaagatgcatgaccttccgtacctttgttaatcatcagttatagatagttaaaatgttatatttacaataattctgtgacttttaaagtaattgtttatacaactacattgagcttactagtggcagtatgttcatatgtacatgtgtctctcttgagctctcaggagagagaaaaaatctgaggaagtgctagcaagcataagcagggagataagaaaaataaactatcttataagtacaataaaaatcacccatgcctcatggataacctaacttcccaattaaacatgacgtttcctccaaaatattaagcgacaaactagaattctgtttcggaagccaaggaaattaaagaaaaatagagtcaagggttaagtagaagagaagagacttaattacatttagcaagggtcccaatccacttagatacttactagggtactcagcacttgttcactgcagcatttgcatttagcacttttaaaattgggatgaaatgagttttatagatactagaggaatcattatgagatcacaaagaagtactgtgataccataactgaagctaggagaagggaaagcaaattcatatcacagaggaaagcaaacttccatcctctcaagttatctttccagtcaacattgccgcatatcacatatggtgtgcaaaaggggacagattaatgaagtactcaacaggaaggtataacaatccaaaatatgtcctttgtgactctctatccatttctgccatattccaaggaaatgcagatgtatcttcatttctatgccatgatatacttgggctgggaatgggggacaaacccagagtgattgttctcttttcctgtgttcatagtgtatatgtgcacacacatgtgagggtgagcctacacctgttcataccccatggcagtctgacttcactgattactttctagaatcttttttcctttatgtgccctggacaagagagtggacaggaaacatggtaacaaaaacaaagataaacatccttctataattctaaagaagcatttttctgtttcctcctaggagaaataaaaatgtataatttaaattaccaattaggatcatgttgggctttaaaatttttggggggtaaattgtatgagggttgcaaaaaagtcatgcagagaaagatactgaaatctcctaatacaacatgttgagaagaaagttaatgatcagtttttctggtagtttttgcatataagcctacttggaagcactgtgtaggcctaactgacgttagtgaatcagcagagagctgatttgaaatgcattatccgataggcatgagattaagcagtttgataggcatcttagagctgtttccatggccttattaatttgtaacagttgtgtggtaagttatgtcaacctcccagtcagaaagtcttcagtaagtttttcaggctccaagttgagggatgggtaagaccctgggacaacaccctagtggaggcttataggagagtttaagcatttctgaatgcttaaattctggatgctacattctggatgctacaggcccagaattccacactaaagtatttgtttggagaactcaagtatattatgggtatcttatttgtattatgtgtaagtaaatatcaacataggtttgatcatttaatcccatatcctgattttgctctaagcgaaggcagttatttgagtgccagctcagaaaaggtaattcactattacctgttaagtgtgatgaaacaggacttctcagcatatctttcttgatggtattttaggttcaaagctgatggattagctttttgccctttcacacattctacctatcagtgacaccatggccaagggagacaatccaattcacttccctgacagaattgtgggtgatggttatatcattacgtatcctggaatgcaagactctgcttgtattgatcttaaacatataagctaaactcagtagcaaaaacataaccgatatatggtggggaaaacgacaagggagtgttttctaaacccaagaaatactcaataaataggctaagaccaagatgaaaagtgcaaagaaccaacaagacaagagtagaaagaatgcggggctcaataaatggtattattctcagaaagtatattccattatctgttgttgtagaacaaactacccaaaacttaatggcttaaaatcattgttcacgattctgcaatctgggctggcttcagcctggcagttcctgccactagtctcatctgaagtcactcacaaaactgcagcccattggtccagggtagtcccattcatatgtttggtggttagttggcaatgtcagcccagcatttcaaatttcatggcttctccagaagggagctcaggcttcttacatggcgcatgtaatgttccaagaagtcaagaatggagactacacagtctcttgagtcctaggtcagaagtcacacatcattacttgtactgcattctgttggtcaaaggagttcacaaggccagcccaggttaaaggggtaatgaaatggattccacctctacatggaagaaggtgcacatagtatgtgtccatatttaaaatgtcacagaatttacaggaatatgaaaataatcatggcaaatgtggtgcattcttaggaagaatttttttttcttttttctttttttgagacagagtctcactctgtcgaccctgggctggagtgcagtgatgcgatcttgactcactgcaacctccacctcccaggttcaagtgattcttctgcctcagcctctcgaatagctgggattacaggtgtgcaccaccacacccggctaattttttatatttttggtagagatggggtttcactatgttggccacgctggtctcaaactcctgacctcaagtgatccgcccacctcaacctcccaaagtgctggaattacaggcgtgagccaccatgcctgcccaggaggaactatttttaatgtccaccattgtatagtgctcccggtacagcctctatttaacaatttttaaaatgtctctacatattttgactctcttaaaagttaataataatgagaaatatttacattgtattcattcaataaacaagtactatgatttctctatcgcgctcagatctatcagaaaccttaaatgtaaatagatcgtttgatgctttattataataattgttaaacattcttcctaagtgcattattgaccattgatagaaaagaaattgcttcatgttatacttattcatcaaaagcacaagaagtgcccttccctgtcaaactccttcaattgtcaccccagcacttcactagagatacaaataatagcacatgaaattgtagctggaagggaaggggaagactggtaaggcttatttaaattgcattccaagcatagaaaacatatcttctttccaaaaaatgaaagctagtacaatattaaatcagtaatatacatacttaaaggcatattattttatgtgatatgttaaccatgacatagagtatctcaaaccaaagtgattcaattgtcattaccatcaacaaaatgaaacttataagtggattgttagcagcctctttttagtttgttgtagagtgttcctctaaagagaggagaggccagaaatcatctcagtacacagacacagtgttgctgcatctccatttttccacaccgattttagtcttgatattacttccctgtggaggctgtctgaaagctaaaagcctatacagaagtaacttaggccaggtcatttttacttactaaaagtcagttttcctataacatgtaccacaagatgttactttaacagttttggttcaagggtcaccagactgtacagactaccagagcttcagcagtggcattctttcaggtggcactctataagttgtctgaatcattgggttaacattctcttcatgttttcatcttagaaaggcaagttaacgtatttttaaagaggtttaagaaggcttaagaaaaagtaaactttttttaatgcattgaaaaaataattttacaatttattcaattcccagagtttttattacagacctactatgtacacaagcatggtgtacccggcagctgtgagaatagcaaagacacagcctcagcctcccaaagtgctgggattacaggtgtgagccaccgcactgggccccagtagatcttttctgtgtatattttcccctactcctctcatctaccctttactccatcctaagtgaatgatgcccttttctctgactatatcttacctttcctacctctatgtctttgttgatcactttcaccctagccactcttcaaggctcgtttcaaacacagatttcttcatgaagacttttctcctgaatacacacactgctacctcaaatccaaagctatttctccttgtttatctcccattgcaccttaattcctctttgggctagagttgtctctgtatcttgtctccaccatccaccaaattttaagacctgaaagtagagacatcattttgttctatctcctaacatactttgcagttaataagaggcaaaataactgtttagttgaattaaaaatgaatgtgaggaaatattgtggccatctgctaaaatgcataggtaacaatgttggaaaagaagtggctcttttttaagtttgatgaaaaaaaaaaaatatatatatatatatatatatatatattcttaaaaaattaatcacttgtccaagatttaacagctaaactaacatttactgtatgttcattattctgcataatatgtttctcatatatgtaaaagcacattatttagtcaaaactatcatattaaatttctcccgtaattcctaagggctgtcagctgctcattaaatcttgattttctgtcaggaggaattaataatcttgcctttgagtgaatttagaagcaatgagggattgagcaggaatatttgaataccctctcggtggtaaattggatatccaattttcaacttagtcttaatgggaaaaaaagaataaattgaattcagaagctgttctttactttttaatatttcctccccacttttaactgagttaaaatggaagggtatagttctttctcagtggtggggaaaatcaactttcattcacttagaaaagtttgtcaaattcgaatgagacttaatatatggacaatctatatgactaagtctataaggtgatcctttggaaatcataggaaaattcagtacaataacacaaaaattgatttgcatgaggtttaaatcgtgtttttctaaaagcaaggaatcctgctcctccctctccccaaatgaattttgttgtcaaatactggtactaacaattattgatatcacaactcagtctctaaaagcaaactgtcctattattaccagagaggtgctaactcacattaacctaataatatatagctcttaattttcagttttcatctttcatcattttttagctactcatgtcttagatttaaagtcccttaaaattataaaaggttgagagactgataaacaggcataaaaccttgtagatttttttcccctccactctttttttctaactaagctacacagtaccatcacgtaccatccatcagtacatttagctgtcatgacgctgccaatagaagttgtccatccactaggcagtataaaattacaatcacgatcttcgctgggagtggcagctcacgcctgtaatcctggcactttgggaggctaaggcaggtggatctcctgaggtcaggggttcaagaccagcctggccaacatggcaagacctcgtctctactaaaaatacaaaaattagctgggcgtggtggtgcatgcctgtaatcccagctactcgggaggctgaggtaggaaaatcactcgaacccaggaggcggaggttgcagtgagccaagatcgcgccattgccctccagcctcggcgacagagtgaggctctgtctcaaaaaaaaaaaagttacaatcatgttctcagtgaggcagtaaggtggaagagtgtatttctttctgtgtagtatgactatatgacctcatgtgtgtcactcacttgcacttattttcaaataccaggcagcagtttgcttgaagttaactatctgttttatcatgcaacttaagaagaagttgtaacacatgcaactccaaattattcttattcataactctgttctatagtaagcatttgaatatggatgcagctcatgtgatgagcatcattctacttgacatgaaggaatgagatccaactgcgaggaccccagtcagaaagagctgaaggcccattgatgcctcaccttttctccctgcttcccccactcttgctagggatcattggcaccaccactcagactgatggtaaaacaagaaattgtcttctgtctagctcagacacatcacttgtccaactcaacccctgctttgggtacaggaagttttaatctggttaagttgaatagagtttgtcttctagcttttgctgtgctaaagcaagagaagtacaaatgtcaacaagcagaataagaagagtataacaagaaatggtaagaagtcaaggccaaaatctagatactgacctgtggataattgagaggtgtcagcaactctcttctaacatcaaacagacataataaaaacctaacaaaagatgttgaagtctgaccagcatacctcttactttgcataggtgctgtttggatttctatgcaagcctgtgcttaaaatcagccttcagattgaatgttgataacctttccttttttacatgcctcatttcagtttatggcattccaaccttttctccctcgtgacgaacacttttttgtatcaatgtgaggcaagctctgtcaattcatctaatcctcaaagaatttttgcagaataagtatgattatccccattttatagatgaagaaatcaaggcccagagaagttcaattagttgcctaaggccatacatctggcaaatgatagagttaggagttgatcccagatctgcctgattctgaaccctttgtttgatctttgtgttgttccatatcatttccctatttaagaaactcatttatatttgcactccataaatatcaagcctgtcgggactaagttgtaatgagttcagcatcaattcctgtttactggtctgggctaaacagtgctgatagtaatgctcatgtgaccactgggaaaggtccaagttcatgctctaatatctgacaacagaaactactcccttctagagaaaagagcagacctgaggataccttgtgcaatccaaagtcaaattccctattcattcattcattcttattttgtgtgtgtctctctctttctctctcttgtgcacctatgcacacacaatttttggtcgatgcacaattttaaggtcatttttaatctaaagaatttgttcccctcttctttcctgattacatggccatacagcctgccccaaacagtatgactcactctccatgactcttctgcggctctttgttgtgagttttcattttgtgcctcatttctgaatatgctctaaagagcagggatggcctttggctagaaagaatggcatgtcaggagggttccacaagccatgttgcttttctgaatcatgaaaaggcatcagcactcagtgacatggcccagttttctaatctaatttaattgaatgtacaatgatgtgggcactggagattaaatacaaccccacttctctgcaaagttcacattgcctttaaagcaatgtaatatttttttcatttcttatgaatggttctgtgtatgtgtcatgtatacttttacttgtattctctgtgcaaagtgataccttaaaaattatctgtaaaaagtctaatataacttggtcttctggaatatggcctgatttaattaattgaccaatattactttaaaccattatattgcagtgaaagttttttcttgtcacagtaggaactagagacgtgtcctaacaaagtactaacttatttgcaactgatataaagtgaattaatatatttgttacttttaaaagagagtgtattttggaattttgcagttatttgtatattaaggcccacattaagggcctgcccatttataaaatgacgggtaattttcccaagtgctgataaaatattttatcatctaaatttgaaaagaaaaagaaactaattttaaaacatttctaatttataacattttgtgactaacttactttttatttaatttatttcctttcattcccctcactgtgatccaatttgtagacaggcaggcttgctaaatagcttcagcatttgggtttgatttactgtgaagtagatcttagaaattaaagtttcaggttgaaatttgcctttcagatctccttgcctaaatatacatgtaaatttgggagtaatctaacatgtgcataaacacattcaaactattttatagctttaaaaaaattatattgaaataattttagacctacagaaaagttacaaggttagtccagattttgatacccccttcacccagattccccaaatattaatgttttactgcatttcctttattaatcttttttctagaaacacatacacacattatttttttctgaatgtttcagaataaattgcaacatgatgccccttcacccctgaatacttaagtgtgtatttcttcaaaataagaacattcttttgtataatagtacatttatcaacattggtaaatcaacattgataaattaccacttaatctatagactttatttaaattttatcagttctcccactaatattctctatagtaagagaaaaaaaatcccagcccacatgttgcatttagttatcatggctcttcaacctcctttaatctggaacagttcccctgccaaaaatgcatatcctgaatctaatcatgaggaaacatcaagcaaatccgcattctacaagataatttacctgtactctttaaaaatattatagtttttagagctatagtacatctccaagtaagcacataggcatatctacatttttaattttctctaagaaagagcaacaattcaaaataatccccaagtatgttttaaaataaaggcttctttttgaaagtcaaagacaaatgctcttagcctaaggtttcatttaaacatagaatggctatttcaaaaaacagtattacataaaatatgggctgggtgcagtggctcacgcctgtaatcccaacactttgggaggccaagtcaggtggatcacctgaggtcaggagtttgagaccagcctggccaacacgatgaaaccttgtctctaccaaaaatacaaaaattacctgggtgtggtggcgggcgcctgtaatcccagctactccggaggcggaggcaggagaatcacttgaacccaggaggcggaggttacagtgggccgggatcctgccactgcactccagcctgggcaacaagagcgaaactctgtctcaaataaataaataaaaataaaatatgtattatataagttagggacaatctggtctttcatatatagacttcagacaattggttgttcattctggagttgagcactatttctctcatgggctcttaagctaagaacatttagctacatgtcgggtatgtttcttacattctgcctcatgaccatctcccactgccatgcatatgacaaagacacttaactctgagccccaaatctagaggagagatctaaatgtcacgtgaagttcttaaaaacctttcttctgaggagttaacaagggatattaggaagattcctctgcccaaaagacctcccaaataacctctgccaactcaggctgcattaagttaaaccagatctgtctgtaaaatagaaatgagaatagctaataatatcaatatttcatacctttattttaactactcttctctggctactttgtgggttgtgagggaatggaacattttactgaggagccaggtgaatgaaagaagacatgcagagcaagaggtctttggtgagagggcctgtttgagcccctactcaagggaattaggagtagcatgagggccctgtatatccacagaggacattcatttttaatttcctctaagaaagaggaacaattaaaaataatgcttaagtatgtttttaaaaagacttttttttttttgaaagtcaaagagaaacgttgttagcctaaatttttatgtaaacatagaaggtgattttaaaaagccattaaggaggcaggggagaggtatgaaaaaatagattgaaggccacctactttacaattttgcctggtaacaccaaactaggcagccaaagcctggcttcaggtttgtcacagctatcggttatgataaacaatattaccatcacttcctggttgtagtctgcatgaatttgaaaactaaaatttgcagtgttcgggagtggtggctcatgcctgtaatcccagcactttgggaggctgagacaggtggatcacctgagatgaggagttcgagaccagcctggccaacatggtgaaaacccatctctactaaaaatacaaaacttagctgggcgtggtggcgcacacctgtaaacccagctactcgggagattgagttgggagaattgcttgaacccgggaggtggaggttgtagtgagccgagatcgtgccgccattacactccagccagggcaacaagaacgagactccgttttttaaaaaaaaaaaaaaattaaaattaaatttaaaaattaaaattaaataaaatttgcactattatgattcagtaaagcaggaatgttataattggttgttttctccttttttcctctgtaatactatttttaggaggatctaggtagatatctcactctgattattcccgaagtatgaagtctcccatactggctatttacatataacttaattcataagacttttaagaaatctctttttgccttctccttattctccagactggcattgtgaagatgagagccaacaaattatacctcaaagtctggaaaattagtcaactgttccacagttgtgcatgaaacatttctgactttgtgatttgtgaaagtagcactgactcagctaaggatcatggaaagagcatagacttagatcagaagactcattctagctggtaactgtgtgatcgtgatctgatcactaagactctgcgagccttaggagtctccccttgcatgaaatgaagttggtgaactagatgatcttcgcattatctcctaagttgtaaactcaatgattttgagtataggaattaacaaagccacttaaggggaaaaaagttcccttcatttcttgatgaaatacttattgagctatgtaccatattccatagaaaggaaaaactagatatcttaaccctactaagttgtttagtgaaaagaacatgaaaagttcagatgaaaagtcaagaagtcaacataggaaaaaacagataaactaataaactgaataagtaagtaatacagcttcaattaagtactggacttccaaatggatggaatcatacctttcagggctaaattgtatttgagaatacctactctgaggaataggtttttatgctctggaatcaacacctcaaaattcaacatttaattcatttcactcttcactcattactcttttgtttttgaatatacacatttttcttttttttttttttcctttttttactataagataaaccaaaaataaatggctaggtagatggctggagtttgcttgtttgttttaatgatagtataactgcatatagaaaagcaatatatgtgttcctatatgaacaacccaaaagaaaaataacttttaagtcatagaactttgaaggtctgcaaatagttgttgacttagttattactacgtgtattagtttgctagggcagttacaataaatgccatagacttggtggcttaagctggataaattaatttcctcaaaattctggaggctagaagtccaaaatcaaagagtcagcaggtttggtttcttctgagccctctgtccttggcccttctcactgtgccctaatgtgactatccctctgtctctatgctctgtgtactaaggacaccagtcagatttaacttaattactactttaaaggccctatctgtaaatactgttatattctgaggtactgcaggttaggacttcaacatatgtatttggggaagacacagttcagcccataatactgcatttatctttataataaggaagaaggatttatattattctactgttttgtgtgctgaatgtatttttaactttggttgtacaatttcccttacacctgcatcagcttatcacattgtgccaaggatgtgaaatgaattgcttcaaaatacaccctaattaattaaatattcacaacatttttatagcatttgatttttttccttgttaaacataacagagaattggatgttgttcacataccacagataagccaataaaccagacattttgtcatactctgtattgataagaatttttttggcatggaaatgatgtattttattgcctttaacttctaatacccccttaattacaaacacaatggatgttttactggggatattgtatatgcagcagttgtttaaacctgaaatagaaatgctaagagggaaaagtattcaagtccagtgtagcccaatgctgaaagataaaattgcagcttttgacattttaccaaattattgattgtgttctctggctggctttaaaaaacttaatgcagtgagtaggttaaaaaaaaaaaaaaaaaagaagaagaagaagaaaatggctgggaaagcataaaggcaaaacagttttaaaaaagtatgagaaagcttaaggcctaactcaaatgataagcagtagattttatggcaatggtgccagacagccggggtttgtatcttgactcttcctacttaataactcactatcaggcttgatgtgataataaaataattcatgtaaagcactcagcacatacctggtttatactaaactcaacaatttctagttatatacatagatagacatacactagtacatgtgtatatatgtatatgtaccttgtatatgtatgtgcatatattaatatatgtatgtatgtattcatatacataatatgtatacatattcacattcattttcatattctccagcctccgtttggtacactacaacagtgtgtgtagttgaactaacagctggttctgctgtcatgatggctagaacagcaaagtcagccagagaaaccagcctcaaatggtacatctttctgtaagcagatatatatgatctatagcagcacgtccagtgattgcctcacagatactacttctaacctatgggggaatttttgcatagaaatccaaatcccctcctacctctcctctcagtgcttgagcaatctcttgatacatataaagctttgtaactatccttaagtttttctctggtctacatatggcctttatgcttaactcattgttaaattctcacaggacaaaggctacatacattccatatataacttcagcagcatctgctataagctttcccataccttatacactgaataaatcgtgaaggctgatggaatcctgaaatgaacccataatccaataaaatgagaaaggctaaagacctaacctgctctggactcacattagtctagaagcttcaggaactcactgaaaggcaagatagaataatggttagtatatggactacagattcaggaatacctacatttgaatcctggctttgcaacttatataacttgggcaaattatttgacctctctgtgcctcattttcctcatctgtaaaatgataatcagattatatgtttcccaaggttatgaagaataagcttattcatatttgttatgtgcttagattagttcctggtacaaagtaagtgatagcacttactataagtgtgtactacataaataaaataaaataatgcctggtgtctcaacgctggcccacaaactagtctactctacacaggtcttccagaccaagagtgactataaacctaatagacatctctcaacaaggcagctgtaggtctttactgttcatgttgggttttgccagcagaccaagtattatgaattggctttagccaagggtttcctgaagagattaaaaaaaaaaaaaacaggctggtggaacatttggtatgtgtgtttctttagtggtttacagtctgtgtttctagtgtctgcatcattaatatatttctctttctggatttagaccctgtcattactcatctgtgtctgttttgacttaaacccatcactggaagaaagaaagaatatgggtctcaatgagttctattgcttcattatggtgataactttagtgcccacaaggaaatagttgcatacccactggctgcaaactaggtctgcattcttcaggaaagatgttatatggcagcctttaagaaatgcagtcttcttttaccttcaactttgtgtcttatttcactctacagtttttaagtgaaggagataagaagaaagagctagctgcaaaggtgagagttgaaatatttttacagagacatcattataatgaacatgatggactgtagttgtaaatagggtgagtgggagaaaacttgaagaaagttagaaacagatgaagaaaaggatttcagataaaaatcagggaaatcaatgtcagtatgggaaaaaagatagtaaggtagaaaaggaacttttaaatgaaaagaatgagtaaaagatgattttatactgattttaaataaaactctgtgtcaaagccttttgtaaataataaggttatagatgattgtcatggtggttatgtttgtttagcaaagactacattaatgaaatggctaagaagcaaaatcttaccaggttttaaatatgagtacactgtgtctattgctctaatttttgttacaaacttaccctaaaataggtcttttaggcaacaacagtaatagcgccaatcgcagttactctaccattctaccacagaccggggaacattctcatgaggactccagcattagatggcccattttagggcacaacacttcagccaaaactttggtagagaagcagtttcagtgagtcattcatgatcctaaatcttttggctgtggcctcaagatctcccctctgttcccagtgggaattatggtagagagacacagttaattgcctgtggattttatgactgtccccttccctgcagccggaatcatcatggaattaaacatgcagggaggttatcaagggactctctcttatgcggactgagaaacttaggttagaccctttgaagaattcactggactgaacatagagtctctactgagtaaaaggatctcctctgttaagttgttcatcatccatttatttattcattcaataaaaatgtattgggtgctgtatgagtttcctagagctgctgtaatatattaccacgaactgtgtgacttaaaacaacagaaatttattctctcacatttctggaggctagaagtttaaaatcaagttgtcagcaggcttgatttcttctgagggcgctgaaggagaatctgttccatgtctctctcctctctcctatcttctgttggttcccaacaaaccttggcattccttgcattccaatttctacccccattgtcacatggccttcttacctctgtgtgccctctgtgtctccaaatctctctcccctaatgacaccagtcactggattaaacttatttccaaatatggctacattcataggtaacaggggtcaggacttcaacatgtattttcgggggacacagttcaacccacaacaggtaccttttttgtaccaaatacaatcctaaatgctggggatagaaagatgaataatacgcggtctctgaactcaaaaacgtcatttaaataggggtagacataaatatacaattatagtgtcacaaatattaaattatatgtctcaacaaaatgctatgggaacacagaaaaacagggcaactaacattgtctcaggaagcccaaaatgtttcactgtgaagctgccttttgagttatagggtaaaggatattggagttcatcgattaattcatagttgtgagtatgcaaagggcattgcagaggaatggaaaaatatgtataaaaacatggtatcatgaaaagactttgtatctttcaagatagggaaggagttggtgtaactggagtctagggttagttgtagggagcggcagaatacatagaagagaataaacaggagatggtagacggcagaggacctgtacaatttcatctcaaagaattggggctttaggccaggcacggtggctcacacctgtaatcccagcactttgggaggccgaagtgggcagatcacctgaggtcaggagttcaagaccagcctggccaacatggtgaaaccccatctctaccaaaaatacaaaaattagctgggtgtggtggcaggtgcctgtaatcccagctactcgggaggctgaggcaggagaatcacttgaacctgggaggcggaggttgcagtgagcagagatcgtgccactgcactccagtctgggcaacaagagcgaaagaattggggctttataacatagaatgtctctgccaagactcttggggatgtgttttaatccttaaagtaacaataaatgtatttaagtagtagtataaaacgaagtgaaacagtagttaataaagcatcttgcaaatttggaaaggccattttgattttgagaaaattatttgaattatagaataattttaaggaaatgctttttaatttatttttaggatgcataggagctcaaactaagttaacaagattcagtcatccaaaccattgcctagtaggtgtccttaaggacccagtcttaataaacaaatacagctaaattataattggcatatcaactgtatgtaaattgaagcttataaagtacttgaggggatttgacaagtttgttctcttaagcattttaaatattactcatgttagttatactatttattatctatggggaaggagtttgctaaaccaaggtaaatgtcaatgctagttcctagacaactatcatgaattctgaattagtcactttttatttattcaacaaatatatattacttaacatctacgaacgagattatgtcctaagtagcaggaattcaaagacatgacaagggcacattcatgtcctcttataactcacagtctagttggggagaccaagatggaaacaaagaaacacattaaagtttgttgagttagataatggtggtgcatacagggtgcttgggtgaatgcagtggaagacccaactctttgttgaagaaggctttatatttagcttgcgaactttgaaggataaaaagtggttttcctagaggacaaagaaactggacagtgtagtgaggatccaagggatcaggcacaatgctttaaaaagttaggagaaatgaaggctaagccaaagtcccagaactgcaaaaaattaagtccgtgtggttttggttaggatgagaggaggcaaggtaggagatgaggctggggggttggccagcagccagtaaggggtctcatacaaaggagttagaacttttatatgatgtacgatccactgatttaagcagaagagggccatgatgaaattgggttttagaaagagacctctgggaacaatttggaagaagaaattagagcagtggttttcaaacatttctctttttttttaacacagagaaaacttttctaaagaaaatcttacatctaaccaagatagataaaataagagtgatatttctttcaaataaatattatgcaaatgaaaacaggctacttcaaactcaaaagtgtcaaattgggggttatagactacagcacctgtgttatattagactcagtatcaaaattatatctgtacacagttagttaggaattatgatggttcaactatttttcaactttacaatggtgtgaaagcactatgcattcaagtagaaattgtacatctctcatcatgctgggtagcaacattgaggcttagctcccaatcagctacacattttcagcttctgttgggtttatcagggcgtaaccccattgtaagtcaaggagcatctgtatttattaccgtactatattgagacaattctgattttctgtaataagttgtaaacaataacggttcaaatgactctccctgtcatgtcatgaaacccttcagttgcattggtctagaaatataaaacagtccgggtcgggcatggtagctcattcctgtaatcccagcactttgggaggccaaggcaggtggatcataaggccaagagatcaagaccatcctggccaacacggtgaaaccctgtctctactaaaaacacaaaaattagctgggcgtggtggtgcgcgcctgtagacccagctactcgggaggctgaggcagaaaaatcgcttgaatccgggaggcggaggttacagtgagctgagatcatgccactgcgctccagcctggcgactgagtgagactccgtctcaaaaaaaaaaaaaaaaagtctgatagtgggaaaaaatccctaacaagagtcaccacaactcacagtctttactgtaaatataggcattcaaaactttcttaaaatgctaaaagcattcatagtgtagtcttacatgtctattttatgtgttcacttttcgtttctacgtacacggtagacatggtaaatatctgttgaattaaaatgatcaaaaacaaagtaaagatttaaccaaaaaaatacagacaatataaaaccatgaagattcaaagtcaaaagtagctatagtctctagcaaggcagatgttcactggcatttgtcctctggtctgacttccagccccaatttatataatcctgacctaccagaaattgggataggtatcacttcatggaaaaagacatcatgctttaagaaagaagagacacatataaacttgtatggggttagaggagctatgtccctctctagttccattagaaattgctgttaagaagggttgggagcaaacctcttccaatcctacccacgtctcaaggcctagatcaaatttcacggtctctgtgtgacacactgatatctcaacacttcctgaaggtgacccatatgccaggaacagcactagatccagagatacaagtattaaaaagatccctgccacctctcatctacatttctagcatctgtttttactcatttgccatttgatcatttcccatctgtatacaagactttaaggcccatgagagcaaagtttctgtaagtttaattcaacctactttttttggccacaagctttgtggcaggcgccatgttaggtattaagaaatacaaagatatagaatacaagtcctccagtagcttgcagtataccatgtataaacctcagatggctactaccgtatacccctcaacagccagttagctgtgagagtaaattgtaaattctttcatgctctggccagatttaaaaacatattaatgtgtatattcttttccaactgtgtcttcttttttttttagatggagtttcactcttgtcacccaggctggagtgcaatggctcagtctcggctcactgcagcctctacctcctgggtacaagctattctcctgcctcagcctcctgagtagctgggattacaggcacccgctaccaggcccagctagtttttgtatttttagtagagacgaggtttcgccatgttggccaggctggtcttcaactcctgacctcaggtgatccgcctgcctcggcctcccaaagtgctgggattataggcgtgagccaccgtgcccagcccaaatgtgtcattttagatttcactttcttcttgagaccatgatgatgccacatgagaaatccttaagtccagctccaattatactgcatatcctagaatggaccattacattaacaagaattttcatatgctaaccatgacatgtacttcatatcatgaatgtagatggctaattttcacacattaccatgcatttcagcattccctagagttatctgaagcatctggggggaagggggagagaacctttaagttttctgcttctgagactattttgttgttattggatatcgctttgacccccttcttttagtgcttatcactaggcatctgccgtatttaatgatgtgtgtcatttcatttagtatcactgacttggatcaattcctcttccaggtttctgtactgtcttgatacatgtatttgttttgctttgaaagaaaaatcaacaattgaattgccagtgatagacatatgagtaggaccattcttaatggatatgtagagataatttctcttcctttaatgtctgtgaattatcatccactgtgatgcatttaaaaatgcaactcaacaacagtagtctactgacaaacaggtgactgctgcctgtgatgtgttttcagttgttggcttttctaagtagttacttgtcagagagaaaggaaaaaggatgaaaatatccattttgacacctcttgaaatgtgtttgttgactgtctctcttttaaatcgccctgtacctatttggcatcactaatcacaatgctaagtgactttttactttactaggcattaaacttgtgctgcttaacctttgagcatcaaacaggcctttccccagcaccctgctgtatctttagtacaaaactcctgaatcattatccatcttgaggatctgccttgccttagaggtactctgacatttgctaagacttcccattggaccttgcagacatttccagatcatgacagtgtcatttgatattttggttttaaacatcatcagagtggcttgtgctgaagaaccagaactagaaagaaaatgtaaaatgaaaagaaggctattgcctctgtgctgattgttaagatggcattggaaacatttttgtttttactatggatatagtcataaaaccatgaatatttttcaaaggatcacagtatgaaatacagagccaacggtagaatatattaaattagcccatttgaaagagggtctatctgtaaataaaccttgcagttaagaaagccaattatgataaaactgtatagttacctggtaaactactgtttataaactactttaattttacaatatcttatttgaaccttacaagaaatgtgtgaacatagtaaggtagggttactctcctcattttgcaggtgaggagactgagaattagaaaggacatgtgatggccgggcgcggtggctcatgcctgtaatcccagcactttggtaggcggaggcaggcggatcacctgaggtcaggagttcaagaccagcctggccaatatggtgaaaccccatctctactaaaaatacaaaaaaaaaaaaaaattagctgggcatggtggcgtgcgcctgtagtcccagctactcgggaggctgaggcagaagaatcacttgaacctgggaggcggaggttgcagtgaaccgagatcgcgccactgcactccagctgagtcaagatcccgccactgcactccagcctgggtgacagagcaagactccctctcaaaaaaaaaaattaagaaaggccatgtgacttactcctaatttcctggcttgcatgaggctgagccagaatttgagcctaaagcttctctgagtccaaatttggtgttctctccactatatcgtgctgcttctacttatgggattgggaaatattcgggaattttaattgacaaaagtgaactgtgttcaggacagaacttaaaactaaggtagatattaagggaacaccctatagttcaatgggtgtttttctaggctatagatgaggagaatgccaaggttattacctactccaacaccaccactttgtggtacaaattaacaaagataccccccaaatctatgtatggttggcttgcacaaattaactttgtatttggcaaaaataaaaagccctcaggataatatttcccttatgtagtaaaatagctataatagaatttcacaatctttgttattttctgttgaaatgtccacaggaaaattagaattctgctaattgattttttttctgtatttataataagccctcatacaattgaagcatatctgagaaaactagaaatctattttatttatcttgtaatctgaaaagggagtgttataaaaattaataaggtttcctagagtaggaaataaaaattttaaaaatgaagtaatgataaacattaggctctttaaatatatacgaggcatatagaattacaaatcaacctggagagaccaattggagggaatgatgacaatgaaagtagatgcattttaggatgtttggcagattaatccttcagttttatcccttcagaggtatgagaggtcagtagcatgtctaaatgtaggcttatgttatttacttttcatcatcactgtgaggaagggtgaattttttaataaaaagaaaaaactatcatagcatggagcttgctttttttaattggcagataattttacacttaatatttctctctcagctccatacgttatcagtttaattactctgaggcctcaataaaaaaattaaggaaactaaagtaggagagtttgcagtttacactcagctgttctgagttcactgaaagtgaaatgccaagctgccagggatctactgcatgaagctctcgtgaggctcctgagtgggccgagaagtggcagatgagcttcgtgtggatacggtaaagcatttagtgaaaaatgaaagtgaaagaagctaggctgcattcacaggctggcaggctttgccttctcagtttcaaacttgaaaaagggatctaggagtgactggtaaccattctgtgaaaaaaaaaaaattagctcaggaaggtgttgtaatcacaatggtccacactctgcagatcagtctcaggaaagagattggcatcctaacagaagacattctacttccttagtacaagattagggtcctccagacaggatgaattattgcaagtaattctgattgctgcttctgtttaaaaacaggctgctgcatcaggctagagaaggccctttgtaatgaagtaaaaatgggtgaaaattccctgttatgaaagaccaaaacaattagtgctcttctcttggaaaatataatagttgagtgagaagcttcaaagagctgcctggcccttccactccttttgccatgtgaggacacaatgttcatccattctacagtgtaaggatgcagaggctatgctcagtgtttttgaaatcaagaaatcataaacatttggataggataaatgcaaacctatttaccaaacccaagcatgttgaaaccttaatctgttcaggctgctctacctgagactgggtaatttgtaaacgacagaaatttattgcttacatttctagaggctgggaagtccaggatcaaggtgctgtcagatttaatgtctgatgagtgtttgctctctgcttccaagatgacacttcttgctgtatcctcacattgtgaaatggacaaacgctgtgttctcgcatagcagaaggagtagaagggccagggagctctctaaggcctcttttgtaagggcattaatcccattcatgaggatagaacccttatgacttaatcacttctccaaaggtcccacctcttaatacagctacagtaagaattaagtttcaacataaattttagaggactacaaacactcaaaccatagtaaagggtatctttgaagcattgcagaaacaaatggggaaagggaagtaccatacatgactcacagaacaacttatcctggaagttctaaagaaatagcatgtttaaaaagtgaagtgattcaggtcaactcatgcactatagatacatggttgctttgtaagagaaaccaaggaggaaaagccatcctttctacaaagcatcccttggtgactcccaccaaaaatagaatcacaaggctaaattgatcatgaatttggtattcttcatggctttagttttaaaaatatttttaaagtattaaaaggattagtattgaagatagtaatactggtaatggtttgcaaagcttcttgttcttgtcctactttggactccacctgcatttacacaaagtaccttcctgtcaaagtcatggacctagaaatccaggcttagtgcttgtggatgccatctggtatgggggtcagcttacggactttgaaactccacagatgtccaccacttattaactacatgatcttatgcaagctttttaatttcttggaggcttactcttctcatttgtaaaatggttttataatacctatcatacgggatccttttaagaatgattgacgcaatatatgcaagtcacttaacacagtgcatggtatccactaaatgctaagtaaacagcagctcttactattgttgtgagctaagtgagctatttatacaaccctggattcaaaaagttgtaataaatatggtggataaggtgagcccacattttcctaataaaactttaaaaaagttttatgaccattttgagtgtagctggacttttagaaatgtagacgaaacagtgaaatgtgtagttatgaaatttaatttgtttagttatacagatatattcaaattgtagatgatgcagaataatctcttcaggtatgatactttgcttttcctccccactatctcattttgtaaaacaattctattgaaacttcacgcgtatctctgacattggtgtttctagaagcactggagctaatttttgtgtcatctaacagttttccagagcatattacattcatgtccacctaagtttttagagatacaacactttaatctgtgtatcagagtatcaatgtcaggctttttccgcaagccacaaatactcatttgcataccactaggtccattggcttttccattcatcttgcatgtgtatattggtgatcttcgttaggtatttactgcagggaaatcttaagtaatctttcaaaggcttgtttacaatgatctccaacacttagtactatgacgtcacaccctgtaaacaattaataggtctgtgttaaatttcattatcttaactgccttccccaattttgtacgtttacatcataagcatctaaaacccatattaagttgttccagactaatgcgtgttttccagagagtacattattaagaataatttggaaaatgtcccttggaattaagcacttgaatgtaagacatcttcctctttttttctgcgagataacttgtagggagcaacgggaaggtatgctttatatttgtgaggataggaatagagattttcttgaaatatttatccaattatatgactttaaaatcatgcaagtttcttatttttattcatcgtatatatgtattaaatgccaggatgatccaaacacatagaaggtgaagttcctgccattataggaatttttggaccttagagaatatccaattccagaacaatgcatggaatactttgtggaaagcatttgcagagagaaagctgtgagttgcagcccttgtcctcaacaactgacagcaaatttgtcaacaaatttaattatgtttatatcaggcagaatgtgtttgaagggcctgcacacgtttcacatagggaaaagaaagaggtgaagagagaaatgttacatgtaaaaaattttacatagtaaatcatcacatggaaaaacacatttttcactggcaagtaaagaaatacaacaacaaagtaacaggtagcgacatatatgtattgtgatggctaagcactaagtgaggtgttggagaagctgtagagaaacaggtacaatttcaaggtggtgccgttaggtgacaattcatggaaatgtatacataaaacaatgttaagtgaaagaattagatcacaaaagagtatataaacgctgattatatctataataatgtgtgtatgttgacatctattgaaagaggatttgaaagaatgtaagtttaatgttgatttgaattttctctctgtaacagtgatttaaatgcatactaatttgaaaagaatacaatgaaaaatgactccccatcacacccctaaaacacataataactacacacatcttggtaaatagattgtggtagaatatgatgttcattgtttgtgatgttgcaacattatctataaatcaaggacttaattgaagttgtacttcccttctttatctactgtaagtctgatgaagcattttttgatcactgtttattatagtaatgagaaaagaataaatcttttccttataaatcctgacaatctgcattttaaatccttgcacaacctgaattctttgtctccactaaatgaatacagaaagtttaagcctgtgattgccttatttattctgcctccctacctttcaatagctactcaatagctctttcttgacctttacctgtcagttaatagttggtacattgagatgtgtttattaagtccaggcagctaagattcagatttatatgcagctaatatgctgaatgaactgaagatctactatgtaccacagatctttgcctggtactctacaaaggggacttcacttgatcttggtagtaaccatctgaagtctgaactattatccctattctgatgtgacaaaactaagcatcagttcagcaggcagtcctcttccgagcccaggacagtggtccttcccttgttccattgtgccttttaagtggctagtctcagtgtgttatagagaatagtatagttttaaacatataaaataaatttgtaggaagcagcatatttttaaggaagatctttttaaaaagacaagtgtgttgcttttttcctcatttaaaaaactgtatattgttgctataaaatttatttataagagtggttggagggaggccgaggtgggcagatcacctgaggttgggagttcgagacaagcgtgaccaacatggtgaaaccccatctctactaaaaagtacaaaaattagccgggcatggtggtgcgtgcctgtaatcccagctactcaggaggctgaggcaggagaatcgcttgaacctgggaggcggaggttgcaatgagtggagattgcgccattgcatgccagcctgggcgacagaacgagactccatctcaaaaaaaaaaaaaaaaaaaaaaaagagtggttggaaattttgatacaaagcaattcaaaattatacaaacaatttgagtagaatccaaacatgaagcaagattttctactactttaataatttcaattaaataaaagttaggagctgataaaaccgtttgagggtttatttaaaggggagcatgttattggcatgctgaccaataacactgggaatgtaatgtatcatgacatgtcagataacacaaacaaggacagtttttggaaaatcataaataacaaaatagaaggagtgtaaaatggaagaagcatcaaggggtggttggtacaataagatattaactctgagaaagttttctaactcatcacttaacattatgaatactgaattgggatgaccacaatactagcttctgtatgactccttaaatattgatattggaaatgtgcaccacatgataaccaatattttaaggtgggggcaaaatagctgctggtatgaatctctagaaagattaacttgaaaactgtcttgtgtaacaaaaggaaaggagaacatctgggaggagaaaggaaatttcctagaaatgggaaatgtggccataatgtgatttctttctataacccatgtatgcaaaaacatttatctccttttactctagtcacactatgtttgtggcttgcatgagtaagaaagctagatgaggagataattgttcagcaaaagaattatagagttgaaatcagtgaagtgaatggtattttatagcaaagagatccctaaaagtaggtggcataaagaatagatgcaaaaaagtattgctttctcttcgagttctaaagacctctgttgatgacgttttgctcatttaaattccagagaataattggaaacagagactttatgcgacagagctttcatttaacttgttcacctgacagttggctttgaatgatattttattaccaatcaacctaaattaaaatacccagctcactgtaaaaccctgcagacagtgtctggaatgctaaaacacataccatatataaataaaattaaggtaaggacaaagattgacaaaagcaatgacagtgaacattaacatgatatcagcagctttgagcttctatcaacaatgtggaccatgatgaagttaccagagagggcagtatagatggattttctaacttgcatttatcagaagagattttcacttttcaatcttaactatgtcttataccttttaataaagatgtggtatcaaacatcgaacatatatgtctgtacctacatgtaaatatatatgcatgtgtgtatatgcatagccatagctatccatccatccatcccaaagttcatctctccaaggtgctagtccacataattgcgttcagttcttctctggtctttgtataaatgtgtacttaaggactttgtggatagtgcgtgatataaatatggttcaggcccatcaaaatgcagattataggatccggtgaacttttccttaccaaataactgaattcctgaatgttgtattattataaaattacaaaagtttcaaacttactgctattctctaattacttctatagagtgattattatatgggatcaccagatgatcatggtctgtcatgctattgctatctttcttcataaatatataatttatcaaagcttaattatattattatccaataaatgaatgatagaataattatggttatgtggttcattacgttatgtcccattctctgactgaagcctctcagtttcatatctttgttgtgtagactatttatgacaagttaaatctgttctctggaacttagtgtcatcgtctattaaaatgaagggttggatttcaattaaataattcataaatttcctgtcagctctaaaattctatgttccattgattatcctcaaactattatacaagttcataaggccttctaatatatatatatatatatatatatatatatatatatatatatatatattagaagatagatagatagatagatagatagatagatagatatactagaaggccttatgattagaaggccatatgtgtatatgtatatatacacacacacacatatatatatgtatgtatagtgttcagttcttctctggtctttgtataaatatgttttatatatatattttaaaacactatattaatgtgcatgaattgagaactgctgtggtatctaaactcctttctgcttgactctatgatgagagatgaatgaatttggaaatatttagtccaagaaaagaaaaagtgtggggataatcagtcttcaggtttatgatgaattgtgactagctttcactctcttgtaaatgatagacaaagagagaacaaactgtaccaaatctcagaatgcataatgtgatagtgcattaaaaaatgctgtagaagctggagatacttagggaaggtagtcatttgatgcaaaatatcagttaatctcctctctagtgtgctttaaagccagggaatctaaaatgggggaagccaaggaggagtagagttgtttctcactgttcaacaggaaggcactttatgtattttcttatatattaattatttctgagctatttctcctaagagaaaacccttagatttggcctacagaagatgtacttatcattggcctttaatgatacagacattgccattgctaccaaagttagtttatatgtacaaggttatatttaattagcttatgtagatcaaaatgcaaggacagaacctaatccctcctcttcctctgtactaatcaatttataatctgaatgtgtcagaattcagattatgaattatgttgtatctattaatccttgtaaccacagcacattttataaaaatatacatactttgattctaaatgataatatagtgcacgttcaaaaccgagtaagtcacagttggtgggcacagagacattggtaataatgggatcctccagctagcaccaagtctctgttttttctttaatgttatatgatgaaggtaataataggtggccagtaaggataaaaagccacccaagaaagaaccagtcttaaacttggctcttttgcttttttcaagttttctcataatatattcaattccatgtaaatattgcaaacagctgaattgcacacattaacctaaacatgaataaaaaatgttgatattttatttaacctaaaaatagtagttatggataggctgcttttatgattatcgtctttaaaatatatcattttacattgggaatatagggaggattgtcaccgttattgtataataagaaaatttgttttgagtacattaaaaatacagtagatgattattgcaatataaggggaaaagttgtttgcttttgacagtctgtcagatgtagcctaggaagacaagtatggtagctgctttatataaaacagtaggagaaggacacaagctcaaagaaattttacctagctgctgttattaaagaaattcttttatagaatagaggctggttttttttttcatctttccgtttttgcttccatctctgaatcctttgctttcatatggcatgcaaagcgtctgtgcatggcagcctgtaacttctgttatttaaactgccaactgttaaaatggattgagttgaaccagaggaggaaaatagccccactgaggcaaatgcatttttacacccttctttaataaaatattgtaaggtatagctagaaagtttccccttggactttcatctaaaactgttagattgtagctttgtgaaagaatcattgttgactcctgtcagacagttttggagaggaggtgaagaggcttgtcttctgactttctgtgcactttgtcaaatcaggtactttgagcagaagtacgaagtgaaggctgatgtcagagaatgccttgaagcaggaacttgtgctagtctcctgtgacttcctttttttttttttttaaggaatcagattggattgtaaaatgatgggaatatgactggacataaacacgttcattgcaggctcagcagccgttacatatcattagtgaagggaggcaaggggcaagggggaccattttgatgtcagtttcattctttttaaagacaaatgcattcactgatgagaagtaaaccagcatctgtaaaattttacagacaagtaatattttaatgccttcttttcctgtagataaacgtataacttttcaataatcattaatataaactgaaataatgagtaattgtgttaaatacccataatgttggagctgcttttaaggaaaccagttatgaagcaactgtaacatcaagatcagtatatttctgttccaaaatagtctgtttcatagactcagtacatagcttgctgttatgccacttcggccacagttaatgccaaaatctaaaattttaaaggtgataatgctttttaataagaaatataatttggccttaactttccccttataaaaggccatattccatacacatcaactcaaaagtttgtcccattttctgacttttctttttctttatttgccaaagaatctctgtaattggcttgctctgcaaagcattttatttgcccttctgaacattaactattttaaagatccgagtgtattatggcagggaacacaagattttacttcaaccccttctatgccctcctctctactaaattaattatttctgttttgagtgttccagggaaagagtaaaattgttaaggtataacaggtaccaacgagtcatccaaacagaagtgccattccaggaaagtacagtatctgtgtgcccagcatggatcttggccctgccctacttttaagcttctaacatatcttcgtagtcatttcttctgtattgtgatttttttttaagtgagcacttttagatgtcccatatggtttaaaccaaatcagaaattcatgtccttaatgtttcgttagtcagaataattaagttgatagttcggggagcagtggaagcaaaataatggggtcattgaagcagtcaagctctaatgggaacctgagctcattcagataccaaatctaataattgttctacacctgtatgcccagtcccattgagcaaattcacattaaaggtttagtggaacagtttcaatgctgtggtccaaagggacttgctactgttttcacaagaaagcactgaatattttttggcaatatatatatatattttttgtgatgtgttaactaagctctgtgcatgtatgttggtgccctatccctacctagagaggaagaaaagggagagatgtattttcaggaatgtttttcttaccatttagggttaataaagatactctcaagcatttgccacctggaagcaataatatgagatgattaaactcactggatagtttggggagagggggagtttggttaatctatgcaaccaactagaaatgaagttcacttaaccctttttcttcataaaataaaatggtatcaaggtatcaagcatgtttttttggggtttttttgtttttttttttgtttttttttgaggtggagtttcactcttattgcccaggctggagtgcaatggtgcgatcttggctcactgcaacctctgcctcctgggttcaagcgattctccagcctcagcctcccaagtagatgggattataggtgaccgccaccacaccctgctactttctgtattttcagtacagacagggtttcaccatgttggccaggctggtctcgaactcctgacctcaggtgatccacccacctcggcctcccaaagtgctggaattacaggcatgagccaccgtgcccggccatcaagcatgattttggttattgaagtagaaagtagcaattaagcattgtgtagtaatgcactgtttcatttctcctgtgtcactatatgactgtaacaacaaactgactgcctttgattctcctgtaagatatctaaagagagttgacaaacctaaaaaaattaaaggtctaaagagtggaactatgaatttaattctgccgtaaactgaccattgaactgacctatctccaatagaactccctcattggaggattcaaagcacacaggaaaattaaacgatttgcaatttacctttaacaactatgaaatacagatctgaccagctttctttatcaaaaaaggcaatcaaagctgaattcacttacctaaagaatagttctaatacacatgaaggtattcattcaaatgactcttgtgctctaatatttttatttcctttggggaattcaaaaatcatttaccaaatgtctcttatattacaggtaccaaaaaaaaaaagatttaaattgcagttgctgcctttccagagctcacgataaaatgggggaagatagatcgcacagggacaatcacagtataaagctcaagctgaatcttaacagatgagtaggagtttcttgggtaggaaaagaaaaaggaagagaagcatgatccaagaaagggaacagcatttatggaggcaataggagaacacagtatattcaaggaagagccaactgttaacattgctggaacataggtatgagaggctggaaagatgaatagtcatgataggccatgtataattagttcgattattttactacatgggtgataaggagccatttcaggcttagacttatggtagcatggctagatatacattgtagaatgattatcttctaacgatatagaaggctgatagggtaagggtgaggctagagacaggagaaattcaatagggatctattataagagcctaagcaacagaagcataaggcctgcactagagcagtgacagtggagataatgcagaataaatagatgcaaaaatgattcaggggttagaattgactgaacttattgagcaactggatatgaggataaaaaagggaaggattctcggatgatttattgatttattttatgattgctatatgatagctgtagtaattttattagggctgctgtgacaaagcaccacaaactgagtggcttaagccacagaaatgtattgtctcatagttctagaggctacaaatccaagatcaatgaatgggttggctgtgccacgctccctgtgaaggtgttagggaaggatatggcccaggcctctctcctagctcctggtggttttctggcaatctttggcattctttggctggtagaagcatcacgttgatctctgctttcattttcacatggcatcctctcttggtgtgtgtttgtctccaaatgtttcctttttctagggacactagtcataagggattagagcccaccccaatgacttcattttaacttggttacctccataaagaccctatctccaaataaggttacctcattctgctgtactggagcttcagagatccaatatatgaattaagggggacacaatttaacttataagatggctctaatcatcaaagttaggatatataaaaaggagggaataggatgaaaggaaatgaaatcagtttaatttggatctgcagtgtgaggtagctttggaacaatcaggagaaatattgagaaggtgattgaagctgtagcttagagcctgagaaatgcagagttgagatccattagcatgcaggagatagaatagttagagcagttaagtttggcaattggatgagcatacccctgggaagtagctcatggaaagtatagagttaaaatatgggaaagggcaaagaataaagtgctgaaaattactaacacgttgtgaccaaaccaaactgtgtctgtctgcacacaagcaatggaaagccaaacaccaaagcactgtgtttttgcagtgagaaagtttattgccaggcagccaagcaaggcgataggagtcaggttcaaagctgtctcccatactagccttgcagccatggatggatttaagggagagattttgaggctgggatctgggggctggacagtgattgactgtaaggaaaagggggttggaaattcccttgggcatgagctattgaccatgcacgcttcttcatgggtcttatgttcagaaaatgatctgagggtggagattttggccctctgacatcaaaaggtcactcaccaggcaagcaagtctattctgtgcagactgcagtcagacacattaatgggttccaacttgtcccagactgtaagccagttttgttgcaaactaagggaattgtaacaaagtgttttgttctctgttctcctgcaagacaagctcaagaaattttgctacttaccaaattctcaaggaaaaggatagtagcatagaaacagagaaagattaaagaaataatttgagaatgaagaaagaataataatatacaagctaaaagaaaagagagtttcatggaaagaataattgtcaacagtgtcatgtgctacagagaggtcaaggaaaatgaagactgaaagaaaaaaatgttaatactgactgcagaatgtgatattgattcaggataggccaattcataaacaaagtaatcatggaacataccctgtattttcaatagaatttcactctacttgttactagagaaaagaatgaatttatttatatagtataaaatttttatacttataaaaattatattttttctagatcatgtagtttttctaatccataagaaagtcatatctcctattttactgtctttcaaaaggtagttaaataatcctgacaaagggaatcgtttagaaacaatacatacaaattctgccttggtcttgaaattttgatatttatggttatggtattttgcgactaatgttcagaataggataaaatagggcatctcagaataagattataatgtggttggtcagaagaaagtcttctaaggaagtatctttcacttcaagtcattgtctgttttttatgtagttaatgctggagctctcagggctgctaaatgtcattttatgtactacttcacaatctaaccatacatattaaccttttccttcaacacccctaagaacagaaagctgtctctagaaccagctttaaagattcacagttagacccagagtaaaagaacagattgaaaagatagtttgtaaactatttattgtcctgcacgaatatgtatatatgggaacaaatgacatatttctatgtctataaatccttgtaaaagttttattcagagaaagaatcagcatgtatttactacatggctatttaatatcgagaaagctaataaagaggtagaagaggctcattctctgccatcccagaactctcctcttagaaaggcaatatctgaaatgatagtgagcagtacgaaattggctataattgaaagctgaattgtgtgaaacaagctaagtttgtgctattggagtcgagaggagagaaagatcagcgaaggctagagggatcgggaaggtgggatttgagttgggctttgaaggataagtagtcttgaatggaggggaaggagaaggcaaagtgggtacataagcacaaatctggaagatatatagatgtgtttgtggaacagttgtgaagccaacctaactagattcaagggggaatagtagagaatgggagaaaatctgattggatagagtgggatctgtgtaaaaacaaacaatttttaaaaacccagaaaatatgtactccatgaatctctcctgtacttttttagctgccacaaattttggggccaaatttattacacatgtattctaatctgccgaagctacatcctttagtgtgaatctgttcacttttatcttcatatgtcttctcttgcagtgaattttaatctgagtccctgaaagttaacttgttaccatttttattgttgtttttgtcttttcttcaccacttcaaattaggattgaaccagattagtcttgttttaaatccactgcagccttttgagctggggagtacggtctctttgagaaaactgttttctttctttttttttttttttttagaactaagcatttgttgcagtttattggcactgcatatttttatttttatttatttttatttatttttattattatactttaagttttagggtacatgtgcacattgtgcaggttagttacatacgtatacatgtgccgtgctggtgtgctgcacccactaactcgtcatctagcattaggtatatctcccaatgctatccctccccgctccccccaccccacaacagtccccagagtgtgatgttccccttcctgtgtccatgtcatctcattgttcaattcccacctatgagtgagaatatgcggtgtttggttttttgctcttgcgatagtttactgagaatgatggtttccaatttcatccatgtccctacaaaggacatgaactcatcattttttatggctgcatagtattccatggtgtatatgtgccacattttcttaatccagtctatcattgttagacatttgggttggttccaagtctttgctattgtgaataatgctgcaataaacatacgtgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgagtgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcacatgagtaggttgcgaaatttttctcccattttgtaggttgcctgttcactctgatggtagtttcttttgctgtgcagaatctctttagtttaattagatgccatttgtcaattttgtcttttgttgccattgcttttggtgttttagacatgaagtccttgcccatgcctatgtcctgaatggtaatgcctaggttttcttgtagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttttctcaggtttgtcaaagatcagatagttgtagataggcggcgttatttctgagggctctgttctgttccattgatctatatctctgttttggtaccagtaccatgctgttttggttactgtagccttgtagtatagtttgaagtcaggtagtgtgttgcctccagctttgttcttttggcttaggattgtcttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctaaccatgagcatggaatgttcttccatttgtttgtatcctcttttatttccttgagcagcggtttgtagttctccttgaagaggtccttcacatcccttgtaagttggattcctagctattttcttctctttgaggcaattgtgaatgggagttcactcatgatttggctctctgtttgtctgttgttggtgtataggaatgcttgtgatttttgcacattgattttgtatcctgagactttgctgaagttgcctgtcagcttaaggagattttgagctgagacagtggggttttctagatatacaatcatgtcatctgcaaacagggacaatttgacttcctcttttcctacttgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatatgtcccatcaatacctaatttattgagagtttttagcatgaaaggttgttgaattttgtcaaaggccttttctgcatctattgagataatcatgtggtttttgtctttgactctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatactggcctcataaaatgagttagggaggattccctctttttctattgattggaatagtttcagaaggaatggtaccagttcctccttgtacctctggtagaattcggctgtgaatccatctgatcctggactctttttggttggtaagctattgattattgccacaatttcagatcctgttattggtctattcagagattcaacttcttcctggtttagtcttgggagagtgtatgtgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagaggtctgtcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttggtgctataaatttccctctacacactgctttgaatgcgtcccagagattctggtatgatgtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagggctttacttccaagtatgtggtcaattttggaataggtgtggtgtggtgctgaaaaaaatgtatattctgttgatttggggtggacagttctgtagatgtctattaggtctgcttggtgcagagctgagttcaattcctgggtatccttgttgactttctgtctcgttgatctgtctaatgttgacagtggggtgttaaagtctcccattattaatgtgtgggattctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgccttttgttgttttccatttgcttggtagatcttcctccatccttttattttgagcctatgtgtgtctctgcatgtgagatgggtttcctgaatacagcacactgatgggtcttgactctttatccaatttgccagtctgtgtcttttaattggagcatttagtccatttacatttaaagttaatagtgttatgtgtgaatttgatcctctcattatgatgttagctggttattttgctcgttagttgatgcagtttcttcctagtctcgatggtctttacattttagcatgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttctttaagaatgttgaatactggcccccactctcttctggcttgtagggtttctgccgagagatccgctgttagtctgatgggcttccctttgagggtaacccgacctttctctctggctgcccttaacattttttccttcatttcagctttggtgaatctgacaattatgtgtcttggagttgctcttctcgaggagtatctttgtggcgttctctgtatttcctgaatctgaacgttggcctgccttgctagattggggaaattctcctggataatatcctgcagagtgttttccaacttggttccattctccccatcatttcaggtacaccaatcagacgtagatttggtcttttcacatagtcccatatttcttggaggctttgctcgtttctttttattcttttttctctaaactttccttctcgcttcatttcattcatttcatcttccattgctgataccctttcttccagttgatcgcatcggctcctgaggcttctgcattcttcacatagttctcgagctttggtcttcagctccatcagctcctttaagcacttctctgtattggttattctagttatacattcttctaaatttttttcaaagttttcaacttctttgcctttggtttgaatatcctcccgtagctcagagtaatttgatcgtctgaagtcttcttctctcagctcgtcgaagtcattctctgtccagctttgttctgctgctggtgaggagctgcgttcctttggaggaggagaggcgctctgatttttagagtttccagtttttctgttctgttttttccccatctttgtggttttatctacttttggtctttgatgatggtgatgtacagatgggtttttggtgtggatgtcctttctgtttgttagttttccttctaacagacaggaccctcagctgcaggtctgttggagtaccctgcagtgtgaggtgtcagtgtgcccctgctggagggtgcctcccagttaggctgctcgggggtcaggggtcagggacccacttgaggaggcagtctgcccgttctcagatctccagctgcatgttgggagaaccactgctttcttcaaagctgtcagactgggatatttaagtctgcagaggttactgctgtctttttgtttgtctgtgccctgcccccagaggtggagcctacagaggcaggcaggcctccttgagctgtggtgggctccacccagttcgagcttcctggctgctttgtttacctaagcaagcctgggcaatggtgggcgcccctcccccagcctcgctgccgccttgcagtttgatctcagactgctgtgctagcaatcagcgagactcggtggggtagggccctccgagccaggtgcgggatataatctcgtggtgcgccattttttaagcccttcggaaaagcgcagtattcgggtgggagtgacccgattttccaggtgccgtccgtcacccctttctttgattaggaaagggagctccctgaccccttgggcttcccgagtgaggcaatgcctcgccctgctttggctcgcgcacggtgcgtgcacccactgacctgcgcccactgtctggcactccctagtgagatgaacccggtacctcagatggaaatgcagaaatcacctgtcttctgcgtcgctcaggctgggagctgtagaccggagctgttcatattcggccatcttcgagaagactgttttcaaagctggattagagattgactagaaaggaagaaagcctgagtatagtgattagtctacccaatgcattgtttctcaaattttaggtgtagtaaaagggatctgtggatacattttaatgagaacctaataattttgggtccccagtaatcgacttagacttacttttaatatattgttgcttaaatataaaaataggcataaactctatatgctttaagaattttaataaaacagataaaactaaaattaatgttcacttaatgtgcctactgattctagatttaatagtagagcttcagatccacttatacctttttttgaccttatcattacaaatgcagaacatccctgttgtataagtaggctgaacaaagtggtactagtaccatcagtcaacattttgtgatagaattcagggtcatcagactccataccaaatgaaaattttggtagagagcaactctcaaattccagttttaataggatgtctgctccagaaccttgtaaagttgtgttgctcacatgaagagaaggctaggattggaatataacatgggtatttaatccatttactgctggaatcaggaagcaaaaaagtattcagtacatatttaccactcaatttttagatagtgaacaattgcaagttggtccacaaggattacatccgtataatacaactgatcatgtcctgaagacggtactgactgttatgtcacagttctcatatgtccagcttgcctagactgttgtgtgaaagagcattgcaccctgtgatgactcaagtctctgaaaaattttctctcttcaaattatcatgaaaccttcattagtacagtgcacaataatgttgcttggcttttacgtaatataaaagcaaatatatataagcctttttgtatatcagtgatcagtacactagtcactcataaggtgatgatgcagggtatccttatgtaaacactttttactgtaccataaagtgaaaacacaaaactgtaaatataccctgttttaagaaataatgccctagtgagctccactgacttttttttttttttttaatgaaattggctgcaacattgggaattacatcatgtaattaatatctttgttacattgggctcttttagaacagaaacttactctggaccccttaagaaacaaaatgaattttacttccttctgtgtgtctgttcttttctatttatctttcaactggcttactgccctattgagtagtgcctttcatcacaaatcatgccatgtgttacctatgaattggctgcccctgaaggaaactgatgtccataatggtcccttcattggccactgttgagggggaaaaagcctatttagtactgctttcctaagtaaaaaaaaaaaaaactattgagggtgatggtttcagctagaagtggtgttgggtacatcgggcacaatgacctgaggcaactgtttgcactctaagaaaatatcacccctttcagggtcatgggaaatccaagtgtaagttatattcattgcctccacttactcctcaaccttctgcaatctggcttctgctccccttatttcgaactgaaattgctctcattaaggtctctaatgacctccatatttctaaatctgatagtttgtctttattttactgcatctttctacaacatatgatattattgcttattccatttttcaaaatatctactcccctgaattccataacgtgtactgtaatggttctttctatgcctctctgaatatttgctgttttgtttcatggactcttcttcctatacttatctcttaaatgtcactgtttcccaggatttgatcattagcccactgcttttctcactttacgtacattcctgaatgatggctttgataaccatctaccatctattacccaaatctctctcactcttttcaggcctctcccctgaaccttggtcttgtaatatttgtaacggcctgctgggcaggtccactcagatgttttaaaggcatacaaattgacaaatccctaactgaactcatcatcacctggaatgcacctttttctcctatatattcttagatgatggaaccaccattctcccaaacatataggctggaaattttagagtgatcttggactccttttctttaattttagagtgatcttggactccttttctttcctacatgtccaatgaatccctaattattgtcttgtgcttattaagttcacctactgcatgatcaccaaactgaactgtcttaccacttcactccctattgcatatctgaagttcaagagccttaaaatgacacataagcccaatctgtgttctaaccatcatcccctgcttttaatcaatactgattttgtttgtcatcttcacacacactttttttacctcatattttctcttcctttcctcacagcatctccttttcctggaatatacttttcttccaggataattcatccatatcctttaagaatctacaacaatattgccttctctagaaagtcttcccaaagatgcttcccctaaggcttggctgagtatttaatttctgtactcctgaacagtatacccctcatcatagcacacactataactctcttctcattatctttgtatgctaaccgcatttgagagagaacaccatgaggcaaagggctgagacatttcattttggtatcaggggatccaatataatctaagttctcaaactgactcactgagaactatataacagagtaaagagaaagccttaatacatttccattagactaatttttaaaccaaaatgccacaatcactacatagtacctgccttgaaagactggctcatttatctctgtatccctctagcactgtgccaggcacatagtcaatgttcaagaaaagatggttgaaataaattgcaggccagtttttggacagagggaaatatgcctgacattggaacagactctgcttatgacagcaaggctcctcctctttcgagtgcataagtctactcaggaaaccgaattgaatttcagcaggttgcctggtaaatctgctgtcctagaaaaaaaaaaaaaaatgagtgaccggttttgctagatgcatcattcaagccaggctggaatctctagaaataatctctttctaccctaagggacaaatctgtccagacaactggaatcctaaagcagcgaagtaatagaaagcagtctggcaacatttctatacccactggatgacaataagaaaaataagtaaatagttatgaaagattttcattgcttctcaagggcataaaaaaaataccctcgcctatgatgacttgtgaaatagagttagaaccttgataaattctgacttctggctgatctttttaagtctttgttttaataggctaatctgaaaaatacttctataaacatctgtttgcatctaatctcattgtcccaaaagtgactaaaaaatgtcatagtaccataatgaggctgtctagactttgaaaagtgtaatatgatcgtgatgctaaaatctttggaatttggctctcacaatatctaatatttaaaatgttcagctttttctctgtatcgggtgccattctggtcattttactttattgtttcattactaaagtctttgtaactgccctgttaggtgggtctttaatattatttttatgttcacaaggggaaattaaaatgagaaaaacatagctcttaagtggcagaacaaagatgtgaacccatatgtatggccatacactgagaactttgacctgtcacgctaaattgtgactatccattgtaagtagaaacagttttttgcttgaggcttgtttattgatttgtgtgcatgctcttcacatccatcagaagattagtatgggccaggtactagattacctcatttagttctgttaatactcttcagtgtaagtaccattattatccccatcttacgaataaggaaactgctgtttagaaaggttcattttgcgaatgcataaacgcaaagtgggcctaattggttaggaaacaaatgagtctagtagtctacattaataagttcaaagactacacatagcagttagctttactttgctccattgttataagtggtaagaaagaatataatgcttagtgctaagacttccctttccaccccacactgcctgcactaggaagggaaaattaacccggaatgcatgctttactaaacatcggtcagtaccttttaccatcaaaggacagactttttttttttttgaagtctcatgtgatttttatcattgaagtaaaactctctccaggtgatgtaatgacatacctcctattttttctggatttttacccatctgtttggagagagtcaatcttttagagagaatgactttttaagactttaacttttagaatttataatctaagatacgtgaaatacctttataaatgataactgtgtggacacaaatttattcatgttctaaaatttgtaagccatgactttcccatcagggaacattccacggcccttactgaaacagggcagaaaactggcacctgttttatatcctttttttctttccattatagtatacttagtgatggtataatcaacaaggaattagtttagagattattggatcctatgctactctttcttaaaattgaaaacaatatgtactttgtagctaaagactgagaatttaacatcctatctagattttgttctctagtttgacaaattaatcatgctcaatgccaaaaattcagatattatagaaatatatatatatatatatatatatatatataaaagaatcagatggttgcggtggctcatgcctgtaatcctagcactttgggaggctgaggtgggtggctcacctgaggtcaagagttcaagaccaacctggccaacatggtgaaaccccatctctactaaaatacaaaaattagctgggcatgatgacgggtgcctgtaatcccagctactcgggaggctgaaacagaagaatcgcttgaacccaggagacggtggttgcagtgagccaagctcgcaccactgcactccagcctgcacggccgagagagactccatctcaaaaaaaaaaaaaaaaaaaaaagagtcatcccaccattcatagatagccactattttttattggtgtatatccctctaaactttaaaaattataatattataaattatatttttttcaaaaagcagattatgacatactcttataacttgcctttttcaccttatcatatggacctctttttatcaagtacatgtagatctatgtaatagtttagattgactgcatagtatcccaatgtttgtaggttccctgttttgtctaatcccatgatggacatattggttatttatgatattcattagtataaacaatgctgcaaagaacatcagtgtatgatgatctagctttatacatttatccgataatgtgaggactggctttgtcccaatagatgtaaatgtcaggaatgattctttgagacatcttatatgagaagcaagttgctaggttagtagccatttttattcatgtataggctcagcctggcactcaggttgtgcatggattgtgttagacactagaaatataaaggaacttgtgccaattatgaatatggaatcaagaagctgtgttttaactgtgtcctaattgttcatatttaaaacaacttttgactggcttctaccttaagggacaatttgtattttaaaacaatggcaccgacagctgttaaagtgtgtgtgatattaaccatacaggttgcctttgttcatacaactggttaagtaattaagcacaggctagcatggggaacattgctaatgggaagcacctgtttatagactcttgcattgtaagctgtaggttaagtatcttttatcaaaatcataggcagtggtatatttctgtgatctggttctttgggaaatggagacatcatgcagggtgaatgaacgactgccatttctgcctcactgctgaaactagcgagcctgcatatcaagggtacctgggcttacttaagctggggagttggactgactaccctaaaacttccatcatcagcaagaaatacgtagcccagacccaagagatgggttgcacatgttaaaaacaaaaagagtagatacatggtcttagagtgattcagaaacaaaggcagatgacaggtaagtgtattctaagtcagcatatcagcaacaaagttcaggcagatcacaaacaactgcctcagaaaatgacagaggattgtccatcatgtgctcaaagttagagaaatggctgatgcctactattcttagtcataggcatatatgccacacatggagtagaaaggcacagagatgacaggtgatagtaatgaattgaccttgtagccaccatgccgtttaacagctagtttattctccaccaacccaaatggctgcttgagctctcaccctgccaaacactcctggcccaggttattgcaatctatgccttcatcggcttttctactgtcactcttgatactatctaggatatctaggcttcaacaatagaacctcttcggaagatttcagagagcccatttctgctcactttttaaagcagaactcctgttttctatgtaaatgcttcaagactgtttttttaaaaaaatagaattaaaattaaaattacatgtttattgaaacagctgtcactgtcttagttctaataactacaagtccagtcagtatattttatttcattattttcttccttagaaaataaaggttaaatatgtatagacattctggttcttcctttatacattcattgcttttcataccctctttgcaaataggaaacatttagtcattaaatagcaatattcgagaactagaattccctttttctgctaatcaaaaattaacagctatctttctgtttcttcttgttgaaatccccctatcttttaaggcttaactgggaagaagttgtccctgactcccagctcctgtactcaagggatatgatttttctccactttgaacctccattgtacttaaaatgtaatagatgctacaagagacaatatagttagtttcatgttctagttgttggtacatttatcctttctaccctcataatgtgcaagggtgcctgttaaggtaccctgcagatagcttatgcagtaacaacgtgtggatagacagacagaagaaagcctttcctttccttgtattaatgtcaaaatacattccctctgtgaaagcagcagagctgaaggtgaattcaaggatcagtttctgatttggtgctaatgattggatgattatttaatcaacagacaagtttctagaaactactatgtataagccactatcatagacaccttgagcatctctgttgtagtttgtgtggtttctgttagcttgctcttcaatatgtttcacatatataacttccttggaagctttaccagctattgcctaactttcttcatatatttatttgtcacctttttctgtattttctagatatgcaggcatcctcatcagactttgaacatcatagagagaaaatctgtcttacgacccaattgcattctctagtaaagaagcaaacataatgcatggctcatatacaaaaccaaggacatttaaaaaaatctattcactagctttgacattgagtccaaagataatcaatggcaaggtctgtggcagttgaaatactgaacaatatactgatgtaattttttcttaaccatacttttctaagatttcttgaaatgcccacgttatcaattatgtaaatgccagtcattcagaatcccaagagattggctgtacatgttataaaaatatcatgtttatggtagataaaagtaagtattgcatattttctacatttgtagtttaatgtggatacatttttaatgccttgaattaatattattgtactatgtgattttacttttatcaggtatttcaatcttcctaaagttactataattgagtttgtttgataatgtacctttacattagtacgagacttgatagtttgcaaaatatgaggttcataatagagatggagagtagagttactacctggcagggaggataagaagaaagtgaaatatagaaaagtgatttaatctcactactgcagttttgtaaaatctaatttgtttttcccctagcacagcagagtttcatgttgataacaagctactgaattaataaatccattgcaactattgagatttttcctttaataacataacgaatgctgagcattaagaaaaggaaaggcgttctttgcacagaagttacctctagcagatctacatccctatgcataggaacaataccaacatcataccgtgaacaatatcaatgtgaaagtaatttgtgcatctcaattagaatactgtattttctacacaaaagcactctgtttcatggaacacatttgcttattttccaattggaaagacatttgggggtctattttgttatcattacatgtgcttaactccaattacagttaatgggagtcgtgtgtctatagtcacagtagcctctgaactattttaacattattgctttccattaccatcctcgttaaaataactttcatctcttctaccaacctgaactaccacagtaatctaggtttctgttttctttgcacggatttatttgcatgtaatgaaggatacagattacacaacatgacctgtttctagtttgcacattataatgtcattgagattagaataggtctagaactatttaattgctaagtggaggtaatcgattggcttctagacgagtacccattgggtttgtttatctagctgtgttatttttaagttgttttgggattatagcatgtagagttctaaaatgtgtcctaaaaaatacatagtttaaatgaaaatatgagtaatggaggtttaactccaccagatattaaaacatctcatgaggctgaaataatgaaatcaggagctattggcacaaaaatatggaataatctcaatgtcaatggaacagaaacccgagtatagcaatttatatttgataaaggaggtaacatgaatcattatagaaattcatgattattcaacaaatagtgcaggaacagcccatctcctctttgtaagaaaaaaaagaaacaaactggtgtggaaacttacctgacattgtacaacaaaatgaattatagataatttaaatagttacatgtaaaaaaaaaaaacaagttaaaccttaaagagcaagaactcatatagttgaatgtttgtcacatgtctctggctagagaaggactttctaagcttaaaaacaaagaaacaaatcacagtgtaaaagattgatagatttagtttcataaaaacagcaaaaaatgaaaccatatattcctaaaaacctacaacacaaaataaataacaatcaacaagcaatcaacaaacaaaggaaaatatttctaataaatatttcaattgtttagtatccctaacgtgtaccatttaaaataaaagcaaaagcagaaacctaagatcccaatagataaatgggcaaaagacatgatcagtatagaaaggaagacatatgaaacgttccacctaattagtatttgaataaatgcaaaaagaatgaatcagatgcaattttttcactttttatattagcacatttttaaaaagattaatacctaacaaagagataagatacacaaattcatatactgccaattggatttaaattaatacaactattctggaatacatttggacttacttttgcataccctaacaatgccacttctacatatggcatatgtaaagatgtaactgtcatgttccagaagtttaatgacatggaaaatttctacaatacaatattaaatgaaaaggtagaacaccaaactgcatatgtagtttgagctcagtatatatatatatatacgtacacatacacaaaagacactattctggtcacagtgaggagaaagaatctggtcaactagtagagcaattggctgtcccccacaaagagattaggctcaagcctaatttggctgccaccttgcagtcatttctggtgagtaaaaaactatttccaagtcaggatttctaaaatcacagagaaaagcataaataaaaccattttggacacaagggggaaaaaatgtaagtccatatgagatgatttcagtataacagtccaaaataaatcatctttctctcatcagtgcttgggatgcaaatagctactctatggacatttttggaagcaacataaaaagttttcttggtttccttagcctaagctgcaatagacccagacctctacttgctctctttgccagaaacaatgcctgaccactgatggtaaatctgccacattgtcactttcaaagggctttggagaaagcaaagctcattgtaaattacagagggtttcttttactttgttttctagcctactaattggcattaaaatgggatattttgtaacactatgtatataagggtcatagacttcgtttatgttatcctgctgtgagggactagtatataatgttaggtcaacactggtatctctacatgcctatgaagcaccatagggaaagaaacagccttcccctaggcaacaacagatggacgcctaaccttgtggggaatgaataatggacgtggcccttttataacagtttttttcaatcccaagtttaccgcctcatgccatattcaagatacagccttgtacttttggcactcgctcactgtgttagaggattgtttgcacactcccaggttacataatgcagctcgagtcctccagtctatctcatgtcacattgtgtttaagctttatctgtattgtgcttattccccagttatttcacttgacaaagtcttcggtaagaaggaaattaatgatgtagatttaggtgtggatctgaaactttgtgacatccaggtattttgtggatgatgtgctttgtacatagttgctgaataaatgattgcatgaatgaattctgaagcaatactataatgggtttagtccatttactgcaggactcagttaagaaggttttgagatgaatgccaaatcaatttatgcttagaaaaggcataaagcttcttactcatatgacagcagggaaagccttgacatctgtttgagctggttaacctgatattcagaagctgcagaaccatgtttaagctgggccatggttttatattcctttttagtgaaagatttgaatattacttttgttttggccacgctttctccataggatgcacattttcttttctttctttctttttcctctctttctttctttctttctctttctttcttttctctttcttcctttttcttttctttttcttttttcttttttgagacagagtttcactcttgttgcccaggctggcaatggcacgatctctgctcaccacaacctctgcctcccagatttaagtgattctcctgcctcagcctcccgagtagctgggattacaggcatgcgccaccatgcccggctaattttgtatttttagtagagatggggtttctccatgttggtcaggctggtctcaaactcccgacctcaggtgatctgcccacctcggccacccaaagtgctgggattacaggcgtgagccaccgcgcctgacccaggatgcacattttcatataactatgttcctgtcttcaaccttatgctttaaccaggtcactcttcatagtatcagaatctattcaccttcacatggggcacatttcaaagcctttgatgaacaaaaagaatctgttagcgcatgcatagccggctctggtagatttggaaggtccattttgggattgatttctcaggcttattgctgcattaaggctcatgtttacaaacattagaatcccttaatgaattcttagaccataatgtgttagtctatgaattaagaaaaatgaagcagatgaagaatatgacaaatcatgttaccccatcctccaatcaagcgtgtttttctgtatttcattgcacaatgtccccaacaagcatatatacacagacagaccctcctcttccatttttctctctttgatttccaaaaagataacaggcagattggaagggataccactacttgttaacaaagccctccatataatctcaggtaaatacatgtgttgtcaactattgactttttgaaggagaagcctgtatttttttcacttaaactatactagtattaggagaatgagactagttagaaaagtgaattggattcaggctgggtctcatggagctctcagatcatatcacatgagcacccagtttctccacctgtttccaaagaggacatacaatcatggccactatcacccaaattaatgtatatcacctctggcagcaatcatatctaacatttgtcctttcctcataaatgtgatgccaactatgagtcctgaccttataagggccaggccactgctttttccccattcgtttttaatactataaatataaaagttgtatttcaaacaattgagtgattttcaatctctgcttaaaaaacatgactccaaacgtggaagtcgtcatcattagattgctagccactagaatgtgaagataaatgaaatcaaatttacacacacacacaaacatgcagagtataagagtatatatatgtatatatatttgttggtttttaaactaaattagttttaacataaatacagagagttggaaataaaagatccagatcagccattgctgctattgtttctaatgatatttttttcataaacgttgtaggttgacattgtgaaaatgtaagtggcaacttttacagaattgcttcttataattatctcattaatattgggacaaattaggcatccagagaggtgtgggaggtggaggcaaagaaggaaaggagaaaggaataaagggagggagaaaatctagaataattctgttttgtgcatgtcaaaagctggatttaggccctgaactcaatgtttatcctgccttgcaaaagcttccatgtcttttcgtcagtttgttttgacccgaaactttgttttctcacaccagatgacaccagtaagttgcaggttgatgtgaagccttacatcccatcatttattgctgcaaagctgggtttttggatgtggtacttgtcttggacccagtgggtagtgagtgatggtgtggggtgccagtagcattactgaagtgaagtgtggatgcctgttgaccttagtgtgtaggaccaccaaggcacaagccttttttcaagtcagcatgatcctctgggaatgctaccgtcattctcacgtctggtagctttaacactgaatactttcatgctagcaatgcggtgggaaccattgtattgtaatctcatttttaaatgttttctaagaagtagaaaaccaatctgtatgcaaaccagtgacatctaagtaataagtcctttattcgggaatgttatcttcacatttttagctgaattgtgatccatatctcaaactaaataatggattttttaatggtatcttcaaaaggacacccaaataatccatcactcagatatatctctgagtagagaaaatgcctctttctttctcacctctcagtgatattattgcatcatgaagcactcagtatgctttaagtttatggctggttggctcaggacacataccgtggtgttaatgaggctggggtcatggaggcccgttagctttgctctgtttgctgaccacagactaccgggaaatcagtcaagagatgctagcacagacaagaacggcaccatggcaaaacctcagtagttctcagtttttcctccccatacaacaggcaggatgtgttagttgggcgtcatcatctcaaggaggaaatgagtagcagcttgggaggccccaacctttaactctgaacaaagcaggcctgacatttaggcattaactttgcattataatcccccatcataccattgatttgctgtgtaaccttcatcactaaagcagagataataggatagaatgaaatgggcttacctcccggagatgttgtgtgaattagcaaattaacgagtgtaaagtgttagcatttatgtaagtgctggtggttgtcattatttctagggacctagtctcattctaaatagagaatctaagtatattatgcttttgtcagaaagggattttcaccccacatcaattgcatttaagctgagcataaaacagaggtgataataacatagtagtgatcattgcaatgcagagctgtaaaccttttccctattaaagctagaactattttcagcaactttcaatgcttttaaactttgttttccaagttttgttatctctataataattattcttcctgtgatgggtggtgggaatgggacctggaataggtcctattcattattcattcccatgatgactatataatatattgaatttttttacatcatacaatcaagcaaatttggtagctagtgtgattgccacatattgcaatcattgtaaaaaataaaaactcttttctgctctgcctatgctggtgtcctctagaggtagccaacatacagattgaaaactcatggggaattgaagtgctttccaacaaaaggtgctgtatatagatcttttcaatttaacatctttaccaaagaattttgttgttgcctgctatttccaaggggactgtgcttgagagactgcttccatttcttttatcactctgacttcgcttaccaagaaaagtcatttattgctgattgcagaactcttgaactcagccgggcagctgccgcatgaactcctcagatctgagttccttgttacttatttacattttcatttgaagtgatttttcaggactatttgaaaacctttctcaacctaacatcatgtaatagcaaagatctaaaacttaccatgcttttggtcctttttctgtttgtcttacagataacagacgagtacctttggaaaggtcacgctctcgccacaatggagctatctcatctaagtgattcctgatgccaaagaatatgaaaatatttaagtaaaaacaaaatgatgcattttgagaagaacaaagtgtgcactcagcggctggaaaggaaataagtgcatttctgcaaagatcaagataagctggatgaagtagtgtgcatttgtaatactattgcaagactcctcccacaattattctaatctgaacacagttatcaggattacaaaatgtgttccattttagtgtaaagatgtgtatcatttgtaattgtgtgtgacctgactgtgatgatggaagtgtaagaaattgaagagttctaaggctttcaaaaacactcagtcaaaaatttaaaatcttaaatgtgtaagtcacccccaccaaaaacaaaagagaagaaaaagaatagaaagaattatccagtgtcagcttccaatccctagtacatatataatagaaaagggccaagaaaaatatgcatcttgatttggagagaggctaatattatgcacactgtaagagaagccattttggaaattcacgaaagtactgctccaccccagttgagttatttagaattttatctcaagtgaaagctgatggattcatctgctttggctgaaattaaacttatcattagtctagctagcatttcagcatgatattgcaagcacttctcattgctaaaaataaataaaccaaagtttaaccgaatcagttagggaaagtgatttaaactttatttaaagaggtattttctaattatgcacagatatctactttatacaaatactttatatggctatttttgagaaaaccctcacattttaatgtttatgctagggatgaacctgaaaattctattacgtttatttagatttcaaaggcaaatattgattcctatgctctgtggtttatttcttttttctattgcttctttctcccttgagtcccttgaaggcagggaatagacttctagaaaacctgagaggaaaaagaattctttttacaggaggcagcagaaaactgtctgaaaggtcaattgttttatctccctttccactctctttccaatttcactttggtggtctgaagaagaaaaagaaattttatgtatgtatgtgtaaatatgtgtatatatttctatctcttgctacaataattccaactaagtgaacttctcaattatcatcatacttacttaccttatattaacaaattaagatgatgctgccaaaacaagtctagcagggaaaacaggttctacatttttcttaaataaattagggagtaaaagttatacttaacttgtctgtctattattttaaaatatgcattgaaataatgtggtataacttctctggagtgcaattttaagtctaattcatgcagatgattgattgtgattattgtaagaaatttcttacatgtatatttcttatgtagaaaatactgtttctactcattcaaagcacattgtagatattcagagagaagaacaaatggctggcttggcaaatccccatctgagataaagtaaacaagtgaccagcagcccacagatgattcctttatatagatgtataatgattcaaactgctgcctttgcctccagtgcatccttacttaggtattatacttctttaaaaagctctgaagctgctacaatagaaaaatcaaaaagggtaacagtatctgaaatttcacagtcctatccgatctgaaaacacacatacacaaatgcacacacatgcacacacacatttaagggacatagcagtaacactgttttttaacaacaacaaaagtttaggttctaatttatgtaaatacctagtatgtgtatttttgactttacaaagtctttcttttctgaaatcttcgtggtatggcttttttaattcttttgacagcttatcagtctgtaggagaatgatcttgaaatgttaaccctgactaaaatttgggagcatatgccttgctatattatcaagctggtcaaggtagaaatactgatatgtatcatcaccttttccagatacaaacttgccttattttctagtttgtgaacaagaacgaatgaagtactattattgataacttatatatttttatttagagcaatcccacatgcttttcacaaacattaaaaaaaaaaacctttcagggtctttcatgaagttccaatagttgagtgagttaaaaggtttgtttcccagatttgtaatggtcctgctctagccatttgcagttttgttttagatgattggaaagtatatcaccaaaaaaagtatatagtgacatttttagtatgaaaccaaattacactaaggtcttttgttggccatattactgccacacatgagaagcaccatttatgcagattttcttcagaatatttttaaaaggtacagaatccttaaaatattaacaactaattgcatccatcatctcctttggctgctgtaacaaattaccaccaataatatgatggcttaacacaacagaaacttatttgcttacatttttgaagggcagcaaagccatgctccctccagaggctctagaggagaatctttccttgccacgtccaccttttggtggctattggcattttttggcttatggccacatttctctttctgctgtgtcttcacatcaccctcctctgtatacctaatctgcctctgcctctgtttaataaggatccttatgatgacttttagggactacccagattactccaggataatctcctcacctcatgagtcttaacttaattacatctgcaaggcccccttctccaaataagataaattcatggttttggggattaggatgtggctatgtcttttaggaagccactcttagcccaccagagtctgccctttggcccaaaatttatgtctgtctcatgtgtaaaagacattcatcccatcctaacattaccaaaagtctcaacccattatatcaatcctaagtccaaaatttcattcaaatatcatcggttcaaaagttccaaagcttatcatttagatcatctaaatcaggtatgagtgaaactctgggtatggtctttcctgaggccaaattcctcttcctctgagaaccagtgaaacagaaaagttaatctgctttcaaattacaatggtgggaacaggcataggataacagttacagacatttctgtctcaaaaaggagagaatggaaattggaatggagtctcctgtcccaatcattttcaaaatctagccaggcaaatttctgttatatttcaaggcctggcagtaatcctctttctcagggctccaccctttgggcctgtagctcttctttcttggactatggattgggcctctgcctctgtgcctatgggttgcacttcttcctctgttcccacacttgggcctctgcctctgtacctgcagctctgctctcgggatggtgcttcctttatcttgaagggtggcacatgtttgcagctgagaagttttatcaacgggtttcctacctgtagaattctggcagtctcacaatcttctttcatttttttctgtctctgtcccttttaggcccagttggaagtgtttctgatggtagaacattctcaaaaatcttgtgggtcttctacgtatgtcacattgattcacacattcagaaaagagggtcctcacagatttttcctgaacaaccccatctctattcttggcttctgttgaaacagtcaaataaatccacaagttaatgcctaacctcttcagcactagccaaaggttgtcaagacacacccttgggcttatctacagagcacacttttctaacagtgaatctcctaattttagcatctttttttttttttaacaatcattcagattgtgaattcaggctcagaatttacccagtcatcagatactgattccttttgtccacttatatagttattttctctttaaaaaaaaattttttttaatgtattagagatgaggtctcactctgtcacccaggctgcagtgtagtggtgcaaacatagctccctgtaacctcaaactcccaggctcaagggatcctcctgcatcagccttccaagtagctgggtctacaggtgcatgccaccatgcctggctaattttttgcatttttttgtagagacttgatcttgctatgttgtccaggctgctctcgaactcctagcctcaagcaatccacccatcttggcctcctaaagtgccggattacaggtgtaagccaccatgcccagcctgttttgtcaatgtatctgttttctgtcttattttactataagcactaagaagaaactaagctatatctctaacactagacttgaaaatttcctcagctaaacatccaagttcatcatttattcaacttttcacactactgtagtagacaatttagatagataaactttttgccactatatgacaaggattccctttcttccattttccaataaaatcttcatttccttctaaaccatcactagaaatgcctttaacattcatactactaccatctggtaaaggcaatctagttttttctatcacagccaccaaaattcttctagtctctacccattatccaattccaaagcctttttcacattttaagacatttgttacagaagtacccaatccgtcccagttccacaatctgcattagattcccatggctgctgtaacaaattaccctctagcccagtggcttaaaacaatagaaatttattatcttgttgttttggaggccaaaagtccaaaattgaggggttggcagggctgaacgtcttctggagactctaagggaaacactcttcccgtgtcttccagtttcttgtggctgccatcattccttggtttgtgactgcatctccctctcctctgtcttcacatcacttcccctctgtatatataatctacctctgcctctctcttataaggacacttgtgacgggacttagggcccatccagattacccatgataattcccttattccaagattcttaattatatctgaaaggaccttttttccaaataaggtactatcacaggttccagggagtaggatattgaatatcttttttggggagggggcaccatgcagctcactacactattcattgcacacaaatgaatttttcactttttaagatgcattcttggtgctcaaaccagatcgaagtttgtctctaaaagctattgtctgcacaggctgctgcatgctctgttgttaaatggatggacaggctattctaaattttggttgatacttttgctactatgggcaattaacttgaaaaaaataatcgatcccaactctgtgctctgatgtacctcttctgccccttttatgacacctttgaccaaatgccttctatggttcacagtgcaggcacaaaactacctctgatacagaagggttctttacaagcttattttacataccgtgaatccctcacctaaagggagaggtgaaagcaaagactgctttgaatgggtattgagggagattgtgtccataccaagccaccctgaagaagtatttcacttgcagtagaactgtggatttgtgctgtcatttcaccttggaataaacacctatctctaagcaggaccaagaatgacttgcaatctatatgtaatggctacttacttattcaataaagttaagatatacgttaaatgttgtgctgcctatgataattaagattaaagacaagtgaaaaggcatgaactatcgggggggagaagcttcaaccaaacagaagtgcaggagtgcttttgtatgtgcctggtccagtggagatcatgggatcatattaaaaacatacttgtaggaatcataaggttttctttagcactgcttgccagagtagtggagatatggtacaactgaaaagtttagaaacatcagaagggtgatttacacgctccagagaaactgtttcaacagagaagtttttcgttttgttttgttttttgttctgttttggtattgagtatagaattaagcaagtgggcttcaaatgcttagaagggtaaaaatctggaatgagtaataaaaggactgtagattattattttctggagagccttcaatagaatagctcatcatgggtggggtgacttgaagatgaaggtctggacaacgtaataaccaggtctataaataatacaatcagaaacatttgtttccaaggcaaaccaaagaccattgtttcccttggaatggtttacatcaggaatcaaatacattggctttttctcccccatgagacccaaataggcaaattccttaataggaagtctgaaaacgttagtatccacaactaggagaatttgagcttaaggccaagagctcaaaggaaagatggaaatccagaaattaatatacatgcaatgcatgtaacatgctatatagttttgatgatttataataaaaagaaagctatagccaaatatctcatttacagactgaatttatttagatgtccagagtcccagtggccacaaataaaatattattacagttagtgtccatttcagaaaaaacaacttgcaaatatatgaattatgcaaatcataactttgttcctagttcttggagatgagccagagttcaatctttagccatgatgaccttatatcttcgataatagcagttcagctaatattttcacctatatcttggctaattgaggttcagccatcaccttttgatgtttatgagcaaagtgtaaacactattatcctattatttgacataataataaataatataaaacccctcgacttctctactttgttaaagtctgcccccacccccactccccagtggggctgttctaatcattgagtgtccatttgatgcaagctgctttttcaggacacaattatgaattaaacatagctcctggcttcaagatctcacagcctagtgggagatgggatatgtacaaacagaattgtaatccaaggtggaaagaaactgattgatgttgaaaccgatataaggcctgtggaggttcagaaaaagcaagaatttagttttagagaggtggggtggttattgggtgggaagctggtatctgtgtagattttgtggagtggctggcatttaaactgaaatttaagaggtaagtagatttggatctgtgacactgtcattcagtcagtatttactgagcacctattgtgtgccacacacaatgctaggctctgagactatgacagtgaaccagctagacgtggttcaagattcatggaactgacatctttttgaagagggagggagggaaggcatgagccgaggtataaacttggaaccttggtgcatatgcagagaatattgaacaattctgtttcactagagtgcaaggtccatgaaacacagcagtggatgtgtggtttgggcttcttgattcagtacaggatagggaaatattgaggagttttgagcaaagaaattatttggagcactgaaggaagatgactctagaagctctatgtaggaaaggtagagtggggagaggccacagaaggccaactttgttggaggttactgcagtaatacttatgagaaatgaggccccaaactggggtagcagttgtcagtggcaccacagatacgcacagctgcagctctgaggcttgctatgatccttttttttttttttttt

SEQ ID NO: 14578 - DNA, 678533 bp, Human; identical to SEQ ID NO: 14577
  misc_feature (1)...(678533): n = A,T,C or G

SEQ ID NO: 14579 - DNA, 16341 bp, Human
aactgtgcagccagtgggcccaagggttgccattgaacttgatgttagtgagctctcccttcgtgagacccctgcccatggatgagcaaggagaatgggggtgtttcaggagcagacagggatcctgtgcaaagctgggcttctgtgcaactttcgcttgcagttatttaaatatttttgctgtaaatacagaactgcaggggagagggcaggaaacccagcgagcagcagcccggcctggctggggacaggatgtgtctgttggagcggggaccggcaaggcaggcatgcaggcagggggcttccctctcggggtcttcggaaggcgcagtgcagggagtgagagacgcccaggcctgggcagcgagagggccctgctccccgctcaaggctcccaggacattccacacaggagccagcctgttccaaccctgcactgcctgatactccacagccaccactgagatggaccccctccccctcagctccccatgacgtccccagcacctgaccccaggctgaccacctcggccaccacctctggccccaccttcctccccaggtttgttcccaaacacccctagagtcttttccggagcaatctcagacgtgcagaacgctcagggggaccctgggcctgaaggcggtaggagaaaccgagaccgacccctggtctagaggagaggtgtctgccgctctccatcctggactctggctgcccaaaagcaaacggcacgcctgcccacgtgggaatcttggtggcgtctctcactgcatcagttagcccccagcccagtgctgcctggattcaggcttcctggtaccttcgtccacccttcagccctaatccatgctggccaggtcatctcgttctctggctcagtgggaacactcgtgcccagagacctctcgtggttctctgcagcctgcacacagggcctgcttccctggcttgaccgcacagacaaggggactgttaccaaggcctcccactgaggccaccccccctccaggccatgcctgcggggccaccacagcctcagcatcattgcaggccccaggcctctgcacctggtcttgttttactgggggcactgtccccactcacgtccacctgggaccctcggctcctgtccactgcagctcccctcccggacaccttcccagatgcccccggaagctcctgtccaggccacagcatccctcagcctctgtcactggtcctaggaagaccctttgggagctctcactcagggccacactcaggacccccgttgtggggctggccgccttccttctaaagcacctggaggaaggaaggagggggtcaatgcgagcctcaatccccaggcgagtgtgccccttttaaagatgagggaaccgaggctcagagaaggaaaggacttgcctggcgtcacacagctagcctaagatggtgaggtcaggagctccctggcaacacccaggctgccgtaccgtctcctgcatcagactgagcctccatcgggctcctcccacagccccaggcgggcccctgagtaggggctctcagcttgtgtggaggtcccccaggaacaccaccccgatccagcctccatggaggctcttgccggccactgggaggggccggtgcaccctgggcagcccctgccagggccctgagacccgagcctccccgccgagggcacctgtctcggctttgccccattcgagcagggccctcgccgaggcaggacagggccacattcggaagtgagagttctctgagtcccgcacagagcgagtctctgtccccagcccccaaggcagctgccctggtgggtgagtcaggccaggcccggagacttcccgagagcgagggagggacagcagcgcctccatcacagggaagtgtccctgcgggaggccctggccctgattgggcgccggggcggagcggcctttgctctttgcgtggtcgcgggggtataacagcggcgcgcgtggctcgcagaccggggagacgggcgggcgcacagccggcgcggaggccccacagccccgccgggacccgaggccaagcgaggggctgccagtgtcccgggacccaccgcgtccgccccagccccgggtccccgcgcccaccccatggcgacggacgcggcgctacgccggcttctgaggctgcaccgcacggagatcgcggtggccgtggacagcgccttcccactgctgcacgcgctggctgaccacgacgtggtccccgaggacaagtttcaggtgggctccccgcccgccccccgctgcccccaggccctgtgagccagggatagtccccggggaagttccaggaggaccccgcccctccagatccccaagcccctccagccttccccaactccctccccacaaggagccaggggcgtccctgatgacaagttagaagttggtccccttcccccagccgtccccacacctcacccccaagccaagggaatggcctccaggttcccccagccccaccctcaacacccctacaccaccacctgactccaccacaagccgaggagatgggcgtggagctgtccaggtcgccagcgcctctgcctgggagctccaccctctagtcatgatggagatgggcaggccgcagggtgtgggggaccatggcagggaccctcatgccaccccactgcaggagacgcttcatctgaaggaaaaggagggctgcccccaggccttccacgccctcctgtcctggctgctgacccaggactccacagccatcctggacttctggagggtgctgttcaaggactacaacctggagcgctatggccggctgcagcccatcctggacagcttccccaaaggtgggtcctggtggactcagccatgctgggggcctggggcagctgctgtcacctgctcagcccagctggactggaaccggagtggtgtttgaggagcccgtgggtgatgttccaggaccgtcttggatcctaagaggcaaaggggccaggcctcacctgtctggccaaggtgtccagttctggggcccaccctacccctggagaaaaccctgaggttgggaccctgctcctgcccctgagctgcagatgtggacctcagccagccccggaaggggaggaagcccccggccgtccccaaggctttggtaccgccacccagactccccaccaagaggaaggcctcagaagaggctcgagctgccgcgccagcagccctgactccaaggggcaccgccagcccaggtaccctccctgcaggggaagccagccagggtctccagtcttcccgggcttccccgggagcccacgccccctccccacccgggctcccacccactgggtgtggggccagcctgcctggggctgtgggggtctcctctgggtactagacccacacactggaccagcctctcagctccctcctgcctgaaggctgagctccccggagctggtgaagtaggcgggcgggtctcatttcccttttactgatgagaaaccagagcccggcaaagggactacccagcactggaccgccccctccacgccctcccaccgcgggcccctgcccaccggcactcacccccactgagaggggaggccaggctgcccccagctcccccattcaggctctcaactgaaggccaagccccccaagaagccggagagcagcgcagagcagcagcgccttccactcgggaacggtgagcggggcccagtgggagcgcctcccttctccctggccaggggcaaggggtcaggggtcagagcagggcctgccctctgagaccctgtcctaggggctggggacgtgctggcctggtgtgtcattccaagggcctaagctgcaccaccagacccaggaaggggacaccttgggtctaagcatgatcttgccagtcgcccctgcccccactgcaccctggttctgggacccccttctcaggcaccttctctgcccgtccactccctatccttcaggaccagcctagacatagcttcctccagaaaatcatccctggcccccagctgcatgcaggctgaacccttcctgtccccttctccttccttcccagggcactggactccagagaccccctatctccctgagggcagagcctaggaactctgtgtccctcccggcacaatacagggcccatgtcatgggggggtgggtctggtcattggtcatgccttcctatccattgtgccagctctgctgacactgccaccccccagcacacgcacacttgggtgcacacacgaacacacacattctcatgtctctgcacttacctgtgggctgtctgcacatggcagggctgggtcccctccttggcctgccctggctggaaggaaagggctctgcagcccagtgctgcctgcttctggcatagagtatgtgcttgggaacagtcttccccacgggtgaccccaatgggtgttccctttcccagggattcagaccatgtcagcttcagtccagagagctgtggccatgtcctccggggacgtcccgggagcccgaggggccgtggaggggatcctcatccagcaggtgtttgagtcaggtagacgctgtggcggggagatggggctgatggggagacccaggctccaagatggaaggaggaccacgcccctttgcatcctggtggtcccacagcagaccggactgttgctcaggtagccagagtttctgcctgtggttctgctgactttggaggaggagggtgagcactgaagtctccctgtcgggggaccttctgcaaggccagcggtccaggcccacatccccacccgggatgtacagcactccccagtcacctccatccatgtgcatgggccctcctgggccatggggttgcatccttagaaagttctgcctgtgctgctgagaccctccagggtatcggcattcttcaaccaggacagcctgtagcatagcgtccttgccccccataccctggccagcctgcagcatcctcgcccgccattccctggccagccgctgaccccatgcaatcaccagtgccatctgaccagggcacagcagggccgctggtggcagacccaccgtgccatcggggcattccatctcaagtccctgacacggtgtctcctcggtgctggacatgggctgggaacaccaagcacagccagggccctggtcttgcacctctggatggtcccaaggcccactgtgttacttcctaaggctgttggttaaattggcacaaactgggaggcttgaaatgacagaaatgccaacatcgaggtgtctcggggccacactccctctggaggctccagggaagaatccttccttgtgtctcccagctgctggtcattatgggggtacccctgtgctccttgttcctgggctcaggacccaccgctccagcctctgcttctgtggtctcacagctgtctcccacgtgtcctctttataaggacaccagtcattgaacttatggtccagtgtgacctcatcttaactaatcacatctacaaagaccctgatttcaagtaaggtcacactctgaggttctgggtggacgtgaacttcgggggacgctgttgaacaccctggtgtagatccaggacaatccccgggccccagactcgactggggtgggggcgggctggaggaatgcaggctgtgggaactccacctgtctctgctagaccccaccctggggcctacacgactgccaaggcaggtcctgctgggcgggtgagccaggaccagccggcatctcctcccaggcggctccaagaagtgcatccaggttggcggggagttctacactcccagcaagttcgaagactccggcagtgggaagaacaaggcccgcagcagcagtggcccgaagcctctggttcgagccaagggagcccagggcgctgcccccgtaagcacctgaccttccctggggagcctggctcttgatgccccccgccccaggaacagcgttgcctctgggggagtggctctgctgggggctgggggctgctgccgagagacgcctggtgccacagccatgtgcaccctcgctgctgaggctgcccccattgctgacgcccctcttccttgcagggtggaggtgaggctaggctgggccagcagggcagcgttcccgcccctctggccctccccagtgacccccagctccaccaggtaatgccctagaccacaggagaggcccctgtctgcccttgctcccctcgggtgggtcctgctgcctctgcctttacctgggcactcagggatgagcaccggggcctgagcccctacccacagggtacagctctttttctttaatagacagtatttttttcctgataatacgcaatggtaatagtttaaatgagtcagagaaagtgaggtcttctcaggctcttaagagcatggcgtttggtccaggctgtacccgctgctctcagctgggcccgtgggtgggccgggcgcccctgctatagccaggaggtcaaggatccactgggaatgccatgctcatctttcgtccccagcatggtttcttaatggggtagaagcagtgtggggggtgcctgccgtggtgggttacagatcttgaccacttggcaccaggggctctgtggggccctggcacttagcagtgacaggagccagtcctgccctgcaggagcacccgggctggtgggcgtctgggggattgttagaatgagtgaggtcattgccgtgcaggaccagcctagcctggctgtctggggggattctggaggaagtggtacctgggagacccctgaaggcacagcaggcaccatccaggcagggcacaaggacggtgggggctgcaggtggaggattcagcaggcgctgaggtcgggagagacctccctgggcctggccccactgccctgtgaggaagggttcatgtggttggtgtacagttccggggcccctggaacgcagcagcctgcaagaaaccgggttttcttcccaatagggatggccccggggggtgtctgttggagaccagatggatggggaacaggtggtcagggcagaatttcaggccctggcagcatgggagcagggcagagactggggagttcaggtacccagagatgctgctgggggagctgttttgggaaggaggtggctctcaggagggtgctgcaccccagcccagtctgcatgggcgtctcttgcctgtgccagaagaatgaggacgagtgtgccgtgtgtcgggacggcggggagctcatctgctgtgacggctgccctcgggccttccacctggcctgcctgtcccctccgctccgggagatccccaggtgagcctgcacctctgccagcgcaaccaggccaccccggttcacggccgcctccacccactgaccctgaagggaagccaccccaagcctctcccatccaagatggaaaggggttctgagtcaggtcactgggccgtggggccggggcctggggttttcccaccctgccacctgcctcccggtctggccacacctgctgcccagcctggacagctgggcccctgagggcagcaaagcagaacagaggcccagggcgaagatgccaccctgtccaagctcatcccaggctgcagcccacgcccccatgggtagccggcccccacccccaagccccaccccagagtcccactccagacagggctggggagcacagaggccacagagctgtgccccccagggcaggtgggagtttgtccaccaatgcacaggacgccgggcttagtgggggcgggaggcctcctctgcgttcacatcccggtgctccttccccacggcccaccgagccctgcccccattccaaccccacaggacgtggcagtctgtgggaggaagagctctgggtgcagtggggacccacgttcaggcgaggctctgccccagcccctgagtggccgtcatcaggccccctctcagccttgtgcctcatcactagaataaggggcacagtgggggtcattgctcggctcctgaagccgttcctccttgccgtctctttctgcccttgatcacctccccattctgctgggtgccattccccttaacaggtgggtcagtttagggaggcccccggcagggcccagccctgagaggcaggcaaagccaccagggctcgcaggtgttggggattcctggggttcatcagagagcacgccaaggggaccctgatcacgctggccagggccaccccacgaagggtaaatgtccccctgctgggctctcccttcctgtgtctctgcccatctctctgctgtgcctcggttccccctctgtgaaaagacatggtcggagccctggagctccacccgtgggtttggggatctgtcacccgctgtcttgttctgcatgtctctgactggtggacacacgagcagtgggacctggaggtgctccagctgcctgcaggcaacagtccaggaggtgcagccccgggcagaggagccccggccccaggagccacccgtggagaccccggtatggccacgccccctcctagccgggccacccctcctgtccacatggccacgccccctcctaggctgggccaccccctcctgtccgtctgtcccctggagtcctgtgggacaggactgccccagccatagcactatgtcccccatgcccaagcccggtccttgtggtctcctgcagtggagtccccatcatggttcctgtgggcctaaacccagctctcctggctgcgggtccaccccggggggcactatgagcattgataacggccccggaagatgtgttccttgttctgctgctgtgagggtagtaggtctactgtgcacagacccagtgttccctctgacagccctgagggccagggggccccccgtgtgtagacgggggaggagggaggaccacagagccaggaagtgccacagcctttcccactcagtgtggacgccttccaccatgccagccctccgcccccaccatgccaggcctctgcccccaccctgctgccctgggtttcagggtcccagcagtcactgactcctgggtggtgccgggcaggcgcccgctgcccctctgatgctgacccttgggttccagctccccccggggcttaggtcggcgggagaggaggtaagaggtccacctggggaacccctagccggcatggacacgactcttgtctacaagcacctgccggctccgccttctgcagccccgctgccagggctggactcctcggccctgcaccccctactgtgtgtgggtcctgagggtcagcaggtgagcggggagtgggggtcagggtgggctcttcaaggagcccaggacctacggggcggatgaattcacctgaaacaggaggagagggaggccaggcgagaaaggctccgggaggcacagggcctggggctgtggggggagcgtggggggctgcggggggaaggggacgctcctagacctccactccagctcctggccctgggcattactgctccccccacaaggcaggacaatgaagggggggatgtcccagcacacgtgggagccctcccctccctgcctcaattcccttccctgcacccctgtgggcaccgcctttcaggagactcccgcactcagccccaaaggaggccaggcccgccaagcaggagagaggtgcgggcgccaggcttgcaggcagcagcctgagggtgcttgggtcgcccctgcctcctggggatgggactggtcccgctgtcctgcagcctgcgtggcaccgtgaggctcctcacttgcgcctagacccgccgtccagccctgggtggtcccaggggagagcgcacagggctcgggttcgggttcagctacatttcccccggccccccgcgtcaccccgcgctgttgcctcccacagaacctggctcctggtgcgcgttgcggggtgtgcggagatggtacggacgtgctgcggtgtactcactgcgccgctgccttccactggcgctgccacttcccagccggcacctcccggcccgggtgagtgagcgtggtcggcggggaggcctgaacccacacccacaccctacaccccaccccacactccccacccacatcatacagcccacaaccacaccccacccacaccccacactcccacccacaccttgcaccccaccccacacccatgccctgcacccacaccctacactccacagccacactccaccacacccccacccacaccctactccccacctcataccctgcacctcaccacactccacagccacaccccaccccacaccccacactcccacccacaccctacacccaccccacaccctacacccaacccaaacccacccaaacccaccactcccactctccacccacacccacaccccttcctcacaccccacacccccatcccccactcaccacccacgcccacaccccacaccccataccccggaggtggcactcctgctcccccccagggctggcagcccctcatcctctgctgcaggacgggcctgcgctgcagatcctgctcaggagacgtgaccccagcccctgtggagggggtgctggcccccagccccgcccgcctggcccctgggcctgccaaggtcagtgccgcaggggccctccatgcatgccggtgctgggggtggggaaccccttgggttggtgttgggggagcacatctcagggcagaccctgggtgccagcttcgagggcttgcaccagacgcactgaccatgtgctcattatctgtagaaaatatttcccctttaaaccaattctttttggcaacttaaatatagttaaaaaggaagctccccccgagggttggtggctgacgtcacggttggctgtgtggccgcctcacagcatgagcctgagagtcctgccagggctccctggtggggtgaagggagagcgggagcgcccggcctgcaggagcaaacccccaccctgtctgacccctccaggttgtctcacccccagccctccctggggccaggatccaccccactgtgtggccagagccctctcagagaggcaaagtgaccccgggtccagccagtagctcttcctgtcctcctgctccggggtcagagaggacctgggtggcgcggagacccctgactgctggggcggctgggcttgccctggagctgggtgtgggggaggcccgagtcgctgctgcaggagcctccgggggggtggcctcttgccctgaccgtccccagcagaggcctcctgagcacatcctggccaccgaggagcctttagggatcctggggtgatgacacgtcccacctgctccactggcccatgctctttcccagctgtgcctccgccccgtatacaccgtgtgggtgacaggccaccccggcgtggtactccccaggagggtgacagcctaccccagcgtggtactccccgggcaggtgacaggcttccccggcatgcaggctctggcctggcatggcacaagcctcagacccagccctgcccttggggcttttgtggaacagtggcgtggcccacagctgtcactgtccccttccttctagaagcctccctcctcacaccacccatctggagtcaggagcccagccgggcatatacgcagatgcccctccctaaccccaggcagctttcctgcaactgctcccgcagcgggtacctcgtcattaacctcctgggttctgtctctgaacagcagagacctctttcttgtcatcgtgatgtgaaatgtaacgccatgtcagaggaaaagttctggctggccttggcctcccccctcagcctgcccccttcctccagggtggttggacgtggccccagaccccatcctgagcagctctcccaccccctgggagcatccttaggaccggggagcatccaggggctttcccctccagaccgggcagcccctccctcagccatgcagggctgccgggcctcgcagcgccagtgttcacccgagtggaggagctgggatgtggctgtttggggccacaaatggggaattccacagggttcaatgtaatatggtctcctctctgctgggggtgcctgcctggggaccttctcccactctggtcgctcacctatagtgtgggctggccctggtggtgcttgtcgggggcgggggtggcatggaccaggcactttcctctctgggcctcagacttcccctctcagagtgggactccttgctggttccctgagctccctcgttttccccaggaggccacacagtgtggaggctgtctgggggccgtgggcagctggccgtgggcaggaccctggggaggcagccccagccccatcatgcccacgcagccctgtgcccccacccccagtggagctgggtgtaagaattcccatctcagtgtgggggaaacacccccgcggcccctaggccctgcggcctctgtacccccaccagggctgtgggagttgggctgacctcttctctttactgggttccaggatgacactgccagtcacgagcccgctctgcacagggatgacctggagtcccttctgagcgaggtaacgcctcccctggcctcctggtgctcctccactccccctcccctgcctcagccggcacccaggctccccactctgggggaggactgccggcccccactgctcttgagccgtggaaactcaggctgtccctgctccacccaccaggagccccagtgctgctgagcacctggcaccccccacaggagcccccctagcccccttgcaggagccccccccggcccctccccctgcgggagcccagtgctgctgagcgcccccagcccctccccaacaagagcccccacacggcccctcccctgagggcctgcaccctggcaggcagaggctcgagcaccaggctcaagatccactttcccagggagggtggggcgtgggagtggggggggggtcccagaccccgtccctctaagatttgcttgcccctcccaactcaggcctctctacgctaagatgggcaggtagaatctgtggggaaaatgtgacttttaagggctctgtctgtttttgccaagaggataagctccttcagcctccacgggttctcctcagtgtctgatgtggcacccgggggtcccagctgaccatggggcaggggttctgccctgtgcagtggccgtgccccacacaccctgaccgtgcaggtgtctgcagagccccagggcctgagagtgggccagggggcccagcgctgggtaatggagctgcccctctggatggggtccccgggtatagctggagaaatgagcgacgggctcacagcctctcccgggtggcggtcttattctgctggcatcgtggggcccgtggccccatcctgtgggagcatcaggctcctgagcagaataagtagctggccccgacccccccaccctgaaggagccacccgaggaggcagaactgccatgaactgccatggggatgtgccctgggcttataggatgtggtgaagtacacaggacagggtcctcggtctggcctgtgccatggggaccttgggcctcagtttccccacctttgatggaatacggtgaagtgcacaggacagggtcctccccagactggcctgtgccatggggcctcgggcctcagtttccccacctttgacttagagggaaggttggatggtgacttcttgtaacgatggccatgattctgtggctgcggcgggggcgcacctggaggttctcaccgtcactctgtcccgcagcacaccttcgatggcatcctgcagtgggccatccagagcatggcccgtccggcggcccccttcccctcctgaccccagatggccgggacatgcagctctgatgagagagtgctgagaaggacacctccttcctcagtcctggaagccggccggctgggatcaagaaggggacagcgccacctcttgtcagtgctcggctgtaaacagctctgtgtttctggggacaccagccatcatgtgcctggaaattaaaccctgccccacttctctactctggaagtccccgggagcctctccttgcctggtgacctactaaaaatataaaaattagctgggtgtggtggtgggtgcctgtaatcccagctacatgggagcctgaggcatgagaatcacttgaactcgggaggtggaggttgcagtgagctgagattgcgccactgcactccagtctggtcggcaagagtgagactccgtctcaaaaacaaaacaaaacaaaaaaaccacataacataaatttatcatctcgaccacttttcagttcagtggcattcacatctcatgtaaccattgccaccaccatctgcagagctgttccagcttcctgaatggaaactctggccccatgaaacactcactccccattcccctcccaacccctggcaccctccactctactttctgtctctatgacttctccagggacctcatggaagtggaatcacacagtatctgtccttttgtgtctgtcttattttactcagcatggtggccccaaggttcatccatgttgtagcatgtgccgaaatctgcttccttttttaaggctgagtaatattccagcacatggatggactgcattgtgttcatctatgctttcctcagcagacacctgggtgcttccaccttttggctgttgtgagtaatgctgctatgaatatgtgtgtgcaaatatctgtgtgagtctttgagtaaaatcgctggatcacatggtaattatatttttaattttttgaagaactgccatcctgttttccacagcagctacaccatttcacatccccaccaacactgcatgagggttccagcctccccatatccttgaaacaattactattttctgcatttttctttcttttcttttcttctttttttgagacggagtttcgctcttgctgcccaggctgcagtgcaatggcgcagtctccactcactgcaacctctgcctcctggcttcaagtgattctcctgcctcagcctcctgcatagctgggattacaggcgcacaccaccatgcccggctaatttttgtatttttagtagagacggggtttcaccatgttggctgggctggtctcgaactcctgacctcagacctcaggtgatccaccccccccccccccccaccccacgggcctcccaaagttctgggattatgggcgtgagccactgcgcccagcctgtgtttttcttttatagtagccatcctaatgggtatgaggtggtacctcattgtggctaaaccatgtacgtttaagaatttacacacacacacacacacacacacacacacacgtgatgaagctgtaagaaaagggagagaataatgacccaaaatgtcagcacaaggatgcctcaggggtagacacaggtgtcttcttagcgccttttagcccacgcatatgtgcttgcgcagtctctcggtgtgttttctaacatttcacaattaaataaggagtagttgatattcacagccaccatttccaccgtatatgtagagaaaaatgctcaaatcctagcgatcagcccgctgagctttcacaaaccgaacacaccgtgcggtcacgaggcggctctcccgaacaccggctctgcacccccagggcccggggaaccaagacttccccaagggcccagcaaaagtgagggaggaggggaggaaaggagggagagggagggaggagtgctggctgctttccgccagcgcctcgtttgggtttcgctctgctgaggcctgaaggcgccctgagggcccctggggggcagggaggggcggtggctgcggccgacagcaaggaacctccggagaagcgaagccgggccagacgtgccaccggggcctcggcgctggcgaaggggcgcgtgcggccgcactggggccagccccgccctggtccccggccacatcctcgagaccaccggggtggaggggggggtctcactgctcagggcccgcgtgacattgcacaggtttagaaacgcacagcgggaaggtggccccggcgggccgagggcgcaggatccctgctccgtccagggtccgtcctgcgaggaggcgccgggggcgggcccggggcggggcgggcggaaggcgcgcgcggggcggggcggggacggcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggtgggcgggggtcccggccgcgtcgcggcgca

SEQ ID NO: 14580 - DNA, 16341 bp, Human; identical to SEQ ID NO: 14579

SEQ ID NO: 14581 - DNA, 64309 bp, Human
  misc_feature (1)...(64309): n = A,T,C or G
agcaccaccctaacccaaactaccaatgtctcacctggacccctactgtcatctcctctctggtctgcttgatggcgcactttactcacctgtccccattcccacagtgtgttcccttaggacagccacggggagcttttgaacacacaaatcagatcagtcacccccttcttcatccctccaatgtccccagctgaacacaccactgaaatccaagctccttgacgtgcccacacagctttgtggatctgtgtatccccatctcccttcaagctcaggccttctctctctctctattgcagcccaccatctcctccctggggctcatgcccacctctgagcttttgcacctgctggtccccttcctgcagtgctggacccctgatgctgtgtccttcaggcctcacctcaaatgccacctcctcagatctaaaattaaccctccaacacccagtattccctctcccatcaccctgcttaatggtctactatctgcaactctgttcttgttcacttatcatctgtctccttcctggccccaagaagaaagactgttgcctttcttcttccttgtgtccacggtgcccactatcgtggttggcacagaatatggaatatgaatgaatacctgaatggtggctttcgggtgtgtgtgtgtgtgtgtgtgtgtgtaatttagaaaggcaatcttgaaggatagtcaggactgggtgcaggaggttactacagttgggcatactttgtttcccatatggttgtgccactcgctagctggtgactctgggcaaacaccttcacctccttgagcctcagtgtcttcagctgaaacctgagttcagatttgccagacctgggcatagggacagcaggtccagcaggaacaccaagccaggaccacagccactcccagggagctcagtccctggagcccgagaggaacactctccggaggcgcaggcgcagccgctcctagagactgggcaacccccaggtggcaggcgggaccggtccgtgcaaacagggaacaggtacccggaggatggacattcgctggcaaaaacataaactgccgctcggagtcttggcaccacccaatttccagggacggttagactccccctagctcactggatgaggtgtacaccaaagaagggtgttagccccctcgggtcggccagggcactcaaagcattctgttcccgggagcgaggccgaggtgcaccacccgccgcgtccgcctggtgacgccgcgagcgcgctctgagcggccagctgcgcccctcacgctcccgcggctcaggcgccccactgctgttccgcgcggggcaactgggcctcagcccgactcagtctgtcggctaacagcaggatcccagaggaggctgcccaacctgggcaccccctgccgccactctcgaataggtgggagtagggaagaaatacactgagccagtcagcccgtcgctccgcgaaagggggcgccctcccctgaagctggggttggggaactggggtgtgccctgtcagccccagctccctgttccgggctggagggagcagggcagcagaccaaggcactaggcctctcggccgagtctggtccactccacccgagggcagcctctggacgcccactcgccctgcaatctgcaagttagtgacgggtggggggcgagcgggctcctaccgcctccaaccgggctgtgctccccagcctgccacctgcaccccggagcagggagggggcccccgggagcgcgcatggaaaggcgcgagcgcgcgccttgtgcaggcggccctgtcccgcgggcgcaggggcgctgggcgggcgcctccggggaggcgggcgggggagggggcgggggagggacgggggaaaggagggaggggcgggggctggaggcagcagcgcccccgcactccccgcgtctcgcacacttgcaccggtcgctcgcgcgcagcccggcgtcgccccacgccgcgctcgctcctccctccctcctcccgctccgtggctcccgtgctcctggcgaggctcaggcgcggagcgcgcggacgggcgcaccgacagacggccccggggacgcctcggctcgcgcctcccgggcgggctatgttgattgccccgccggggccggcccgcgggatcagcacagcccggcccgcggccccggcggccaatcgggactatgaaccggaaagcgcggcgctgcctgggccacctctttctcagcctgggcatggtctacctccggatcgggtaagggctgcctgcgccctttccgcgcgtgtttcgacaaagttggcacggcccggggagggaggtgtgccgcctgcgagcctctgccggccaacttccacagcttctctgagaggccgggtgggtgcggtgtgggagcggtggacgcacaaaggccccccgcaggacaccccaggagatataggcagggggactggccatcctgaggacgtctgagtctggaatcccccaggaccagagacagccggtagggacgctccagcctgagggactctgggggagggctagctgctgcaaaggttcagcccatcccggggacccttcggacccgggcatagggacagcaggtctagcaggaacatcaagccaggaccacagccaatctcggggagctcagtccccggagcccgagacgaactctctcaggaggcgcggcacagccgttcctagagactgggcagtccccaggtggctggcggggccggtccgtgcaaacagggaacaggtacccaggaggaaggacattcgctggcaaaaacataaaccgccgctcggagccttggcaccacccaatttccaggggcccttagactcccagagccccttcccgggccaaggggacagcacgtcccacccccaacaaacacacacaaaggtgggacgagaggcggtctgagacacagagggagacaagcgctagagagaggcgggacaccccgccccctggaactgggcagcagaggcggccgggcgcgcgagcagccctccggcttcacctagcgtttctgtggaggtggggctcgggggcgctctggctggaaggtgggagggggcagctcgggacgcgtcctggagctgcttgtgcaaagccggtcaccctttgtacttaagacaacgcgtgtgaggctcggagcggtgtgggggcggggggatctgggcatggatagaggttctggcgctgaagggcccgcttggtaggtctcacacaccctgcccctccagcccccagcagtgaacccattaccatcccttttgaggaggggtggaccgcaggggctgcggcgaggggatgtgcgtggcagaccctttgtgttttgtcactactacccccctaccccgtcacttccccagtccacgtctctggagcggggatttcgcaagttgtccggccgcggccgctagcaggtgcgtgcagagccgaccaggggccgccagcccgaccagcggcggagaggcggctgcggggctcgcgccagtaccgccagcctgccggtgtgttttaagtgttattgattcgcccgcgtctgggtggctttcctttttttcccctgctttaatcttcatcttggcccgcgccccgccgccccgcgcacattcagcatccaggaagccagtagggccgattggctcgagccgattgactcgggccgcgtgcggctttatctcctttttaattagaaacggggaggagggacacgggtggcgggggagacagaaagggaaaacagcagaaaataacctcccctggccgccccgcccgcccgcgggccgccctcccgccggcgccgcggcctccccggattggccctgcgggggcccagctgcccggcagggagggagggagggagtcctgcagggcgctggctttccgccccaagctgccctctggggtagggagaggtccaggtcggagaggtgggagttgcaggtgacttcgggccaggccctgctgctccctgcgcctcgggctactcatctgtatagtggacatgaggggtgaagtctcaacgtccctaaaaggtttttccatttccccagacgtgacggctctacccgcttctggctgatggtggggcatctgcggtattcttattttgctcggatagttcaggtgactccgcactagcctattgcaacaatcagatccgataacgataatgataattacaacaccaccaccacatttatggggcactcactatgtgcctggcaccttctaagcactttccatgttctagcacatttgattttcacagcagccaatgaggtggggactagttatcaataccctaatttagccatggagaaactgaagtgcagagggaaggaaacttgcctaagatcgcacaactaataagtgaaggaagcttggatgagaacctaggccagacccttaggggctagtctattgcacctatgaatttttggccccagtatgccaacctatccactctcagctggtgtagaaatttcctggtggccagctaggtgctcagagggtcctcctgacaaatgatgccaaaacgtctccacttaatcttctcatgctgcttcttcctcagacattcccagcattctagtgtgtgttagactcgggtttagcgctgagatgccagtgcaaagccaggctgtcccacctccaacacctgctagctgagaaccttcctccaggtcccaacctctgtgagcctcaattttcaaatatgtgaaacggatgtgatgattcttgccccacagggctgtgtggaaaggtcacatgagctgctgtttgtggcagcacccaccatactgccttggcacatagtagggacactgcccaagtttactgatgcatttgatgcatatttggggggcacctgccatgtaataggtactcacccggagccacatctttgaagtgccacaatccatttattcagcagtcatttagtgaaccagcagacagcctccctgccctcagggagctcatcctctcaggaggaagacaagtgatcaagtgagcatgcaaattaaaaacacagacatgaaaacatttcagtagaccatgagtaatcaagaatatccagtaaacaaaacagagattgtgatgggaatttattaggggtagggaggggagggaggagcccttagctgggctggtcagggaggtgacccttgaggtcatgtgaataatggcaagaagccaagcttgtgaagatcaggggtgagagcgcttccagggagaggaggagcaaggacagagtgcctactgcagggagaaggctggcacgtggcaggagcctagggaaacggcaggagtgatcagttgtgcgcttggagggcatgggtccatgtcacctccttgagttattggtacaggagaacctcactctaacaaattgcaactccagaaaactgcccacagctgagccccaggacgaggcacttgtccagtggctctacctgcagccctaccactgccaccaagccaagccaccaccaaccctaacctgcctagtccctctgctcctgctctggcaccccacaggtctttcctacatggagtggggaccaccaggtcatgtcagtgtcctgcttacacccttcagtgcttcctggtgctgcctgatgcacctgagaaaatgccagccctcagccatctcctcttcccaggatctccctgcatctcaagccctggctttgtagcagtttccatgggttctttctattccttgaagaccccgaacttgtctcctagaactttgcattttctgttccctctgcatagaatacccttctccagatcttcccacagatgcctcctggcaattcagatctctgttctgttctaatgtcaactcctcaaggaagtcctcttgatcacctcagctaaagtggccctcactttcctcaccacccccacaccccagttgccatcccagcatcttcctttactttcttcatagtacatatcactgtcgagatggcctgttttattcatttgtgacatctgtgttgtcaccctccctagttccttgagggcagggcattgcctgtcaggtgcacagctgtctcctagcatggtacgtggcacatgatgggtatccgatatatatcagtgaatagttgaggaagataggaattctcctcataatagtcgcacacatcctctaggccagtcatgcccggagtgggatacatgtactccattgacagcaggaagaaaatgccaggacttctacttacaattactttttaagttttttttccaacaataaaacatatacatacatgagagtatatgttacatatacattaaaaaacagatttttttaatgaacatctgtgcacccatcactccttcaaaggcacctgctgcatgaaactttgaagtcatcatttccttgcttgcctttacaattttaccaaagagatgattccctagcaatatagagcttcttttgcatgtttttgaacttcatctcaattgcatcctaccataaactcaaaggcaacttgccttttttactccatgtaatgtttgtgacatacatcatctttttttgtttctaaaacaaaaatcaagtgtgtgtatgtttcactgatattgggtatacgcattgattcaagagcctatgtagaaattatagggtttctattcgaatggacatgagttaggggtgcaggatcaaaaaagttgggagaccactgctgggggcagtggggtggccagtgctggacacctacgaagggttcccaggccatgcccccttgctggcctaatgctccatctctctgtgtctctccctccagtggcttctcctcagtggtagctctgggcgcaagcatcatctgtaacaagatcccaggcctggctcccagacagcgggcgatctgccagagccggcccgacgccatcatcgtcataggagaaggctcacaaatgggcctggacgagtgtcagtttcagttccgcaatggccgctggaactgctctgcactgggagagcgcaccgtcttcgggaaggagctcaaagtgggtatgtgctcacccaaacacccccgcagagtcttaccggctctagggacaccagaataccctcaggtgccctctggaactccctcacctgcccctgctagaatatccctcagtatggggtcctgcaggtgcattgacttgcattcaggactctcagtgagggtcaggtctctggttgaatccataccccctcaatcgtttattgacagaggtgcaaaccagcaaccagtgacccaaatgttaacctctgatacagtgctggtgttgtgttttgaattgaagcccaaattttaaaatttgttgtttcacctaaaatataggaatttctggtttcttttgaaaagttggcagatctactcttaatttacatgtgtgcccatgtggttgcaaagaccttaaactgagaacacaactccctttagttgcagcagtgaatgggcaacccattcactgccgcagtccccaccactccctactgctgcccgtcctgtgcattcctgtgacatgatccgcttgactcctgtgggcttttgactttgcaactgttttatgggaatggcgtgtgcagacacatacatacacacagagttttgagccacacatttgacttctgaagcaactataacaaaagtctggtggaaaagggtcagagagagcaatgctggtctccaggaggccctggtcagtggcaggaggccgtgctgtgtgtcttctggcttgtgtgcgtgtgcattaggggaccagaaactgccacaggctggcttctgcactgtgaacttccctgaaagccaggtcagccttggatatctttgggtatcctgccgcctcctcctcaggtcacactgctgtcacatctgggctcccaggctgtcccacgctcccccatctcattgccctgttgctcctggccatcctgcagtcccttctgcacccagcaggcaggatcatccttttacatggaaatcagatcatgtcactgcgctgcttaaacccctctggaggctttcttgcatcagaatgaaatccccactgctcatctagctgctgctgacctctgctgccatcttcccccttcaccttgctcactcagccttgtcctttttcccaaacacaccacactggacaccagctatttcttctgccttagctcctttcctcagccccatgcccctgaccctgtccaggtcttctagaccttttcgaccttgtcgaaagtcccctctcacctcaaagctccatcccatcagccaagcacttcacactgtctcaatccattccgaactggtttgcaatgtcagcttcatgagggcaggggctctactcccatgcttaccactgaacgctttcttccccttgccttttggaaggaagcacagccttacccatccctgcagcaggcctggttttgtcaccatattctgtgagtgccttcttatttgcaccttacagaactgtagacaggatctcagtatggggtcctgcaggtgcattgacttgcattcaggaatcccagtgagggccaggtctctagttgaatccataccatcccaatagtttatcgacagaggtgcaaaccagcaaccagtgacccaaatgacacctggtgacaaatgtcaccaggtgacatttgggccactggtgaagttggcagaggatctttccagaggcaaaccttttccagggtctttgttgtgtagacttttgccttgcaccgtctgccctgcttttccctcttcccaagcccagggctcactttttagttggaaacagaggcccagagagagaatgggactgtcccgggtcacatagtgagtggcatcaacactgagactccagtttaggttgcttaatctgtcttgtgagcctccccttgcttgtcgcttgtggtttttgtgctttcttctactcagataacacacacagacacacacacacacaaaattcctgggacccaggcatgggctccagcattgttttaaatttgtggcttctgatatataagatgttatagatgaggaaactgaggctcataagggacttgctcgaagtcaagtcaaatgagtggcagggcctctcaggactgggttcattcccgtataattttcagtctcagaacagtcagtatatcaactggcattggaatagtccccacagaggtctggggtggagcaggagggctgcagtgcagggcagtgcctggacaaggatcctctcctgttgagcagcccccagctggccatggttgtagaagagaggctgaggaggaatactgccagcgcacaccagggaggagcagaggccagtggcaagaggcattctagtgggcttggcaggcagaggtggctgggggaattccagcaaagagaggtgcccaagaaaatccttgggacagcgatgcagggcagttggtcggaggagcctggaaggaaataggagctggagccaggaggtatacagggtcaatttaacaagtttgaatttctgagtgggagtcgttggaggattttgagtgtgggagtgactgccagaggataggttgaacttatgaaattgccactatgaaatgatttttggcccacagaagtggcaacataatatatgttgatatacatatattatgcattgacttgcattcaggactcccaacgagggtcaggtctctggttgaatccatagcccctaataggaataggaatccattcaaccttataggaattttagaagattcatgaaagagtgagtataagttcattgattataatacttgttgatttattcatgcattcaccaagttatttggtgtccactgtggctggaggctcctgttccagtgtgtgtgtccagggaatggctctggatttgtgagggaggtgagctatgggcatgtctggggaaagagcatgtcgggcaaagggaacagtagatgcaaaggccctgaggtggaacgtgcttgggggtggcttaaggaacagcgaggggctggggtggctggagtagagtgaggaaggctgaaggggaagtgccaggagctgggtggtgcagcatccctcaggccagggcagggggtctggatttcccttcatgggaatggagaccttctggaggggagacaataagggagggacagtatccgactttgggtttagcagcatcactctggctgctggcaaaagcatgaactgcagggtagggtggcagtgggggtctggagtctggtcgagtcttccaggaaggaggtgatggtggctcagcctcagtgatagccatggagacctgctttgaaatccaccagccaggaaggagggagagtgacaaactaagggccagctaggaagaagggagggtgacaaactaagggccagctaggaaggagggatggtgacaacctaaaggccagccaggagggagggagggtgacaacctaaaggcctgctaggaaggagggagtcactctggtctagacttctagggtagtggcagtgggaagaggaagatgagtcaagatgagagccctgagagtctgaaatgcccctgagcttaggtttcctcatatatagacaggtgtcctgctccaggacatcaagaagcaagcatcacatttagggtcactgcgctcctcctcagtgctctcacccccatggggttgccactttctgggaatgaccagctaacaagggctgtcttgcaggggtaaaaatctggcctttggagctgtggccattaagtcctgactttgagcaccaggacccattgtctgcctttaaagagaaactttccaaagctccaccccatacttctgcttacatatcattggccagaacttagtcacatggccacatctagctgcaagggaagctgggaagcgtaatcttgtattcagagtggacatgagaccagctggactctgtgactgaagaggaagagttcttcatcgcatgcctggctcccttctgagtattcagttttcctgcatagagctgagaggcagcaatgggcaggtaccaggcaaggtccccttgcatgctagaaattgaaccccaattcaagccacctctggtgaaagggggacttatgtatgcctaaggaactggagagccagggcatggtgctgactttcgaaatggactggaccagaggtagcgttggcatccggcaaccccagggccacctcttggggcagcgggacggcctttgcacctgcagtgccacaccttccagattcaagtacccccagaaagagcattggcctttctctagcagcacttggagaagttctaagattcactcggattggaccagctaatggggctttacttttggttgtgtgcccatcccaaactaatcacagtggccaagggcaacagtgctttttctggcccagcctggtagccccacccagaccatctctcaggggagaggaactgctcacgagtgtactagtctgctagggctgtcagaagaaagccctgcagaccaggtagcttaaacagcagaaatgaattgtccagtttcagaagctggacgtctgccatccaggtgtcagcagggctgctttctcagaggcctctctcttgggcttgccaccttctccctgggttctcacatggcctttccccttgtatatgtgccccaggaatctcttgtgtcctggtctccttttttataaggacacgagtcatataggattagggcccacactaacagtctcattttaacttaattataatacttctttaaagttcctatctctaaatgcagtcacactctgaggtactgactcagttcacagcaatgagtggccagagtgcagcatggttcaggctttagggagaaggcagagggagtgtggcgggctctcagaagtgagacctcaggatggagggaggagtctggacagtggagatggcccttgatctgggacttggagggtggggagaaatttatcagtgagtgggattccaggcagaggaaacaacagagcaaaggcatggtcatgtgagagctatggtgggaatgagcaggggcctgcagcctcaggagacggtggctcagagagtcccctgtgagatggcaggctagctgtcaagacccttgaatgccagggattgtttgagtggggtgtgtggccccacatcagtttgaccaactgctacctaagagaagggtgtctaagaaggccttcacttccctctagacttttctttctttccttccttccttcctttttttctttctttctctccttctttctctatctttcccttcctccctccctccctccttccctctttctttctacttttctgtgtctttctttcctatctttctctttctctctttcttcctcccctcctccgttcctttctctcactctcttgagtcagtgccaaagctgcnnnnnnnnnnnnnnnnnnnncctccacctcctgggctcaagcaatccttccactgggattacaggcacacaccacctcacctggctaattcttttctgttgtcttatagagacgggtctcactgtgttgcccaggttggtctcaaattcccagcttcaagcaatcctgccttggcctcccaaagcaatgggattacaggtgtgagccactgcacctggccatttttttcttaaataatattgtgaccttcctcgaatttacccccaacacaacttgtcatccacgtttgtgagcctccctcatgtcttccctgcctctccctccctggctacactttccctaccttgaatcttgagtttcccattcccttgcttatttatgtttaatgtatcatatggagatcttccccaaaagtaaatgacttcattttggttggattgaattgctattgtgccaagctcctcccccgctggaagcacagctccaacactgggactggccagctgcatgtctgcccagtgagtgggtgagaaagacaatctaacagcatcctgatttgcacttccctgagaagtgatgaggttgaaatatcttcctgtatttactggctgtgcatgttcgctcttccacgagttacctcttcatgctttttccccatttttctgttgggttgtgggttctcccattgggtttggccagtgtggttgtagtcacagtgcagggaaaccagggttagaccaggtaatgcctagggatgagtgggttccttggggtgagtgggctcctcagggtgagtgggctgtgggaggcttcactctatcttgtatcttttcactgaggatcagtgtggaccaggagccaagatagccctttctcatccgtcacttcattgggtccttggcacccttgaaagaaagtgtgtccacctccgtctcattcctgggagacaggcttagagtcaggcagaggctgaccaagatcatgtggctgttttgtggcagagctgaaatcagttgtgagtccccccttgctagagggattcttctgtttgtgtgatcctgccagagattctcaagtctgccatgtatttgagaaccccttgtcttgctgcaggtgtggggctgccaagtgagtactgaaatcagagtcacatggccgggtttgcatcccagccccacccttaccttgcagatgactttaagtgagtacttcacctttctgacagtctgcagaatgggggagccacacacccaccttgctaggtggtagtggcattacatgatacgggatgtaagagcctggctcattgttatccattggatgacatcccctgcccgcttccaggaggcctgtgtgcccgtgtcatatgaacacaagctcaaggaacccgggacccatgctctagattttcttagtgattaccatcctaagctgaccattttgactctacctccaaactatatcccccaatctgtccagttttcaccaccttcaccaccacctcctgattcaaaccgccatcttcagatacttgttgcctggacaatgacatcaacctccaaatgcactccacctcctccctttcatcctgcaacccacgcagccatccagcatgacatcttctccgtgttgctccgtgtggcatcctgctgtgtaaaaccctcccgcggtttcctgttgttctgagaataaaacgcacacccatcccctgctcctttatggacctctgccaaagtccctcccacctcagggcctttccctcactgttccctctgcctggatgctctttgccagcttggctcgctccctctgtctttctatcctctactcacctgtcagcccctcggagaagccttcattaccccctctctagtgtacactgcctgtccttgtccgctctcactgtgtagcattttctttatgtcactttgttactccaggatgtattctctgtaacttgctcatctgtgcagcgctgtgtagtggttcagccctgaagcttactgcttggtcatttaccaacagtgggccttgaccaaacgggagtgataatggcaccattcccacaggtggcgagaggatgaggttaattactgcactcagaactgtgcctggcacacaggaagtgccccatacatcgtagctgtgttgttattattgtctgtctttctggccagaaggcagctctgtgagggagcaggggcctctgacccagtgcctggcacatggagggcacagtccctgtggaggtgctcagtggatgtagggacatcacaggtaccagagcagccccctgccccaactcctctctgcagcaggagatggcacagagggtacttgggagatgcagctgagtgatagtgggcaacctgtcatatcctgcatatgcaggtctccactcaaaggccacctcctccaggaggtcttcctggaccatcctgtccaagacagcaccctccacccttccctgacagggcaccctgcactgttgtctttgcagcacttaccacttttggaagtgactttgtttacttttgcaagaacccatctgacattagtcttctctgccatcatgaggctccatggggcccagatctgctgatcctcttctccccagaccgccagcatgtgtcctggggcctggcacacagtaggtcctcatggaacacgtgaagaagtgtatggcccccaggcaggccagctcctttctaccttgtgtggccccagttgctccgagcccttgaggacaggcctggccttgtttatcttccaaatgacgggtctggggagcacctcatgcacagcaggtgctccgttttctctgttgcgtgagtgacggctgtttacttctcaccccaaataaaaaactgcacgttcatgtctgcacattttcattgagctccattctagctgggcagcctcactcatcaagatctttttaatgtcaatttgatcaaccatcctgttagctatcctgtccatctctgcattggctcaaaatgggataaaaaatgttgactaggtctagtgcctaggaaagacccctgtggcatgattcaagaggagctgtgcccgttcccaggctccacctgccgcctactgccagctgccccggggagaaaaggacattcccttggacaataaaatgggggaactcagcatgttatactccctgctcctggagagtcagggtgcctgccggcatattaaaggtgctgaaatgtcctgtagataagacagcagcttgagctgactcaatctagagggtccactcatttccatccttggactcactgactgcccagtggagctgctcttaggggcacacacactggggaatatcaccctggagaccctcacagcttgaccatactcagaatgtggtttataggtcaacttggaatctaccaaaaagtatatccacccaccaccaatttccatatctttccccaagggtacagaagaggcacatcctcgcttcggacattgccatgggcagcgaaatccattctaatccacattaccattgaaagtcccttcaatcatgcataaaattcagaatgcctgagtttccatacaagtacaggaaagcatgcacatacatgtaaaatgtatatgcgacaacacagtgtatagaatgaagagtatatatccacaatataagtatataatattttaatttttttctggtacatttggttcaatttatggaagttaaatgttcatgggataagactcccccacttgtatgtccactcatttattcacgtcctcatcccacagatatttactagaatctctgcagtaaatgctggggtgcaggctctgtctggggcacttgctatctggtggggacaaactgggaagtcaaggctgaaaagtgctctgaggatctagtggaagagaaacaggcactgggagatgagcacagaagctgcccacatgggtcacctgaagtaggggccgtccacaacccaggaggggaaggggagtggcagcaggaagggcttggctgggcgacgcagacaggagccctgggatccagagtggcttggcacgagggactgcagggcgtagcgtagggagggtagaagaggctggggaaagaggtgggaccaggcatcctgcagggttttgggaccagactcagggggtttgcttgggagggaagttgtcagaggtatttaatcagaggagagacaggatgtaggaagataatcaaattctttgcacacacagaacattgctatgtctccagcattatcatcggcaaagaaatggtgatttcccgccatgtgctcctggggatgggtgcattcttttccacatgctcacgacctcctgtttggtacccccctgccggaatttttccagggatgggcacaaatgacctaggagtcaacccctggagtccaccctcctctgtctacaatctgggaaactctgatgcatttctgggcttctgcctctgtagaatttgtcaccacttctcttgggcagtcacttgagcagctctctcctctccccaaggtgactgcctgggctgagggtcccatgtctggggatccccacactctgcaaaaaggactccatcattttacccatctagggctgtgagagtgcaacacatgtctggtgagctggtgaatgcttagaaggatggatttgaagacctttccagtgagagagacagaagcaaggggcgggccagctccattttctctctgccatttcttaacaatacgccatcttgcccaagcaaaagacctattctttccttattcttgcttagaatgcagctaacaaaggactttttgtctcgtttgcattttttttttgcaagcctcagttcatcctgggttttagctctcctgacactattctctgagatgactcttttgttataatgttctcttcccagctttcatgtggtagacaggcaggcaggcaggcgtgcgtgcgcatgcaacatgcagacacacacacacatatacacatacacacacacacatacacatacacacacacacacttgctttcacatgcacattcattcattcattcaactgttgaggcttcacagataaataatccaggtccccacaacctagtggcgagagactgatcattcaattcaatacaaagtaaggatggacagggtgctgggccacaagtggagggaggggacatctgggaggcccctcagagtagggaacttgggagccatggcttgatggataaggtgctaaccaataacgcatctagtaagagctactgtttatcgatcccttaccaagtgcgggctgagcttgtcatgtgcattggcttatttaatcctcccaacaaccctgggaggtagacattttgtattcccactttacaaatgaggaaactgaggccttgagaggtgagttagctcattcaaggtcccgctgtcaggaagagggggtcaggatgtgaacccagatttatccacctccagggctctgttttaaaacttcctgggctacattcactgccccttagcaggcagatggaataagaaagacaattgcaggctgagggaacagcatgtgcaaaggcgtgaagccaggaaggagtagatgctgaccattggcaagtggtcagcagtgtgctctggccttgctcagtgggaagagagacccttggatggagaaagacagaggctggggcttgcacacacccctccccagtttcccgagctgtgggcctgttaccttaccaagctccgcccagacacagctccctgcacccccaaatcttccagttattcattgagaggctccctggttcctcttggtgagacagccccatgtggcattctgagcccagaggggctatgaactgccatgccacggggctggcaagcgcaacctttttccatctgtatattttccaaatcatatatttcagcttgtgtcactgcagattgcttgctctctgacccattggctttaaatagcaaaagaaaaaaaaatacaatgcactttgtggtttccagtaagataccgtaaatacacccagataatattccggtgcaaaccatttacagtggctacacagggcggtggaatggaatcttttgggcaggcttggacatcagtttatttcctctgtacccgctgggatcgttatggagctggaaccacagagggcgtcagctgggctccccattttcgtctcagtgataatatgtatcgttctttatccagcaccttctgggagctccatagaggcttcattccacagtggtctcatttaattttcacaacttggcaatgtcctcctaagggttcccacttcacagatggggaagctgagactcagagaggcagagtccttgcttggggctcccccagtgaatgagaagtagacaggagggactgacgggttttgtcttatctgagttctgagctgaagtcacctgggatatcacaggagggaaggtctcttggcttctggatgaaaagtttacctggagatgtggatggattgagaggtaaggagggcatgggggaggtgagggagccaggggatcttctggtcttgctgagtcactggtgaccttgagcaagtctcccattctccttgaagctatcattccagtaggagccccctggctttgtttctgtggctctaggaatctcttctctgattctggggagaggaagggctggcagaatccacacccgcccacagcctcacctcctccggtgccgccctggctcacctgctcccgccactagctgaccacaccacaccagggccatcactcaggctaccccttggcctgatgccttctttgcccctagagagcctcatgacctccccactcaaggcaccaccccagatatccccactcccatcactgccctgtgtcaccttcttcaaagtcctcagctgccacggagtggcatgatcctactgcctgtccttctacgaaggcaaagccatgtctgaactcctcatctgagtttcctcatgccctagaacagtgcctggcacatagtagatgctcaagaaatatctgatgagtgaaggaacagacggcttggtcagggaggtggaggggaaggcaggatttgagggaggttcttcctctgctcctgggcaggagggaggggcaggtccttcacagcagactgtccccactgccaggggtggaggatctgatcctggagggcacacaggccatggtggccaagcccagggttcactcacaggctccacatggatgatctgggcaagaatgtaggcctggagtcagtaggactggaatggttttcaaaaccttgaggcaagggagtgggtcaaactctggggccagctgtacgagtttgagtccttacaggttgtatcacatgggcctcagtttctgcatctgtaaaatggagataatagcagcccccacctcccacgttgttgccatatattgtagatctatattcagtgcttagaacagagcctggtgaataagaaacattttgtatgtctttgctcagctttttatgtactatatgtcattggacatatgatctcatcccatttccacagcaatagaacagaccacccttgcaggtgtctcctaagataaatgaggcatttatcttaggcattcgggaaattacccacctgaatgaaggggcttccccgtacagctgagagaagggctgttctcggagcagtgagcatgaccagggtccaagggagttctctggagtggttaggcacagcaggtgacctccagatttgcatcctaactcttcctgggcaagtcacctcatctccccaagcctcagtttccctatcttacctaggatgagtaaaggaagcagacatggatggagtctgagatttattttaagattccaggaggcttttctgctttctaccatcaaaccctgttctcagctcagcaagccatccgatttgaatggttttgataaattatttattgataagttttaattgataacaactgaatgccatctcgttttagaagtaagtgcattctgacaagagttgatgtcttaagccagaagaatctctaaccatggggtttccatgcactggtgggccaggaagggagctggggtggggctgaggaaggacactgaccaacttgggccttgaattccagttctggccagtttctagctgggtgacctcagcaaatcactctaactcagagcctccatttcctcaactgtaaaaccatggggaatgacatctacactggggaatgttgtgaaacaccttcacagaggaccaagcatgggtccggaacctaggaggtgcccaacaaatgttaccttctctctactctttcccatcttccttaaaaaaaaaaacccaagtgtctggctaactctgtgctcatgccttggggcagtcttgatttgatgaatgggctaggagatgggctataaggggctggagtttatcacaggttccacacctgcctggttagatcctcttggagcctcagttcccccatctgtaaagcagagaggctgttattacctcccttgagggttgctttcctagggaatagatgggcattctcttctaacatgctgagcatggagtctggcaaacaaaaagcacccaagaaagaccatgtggttgaaggcacacagtctgtggagaccaagtcagagctttctttcattcatttattcattccactgctatttactgggtacctactctgtgccaggccctgaggacacagcaagggccatgacaaagtgcttatcttcaaagcaattatatccgagagggacaggggtcatggtggtagggctggtatggggaacagataatcagcagctaagtctaaaatggcagggagcaataagggccatggataaaacagatgcagggcaagttcttctctgtaccacccagtggcacctataatttcatcaattattataattataatgctcactactatttgtttaagtacctgctaggtgccaggtgatgtctacctcttcctacagggtaggtgctaataacagatgaggaaatggaggctcagagaggttaagtgacttgcccaaggtcacacagcttttggcagggttgaaattaggactcaggtctgtctcacccctcacacattttggaggaggttggagacggtgggagtgacagatatggtccctgtcatcttgtaaaccttaaatttgcctgggcagacaaacactggatcagcctcacatacttgcctctctgctgtgaccttcaggacattgtgaaatgggactcggtgatagtaacaacaacaaaactacaacgcaacggctgatgtttactgagcactcacggcatgccaggcactgtgctcagcaccgctcaacaccccttgttttgtaattcagttcacttagacacataggtgctgtgtaattgtacccatttcacagaggaagcaacgaagggtcaaagaggttaacagccctgacgttagtcacacagccagctggatgcccagggtagtttcctccatggtagtgtgggggtggagtgggattggatcatcccagtctaatgtgggcaggtaaggccaacgtcaaagttaatggcaagagtcaaaagtgactcttccacatccagaaggactggactttaccagccagtacctgggtccctgagagctctgaagccaagaatgactggccctcatcggtgtcttgactacagccttcgcttgtcaggggcagtgggtgctgaggaagcccagcttggtggggaggggaaggccatggcacttgatgagacctcactctgggctgtggggaagaaagctctccatctggagctcgggggggtgaaatgtgccccaaggtgcagctgcccttccccacctcaggggtgggatggaaatggtgagtgggtggaagccatctgtggttagctgtccatttctcaccatctgcaccatcatgcactgctccagagactgagagacccagggacggtcaccactgggctgtagagcagaggacacacgaaattaccacaggagtcttgggctgacagccccctcctctgcctcctgccccttccccagggagaaaccaagggagaggggccagtctttgaggacaggccaggctttctgccccgccttgattcgcaaactccattcttggtctgataaagaggacacagtctcccatcaatggctggagcctgccggtggtgcctgcccactgcacctgggaatcatttcatccctgggggcagttcttggtctacatggggtgcccagaggccgggtctgcagctcagctctgctgcccacatgttgggtgtcccaggcaagccaaaagcctttgtgtcttcgattgtaaaagaaaagccctactccttacctctcagccctcttgtacttgtagagacttgttacctccatcatagataagaattgttataattggagcatttggggccacttcctcatgccaacctctgtgctaagtgctctaccattgttaatttttatcatcacattttacaatgggggaactggagcacagagaggttaggtgactcacccaaggtcacacagctggaaagcagtggaacagatttcttccctgccctccatctgattgtccttttctctcacgtccttgagggtctattctggatattgactgtctccctgagggtttggttttcttgtgagtttgatactctcgagtgtgagctggtgcctggggttggagagctttctctttgctcctctaggctctcggggaatcactggaccgggggtgagtcttcccacttgccttggagcccttggagcatgcagggggatatatttgagcctcaaatctatgcaaatgcaggaagtggcgatcaatttccaggagattctggcttcctccaaccccacctgcccacctcctgcgctggctggtgtggacctgtgtgcctgtctagctttgctggagggtggggacaggtgcagacttttcctgtctgtctgccgtttctttgcccgaggatctatccatgaggctctatctctttaccaaggccctgcctcagcagcactcaaagcctggtctcctgacacctcatgggcttaattccaaagctccctccttggcagagctcagcaacatgcgtctattcccacctatcttgctggcagttctgtcttcaacctgtggctgagacagcttcccttgtcctcctatggcctggtccagcatgcagatcttacacagcatttcttgatttcatgcagcaaaggcattgttgggttttattgctggaccagaaatcgagcctgttcctgtgccccatggctcccctgtccttgctgccctgtgctagtccctctgatgggcgtgtgttactcagagatgttttcttccttcttcttcttcttcttctccttcttcttcttcttctccttcttcttcttcttcttcttcttcttcttcttcttcttcttcttcttcttcttcttcttcttcttcttcttctttttcttcttcttcctcttcttcctcttcctcttcctcttcttcctcttcttcttcttctccttcatcttcttcttcttcatggagtttcgctctgtcacccaggatggagtgcagtggcacagtcttggttcactgcaacctccacctcccaggttcaagcaattctcctgcctcagtttcccaagtagctgggattacaagcatgtgtcaccatgcccagctaatttttgtatttttagcaaagacagagtttcaccatgttggccaggctggtcttgaactcctgacctaaagtgatctgcccacctcagcctcccaaagtactgggattacaggcgtaagccaccatgcctggccccctcagagatgttttctagtactaaggaaatgactaatgcagagagttgcgagcccggtaggtgctaaaataataccctttcccgacccccaaagttgagctgagttccccaggggcttcattccacttggtgccaagtttcatgtttgtggagccaggcactggctatgcatttctgcatttgacatgcccccttctcctgtaccttctcagcagctcctgtcaggcaggcgctggcactctccagactgagatgcggacaggagaaggagctcgcccaagtcccagtcagtcagtggcggagctgggacttgagcccaagcattctgactccagagcctctgtgttagcagggacaccatgggtgggctggcatggcacgccacggcaaagacagccctggcatggggaagctgtccagtccagcaggtggacaggcctaccttctgcagggtgggagggcagcgatggggtggggggacaagttgtttgtgtctgtctccccctcctggggagggaggtcccaaggtgaatgagaaggtgggtggggaaggacctccctgagcatgggacagagtgacctgaggctggaagcaacttggagcaagtcatctgcctcctcacttgctgcttaagccgtctccatcctggcattctgaaacaccttctctggcccccctttgcctgctctgggttccagggcctcttcttccaggtgccttccctgaaacccacccaggctacatgagagtgaacttgcccagtgctcctcagggcttataccacacacagggcttcccataggttgctttggtcagtcttcaccctgtaaagcagacgtagcccttgaacccattttgcaggtgaggagactgaggcccaaagaggctaagaggcgaggtggcagcaccatatttaggccaactctgagtgactgcctgtcccacgctgtctcctgcaccccagctgctcaggaccctgccctaccactggagatactcacagtccagtgagggggccacagaagaagggaggggatggacatctgaaatagcaggtgacacacagaaagagtagtagtggccacgaaaacaagaggtagggtgcagtcaggttccatgaatgaaacatggggccaagagctttccatggacaaactcttattctccctcattgccatgagaaagttaccaatgatatgtccccattttacagccagagagactgagatgcagggaggagtagtccttggccaatagtcacagatccagggattgatgttcctgggatttaaactcaggccttctggccccagagccagtgtcctctgtgggtgttggggaaacgctgctttacgatgctgtgagctttatgcacgtgtgcagtttacatggttacgtcaagtgtgctcaggagtggggagtggggactgatgggctagaggggtcccccacatctggccttccagatcctgggcaaccagcccacataccttcctcctttactgcccagttgactccccaggttctggggttgaatggatgtgtgtgtaatgggaggtgctcagctcatcaccctaaaagggagctttgttggaagttaggaacgggtactcagtcgagctttggagagccattgcattgagctcagcctcactcttcagtcaggcccagcctcctctcagatgcttgggacctgaccccaacttgtctcctcttctctcctcctcgcagggagccgggaggctgcgttcacctacgccatcattgccgccggcgtggcccacgccatcacagctgcctgtacccagggcaacctgagcgactgtggctgcgacaaagagaagcaaggccagtaccaccgggacgagggctggaagtggggtggctgctctgccgacatccgctacggcatcggcttcgccaaggtctttgtggatgcccgggagatcaagcagaatgcccggactctcatgaacttgcacaacaacgaggcaggccgaaaggtaggaagccagggagggcagctgggcggcgctcgcggagatgctgcaaaatggcttgtttgtaacatctggtgctgggtgtctgttgaggagccacagggctctgccctcagcctcattctgcttggtgctggcatcagcttgtagctggtcaggatttgtgtatggcacgaagcttgtcagttactgaagaggttggataattgagtctcccttaagacgaattgaatgttactcagcaagatggaaagagggacagatgtgaactcttatccttgggagggaccaaattagcctttctcccttgctcccttcctgcctctctccctccttttttctctccctccctccctccttccctccgtccctccttcccttcctccctcttctcaggcttctggccacatcctgtgtgtcagagcctcacaggtggccttggtgagtcacacaggggaattgctcacctggtctgccccaggatggtgtcctgggggaaattaccaggccctgcctgtctagtctcatggctgggagctcctgcccagggtggtgcatccctgcagtggtcccagctgctccctcctccctgtttttgtggtccaatcaccctgcaggtcccaggtcccaggctccctcctgccttgaagccctcacttccttgaggcagacaggaggaggacacgtggcttccctctcccagcctcaatttcctcacccacggctccctggctgggccatggtgagaattaaaggagagaatagcacgtggcccgcagcaagtcagggtcaggatggatcccgtgggagtgtgttctgtgagccacacagctccactgggcatgaggcttgtggctgttgctctgtcatactgccatgagcccgtgggcaacacagacactgggaactgtcagaggctgtaagaccaatctcagtgggcttcctggaggagacaggcctcgagagatgagcgaggtttggctaggcagggaaaggaggtggaagcagccaagatctggtgagtgggggaggaatggacacagacccagaggtaggggcagggggccagttagggaccacactggctagtctgtgaggccctgaaaagggaacccctgcaggttggggccgaagagtgcagccttgtgttctgcccccagatctgcctgtggctgccatgtccttgtccttcaggtttcagccatgatgtcctctccccagagaggtttccctttacattccttcctagccttttctccgagtttgccttgttccgtggctttctcccctctctagactttaagcataccgaggacagaggcctgggctgtctcagacacagcagcactccagagcgtggcacacagtaggcactctacaaatatgtatggagtgaatggatgagtgccttgtggttgctggggagccactgatggtttggggcagaagtcatagacccttgggaggcagagggctactttgagtggggtcaggagctgggtatgagtggagtgcaggccaggcctgacctgatgtttttgagcaggaacagccctcccatctcaggaaagctcagtagagggccatacatcctcctgcctgcccagtgctctctggttagggaggacctttggggatggctttctagaaaagcacttctacagacactatgtatttcctgagccaagaggtgggactgtggactccccggtgtatgcagagaaagggctgagtcacacccgtcccgcccctttgtgctacagggatggaaatggaggctcagagagggtaccagctgacctgtggggactcaggtcagtgaccacacacaccactcagccagagcacggtgaggtggtcttccagcctagccccaagtggccagtccctcacttgctgccatgggacaccccaagggccccgacgagggcaggaacaaagacagccgccagctgctgtgggttccagcccctcttgcgacctcagtttccacatctgtcgattgggactatgacccactccttgttccgaccggtgccagtcagttccccaggattttgcaacacgccatttactcaaaggcatgggaccccaccccagaagccccctcccaacaggctgccatgggctccacgcatggcagggctgggaaaccgacaggagcaatggggccagcctactgctgctcctggctgagagcctcggaaaggctcgcagatgtgtttatcacccgctccctcactcctgccatgaggaaacaagactcaacctgaccacaggctctggggcttgttggcagctggtgtgagagaaggggaagcggggaggctggggtgggggggtgcaccatgtggcttctgcagacctgatgaggggctgcccctgggctgaaggggagcccccaactcccctggcagtcgaaggagaataaatgctgcaggggcgtcctgccctcacaggtccccagtttgagtctaagcccagcaggatgtgggccatggggcaggggcaacaccgcaaggaagctgcagggcatcccctcctttccctcattgtctcgtcaattgtgtggtctgcaggccgaatcagaatggttaggtgccaatatcttttggcgaggtgattttagaattatagtttcccctattggcatttcggggcctttgtactttggattgaaatcagtggccgctcaggtcgggggtcccagaatacgaagttcacatcctagcgtatgatgtgtggaatcataggctcctcagttgggaggaagggaagagtcagaagcattgtgctgaaatctttggatggtggaatctttgtggctttgaataatttctttccagccttttggccgcaaggaaattaactacccacagtttttgccctcaagactagacgttcagtctagtgagagaatcaggtacaagaagcaaaaattgtgattcagggctacacactgtaggagaaacgtgatacagaaagtgaagaaaagaggtcagaggaagagtggtttgtttcctcttgaagtctaagagtgctaggcagaagaagggaactcttagcagggctttgaaggataaggagtccaggtggacgaggcatcaggaaggaagagggcagttcaggcagcacaggcatgttcaaaagcatgaagtcctaacagcatgctgtgggggctccgtgtggccgagggtggggaggacgagtgacgaggctgcagaggggctagatcctaacacacagccttgaatgccagaacaaggagtgggactttgtcttaggccagaggtgcccagaagaggctttggtggggcagtgcttgggcaggtttctggccctgtctgggatagagtggagtacagagtgaaggggctgtggccacggttggtgcctaaacccagcaggagcctcggggcgcacggctggggaggctgtttaggaagcctaataggtaggagatgtgtcaggtgtacttggtgtggaggaacagggtcgtaatggaagccatggtgtttgtaggattgcccgatgggagggttaaagggggaaagcaggagagagcctgggccacagcctgggcaaatgggtactgggacgggagggctatgggaagggaaggacagtcagggaggttggaggagaaccagaagaacctgggccttctgggtgcatttgtgagtgcgtgtagacatccccctgcaggagtgcagagaagcctgggcagctgcgaaacccagccaagggccaggggtctccgagcctccatgataatattgtacctggcaggccaggctttcgagtccttactgtacagagagagaagtgcaccagggagctccgggggcctgggggagggtggaggctctcagcaaccccttcatgagagtgtggtgactgagcccaggagaggcagccctggggatgggggcccagctgggacggggctggcccctgctggaatgcgcctcttgctccaagggaggtgagctcagggggatggaattccgccgaagtgaaaagtcacctcccagtccctgcccagcctcttgcacacggaggggtgtcggtcttgtcccttcctgccctgccccgtctggtccgggtgctcctgggagctggattcccacccctgccctggccgcaggcaggcctgtgagtcaggggacaccagggaccagcccctggcagctggggcggagcccagataaggcctgctcagctatgctcctctctgctgtcccgagggccacttgcatatttgaccagatagagtggccagtggtggcatgtcgagggcctgaggagccaggccccgcccagcccgaagctgactggccaggccaggctggaaggaggcatcctcagtctgccgtgccctccattcctgccccgcccctgggcacaggtgtgggttcttgcccttgcgaatggaaaggcttgcagccaggactcaggggacttggagcaggaatggtcttgcacacatctcagcctttcagggccttggtttcttccatggcaggggcttctttcctttgctcccaggagggtctccaggtctgacatgtgggctggggaatgacatggggttcttgggaccattgtaccccaaccctgtctgcagcttctctcccacacacaccaccttccaaccacacactcctgcagtcaaccaagcttgttcgcacctcagggccattgcacaggccgctttctctgtctgcaaagctctttccttgaatctttgcagaactagctccttgtattccttcaattcctggctcagatgttgccttaatggggaagtcctccctgacttccctcccctgctgtctgtctcatctctctccatcaccctactttacttgcatgtgaaaccaccgcacagaatgatctcatttgcacagctctttgtgtctttattgcttgttgcctcccactgcagggtcagcaccacagggtagtgatggcctaagttcacccctaaacctagaacagtgcctggcgcatcgtaagtgctcaagaaatatttgttgagtgaacaaatgatatggcaagtgcttgctctgtcttggggggatttccaggagcagggctgcaaggtataatacaggactcccacttagagttgaatttgagataaacaaaagtacgtccaaactattgcacaagacatactaaaaaatgattcgccatgtatctcaaattcagatttaaccaagtttgtggttttgaattgagctgatattgagataattgtagattcacatggaattgtggaatatgaagagatcttgtgtaccctttgcccagtttcccccaatggtgacagcttgcaaaactataggacgagggtcacaactaggatgctgatgctaggacagtcaagatgcagagcacacaatggtccccaggttgcccttgtatagccacttctacttcccttccccttccgaatccccagcaagcactaatttgctctccacttgtatactttcattattttaacgatgttacataggtgggtcttacagtataacctttccagacgagcttcttttcattcagcacaattccctcaagcctccttcaagtgttgtgtatcagtagccggttcctttaccttgctgagtagtattccagggcacagagtctccacagtttgttttgccattcacctcttgaaggatgtctgggttgtttgcaggttatgactattacaaataaagctgctgtgtccatgtgtgtacaggttttttttttgtgtgtgtgaatgtaaggttctatttccctagaataaatgtccaagagcacaaatgtctgatggctgtatgtttagctttataagaaagtgccaaaccattttccattttgtgggagagtgggtgtgtcattttatattcccactagcaatgtgtgagtggtacagttgctccacatcctcaccagcatttggtgacatcactgtttttaaaatttttttgccattctgatagatgtatgttatacctcattgtggtattgattggcatttcctgaatggctaatgatgttgaatatattttcatatgcttatttgccatctggatagccttttcagtgtagcatctgttaatgtctttttgcctattttctaagtaggtagtttacttttttaactggtgagtttggatatttctttatatactctagcagccagtatttggtcagacatgcggttggcaaatatgttttcccagactgtagcttgtcttttttatcatcttcatagggtctctcacagagtaaaagtgtttaaccttgataagttttaactgataaggtccaatgtatctatttttctttgaatggactgtacctttggtatcatctaaaaactctttgctcagccctagatcccaaagattttgccatattttttttcctaaaagttttatgtttagcatttaactctgtgacctgttttttttaaaaaattcattaatttaaaaaaatcaatgaaaatttcttttttaaattgtatgttacgtttttatttatttttaattgtgataaaatatacttggcatgaaacttgccatgttaggcattcttgggtgtgcaccccagtggcatcaagcacactctcactgttgtgctgccatccccactttccatctccagaactttaccatcttcccaaacgaagactctgtccctgttaaacaaccacctcccatgtccccccgccccaccccagcccctggcacccacctttccactttctgtctctttgaatctgactgctctaggcgccccacataagaggcatcatatagtttttgtccttttgtgtctgtcttatttcagttagcgtaatgtctgaaaggttctgtgattgctttgaattaacttttctatgaggtgtaagtttaggtcaggtttcgtttttcagcctatttatgtgctaaatccgggaaccctccctagcctccactgtcaaggacggtggcctcgggacagtgccaaggaaagctgtaggattgttttagagctggagattctctcttctgtgggcatttaatcaatgagagactgagaccctgaactggaggggccccgccaaagccacacaccaagggagtggagaaacaagagctgcacctagggcctggctcctggctcagacctcccttccgctccctagagctggccagggtcggggagctgagctggatgagaggctgaggtagggaccaggaggtccatggtgggcttgagaaaagcttagtgggatgaccaggccagggtgtctgggcctagagaaaggagcccagactagaccagagaggaagctaccaaggatgggttggagggggaccagcccaggctggggcggagggtgcccacgaggcctgaggttttgccagttttctctgatgacacagcgagggcagagcccagccaggtcctgtcagtgatgccacagtgatagcagtggacagtacccggggaggaaggggatgagataagagaggccgcatgggtaggggcaggggcggcccttcccacagagactggaaacgtctgtgaccccagcttcatgcagcctggtccctggcatcccactttgctctgggctggtaagaccaccccacccccaacctggatggacgtgggcagccggggcaggccctgaggaggcgctgaacacccaggcctggaaggagtcaggtggctcagccatgagtggagcagcctcaggaaggtgtcaccatcctgcagtccctgaggactgggggtggtgtggttaggagggtggcaggcaggaccaggacccacgggatggaagaatatggggaaaaggcagctcaagtgagaaggaacttgctatcaggaagcaggatgcagtccctatcaaagcaggtggtacaggtggagggaaggttttcatttgctgggagaatatggacatgattctaatatcagcacttgaaatatatatactaatttaatccccacagtagtcttatgagatcaacattccctgttctctccgttttacaaataagaaaacggaagcacagagaggttaagaaagttgcttaatgccacacagctggcaggtgctgtgctgggatataaacccaagcagcctagctccagatccaggtcttaacctcaaactatcctaccaccctcaggagtcttggactcagatgcctttatccccacagtctcctgatcctgaaaccctgtgattccaagatgttaacctaagattcacagatgctctgatttgaggaatttggagactacagtcctcggcccctagaaggccccactatgtggtcatttgggttgtgggttatccaggcacgcacacgtgcatcctctcctactctggtcactgtggccttggggcagtccttgagccaccaccttctgcctgggagaggacacatcagggccagggaggaacccggttgtgagtgagaagaggggattctgtgtgccaccttggcaggtgaggggccccaggctgtcatgggggttcaggatgagactggacaaggagatggccagacagagacccacacctggtgcagggaccagggcacctcctgttttagcagagttctggacttgttcagcctgatgaacagcagtgggagagacttctcttctcctccgatccttccaggtagtcgtgagactcgcctcggtgtctctcagagcccagcctgggcctggcatactcttggtgacataaagtggcacacatcctaggccatgtcacaaacagccaccagagcaccacaggcagtagggctgggtgcatctgtccctgccttctcattcccaggagtgtacagggggcaggcaagaggcaggtgctccctgtgctgtgaggtgggctctggagtccactcctggctttgctgcttgctagctgtgtggccttggccatgttactctgcctctctgtgcctcagtttctccagggacacttaatagcgctatagagtattatgaagattacatgattaaaagaatttaaactgcttatagctgcactgtccaatatgatcacaagccacatagggctacttaaatttaaatgaattacaaataaataagattaaaaattctatttcacagtccatgtttcaagtgcttggtagccacctgtggctcgtggcttcctactagaccattccgtggtggcaggaaggtctgttggacatcactctcttagagtggcgggcacggagtaagggctgagacgttgactactaaggggcctgaaaatgtcttagctgcggtggaagctcatcctgtcacctccctggcctcctgccagcccaagggggtcccagatgctggccatctgatttatcttggaaggaattcccagtgtggctgctggccttgcagctgggaactcatttgaaactcacctgagatggggagggggcagcatggcgaggccctgagagccccctaagtgaggtagagtcaggggctcagttacaccacagtgagatcaagtcaaaagacgcacaccggggacaattgccgcctttgtcctcgggagggggattgggactcctgggtgttatcaaatctgccgggaagagggagggaggggagccaagtgatgggaggaaggtgggtgaggagaggggcaggagtggtcctagagggaaggagaaactaggtgttctggagggtctggcaccaggagttggcagctgtcacttttcctaatcctcaacacttgtgtcttttgaagagaaatccaggtgcacctgtgtccctaggaaggactccttgcctgacaaaggcacttctttaaattacctcctttcagtgtgcgttgagacactgtcaaggctgctcacagtggcaagcacttgctctcgctctgtcccaggtggggttctaggtgctttcctggggttactccgtttgattggcccgacatccttggggacccttggtaactccatttctcagatgggcagctgaggtctgggcagtgaacgtgagcagcatcccaggctcctggacaggagagctggactcagggtctcagggcctccccaggccatggtggggaagggacagattcccagccagctgggcatgggcagtgaggccagcactcagctgctcactgcaaggcactgtgtgcccctctcaaggcctgcccttccatgtgctggtcccatcccaagtgctctttgtaaatgatctcacagggaagggcctattgtcattcctgcttgacagatgaagaaaactgaaggcacagagcagttcagtggtgtgcttgaggttgaccaggtaaaaagcatctgagccagggttccctccagccatcccaactctgcaacccaagctctgttcatccttggtgcagcctcttcttagctctcaattgtgtgtgtgtgtatttttggacctagatggattggtagcattttgaaataataaagattccaacaaggccaggcacggtggctcccgcctataatcccagcactttgggaggccaagggtgggtggatcacctgagttcaggagtttgagaccagcctggccaacatggagaaacccatctctactaaaaatataaaagttagctggacaaggtggcgggcacctgtaatcccatctacttgggaggctgaggcagaagaatcaattgaacccaggaggcagaggttgcagtgagctgagattgcaccactgcactccagcctgggagacagagtgagactccatctcaggggaaaaaaaaaaaaagattccaacatgacattggtaaaacactttatgatttgcatgacctttttttttttcaacatcttttcctggccaagtctcacagctttcctccaggtgagcagtgtaattgtgcccgttttgcaggtgaggcagctgaggctctggttgggtactgctcagtcccccggaggtgttctctgctgggctgagagttttggatgggaggcaggtcaggagctcctggccagaccatgcggggaggtgtgaatgacctggatgtggaaagagctccgatcagagccccgactgtgccacttgtttgctgtgtgcccttgggcagtcacccttctcaagcctcagtttcctcattgaaaaaaaggcagtgaggatttgtacttgtcagagctgttgtgcagattgcatgagataatgcccctggagtgcctcgtcctacgctctcaggcatgatgagtgcttggaaagcagtcattgctgttatgaatatcattgttagtatcagtagtagtagtgattttaaagccacagtcaagttttaattcttacatcttattcctaaggactgttctagctctaaaactctgttttgtccattcgctggctgtagagtgtgctagcagactcaagagaaggagcggtccaggtcgccattgagattttttgctgcactgagcagggagggccacaggacaccaagccatggcaaggccacgctggtcctcctttatccaaaataggtgatgtccacctaggtctttcagtccttgtgagcagccacttccagagggggcctctgcccttgtcctttcagccccatgccacacatacccaagtacacaccacattccaggacctttaaagttgtccataaagtccagtctccagcccagacctgcctcccgaacacaagtcctgtgcatccagctgccatcctgcctccctgctccaggatgtctactggcccatgagcactcgtctaccacaacctaactcctgatctttctcccacaaacttgctggtgcctttgtctccatcccctggttcagtaaatagcatctgcatccttccagttgtgtaagccaaaccctggccctggccttggccatgacacttttctttctttcacaccccacatccaacatgtcagttctacctacaacatctgtccagagtctgtcaccaaataacttatacccccgagctcatgatccaagccaccagcctctcttccctacagtgacacaacagtcccctgccccagagtcctattcaccagcatctcttccctgacattgcacaattgtccccttgccccagggtcctatccaccagcatctcttccttgcagtggcacaacggtccccttaccccaggtttctacccaccagtatctcttccctgcagtagcaaaacaattcccttaccccagagtcctatccaccagcatctctcccctgcagtggcacgacagtccccttaccccagggtcttatccatcagcgtctcttccctgtaggaacacaccagcctactaacttgggcccctgcaggcttttcaaatgtcagttaaactctgcctccctcacttataatctcaccatggctcccatctcacccagagtagacacagaagccttcacggtggctcacaggcccctccctcacccctgtctccttccccttcgctctctctgtccccctgcagcggtctccctgtggctcctcacacacactgggtatgtccctgccccaggtcccttgcacttactgttccctctgcctggaatgctctccctgcagacacttaccctctcacctcctcaagtcttttctcaaatatcacctctcaaggaggcctttcctgaccaccatatttgaactcaccctccagtctgtctcgctgcttcctgttcccttccacgttttgtttttctgtgtagcactcatggccacctgatataatattggtactttgccaagtgatcccagtgtggctgggaaaagttagagtgcctgctgtagaaggcctcctgtgggaacggcacaggcccagacagaagcttccctcccaccttttcccctctgtgccttcgatatttgttccagtgggccagcagcacatgaatattttatacctgtacagcttttgtcttactccaggcactgttctaattacttcatacgcatgaattcctaaaattctcataagaactccatgagatcagcctggcattgtctcccttttacaaatgaggaaactgaggcacagagcggttcagcgactcgcccaaagtcatacagttgataagcaaagagccaggatatgaactcaggcagtccagctccagaggctgcattcttgctctacttcctctcttttgtgtattcatccacttattcattcattaagaatttatagagtgtcttctttgccttaggtgcgacgttttagagacgaacagatcactaaaaactggttcctgccatcaggaagcttagtctagtgggaaacgctgaacaagtaaataagggaaaaggaaaatcatattcattcagcaaccattcactgacgcctgagattatttcccagcctttaaaaagttagaggaggccagcccctggtgtattccctgattgtgttcatttctaagccagagagccgaatccctatatgccagctctgttttaggcactgaggtctgagataaataatataccatttttgaatttgagggggattacattctaatgacagaaggagaagagtgaattactgcatgtaaatatgacaacatgaactggatttggtagaggagtgtgtaggggactatgggaccccaggataggagctctaaccatttggggattggtttggatgagtgcatggctgagtggtaggatgaatggatggatatatagatggatggatggatgcatgcatgcatgcacaaatggatagatggatggatggatatttgctagatagatagtaatgggaaggctggttgaatgaatggaatatgaatgaatagatggatggatggttaaacggacagatcttagaagatggttggatggatgtttgggtagtaggatagatggatggctgaatgggtggatggatggatnnnnnnnnnnnnnnnnnnnntgaatagctatttggaaggatggttgggtgaatggatgagcaaaaagctgagctcactgctggaaagttggacattttccccagtgagatcaccagatcagctgaaagaaaggatggaaatccatgcattcgttcattcattcattcaacaaatatttattaagcacctatttatgcgtctggtactgttttaggctctgggattagacatggtacttgcctttatggagctgacattccgggggaagggagacaacaaacaaataatagaatatatatatggaatctgttgtcagagagttataaatgctatgatgaacaaacaaagcaggatgagagggcacagatgtcaggagcaggggcattttattttaggcgatcaggagaggcctcctggagaaggtaagttctgaacaggaagtgaggaaatgagccatctggggaattgcatttgagtcagagggaattgcaaggtcagagcccagaggcaaagaggccagtgtggctgtcagggaggagaggaggtcacagagagatgtgttagagagtggggagtgcagggccctgcttccctgtgagagaagggtttgtctgcatcttggaagcctgcggaggacattgaacccgggctgatcagcgttaggaagggcaccaccctccctgcacccctgcttgctggttcccagccctgctccctcctggctgcttggcagttgggaggctgtcagcattttaattacagatccacgctctcaatggtttacaactcaactgtaaaacaggccctgggcaacatgtggcacctctgagtgatttacttgctcaccatttctatatttagtgccatttaatgcttgttggccaagttttcagagagaaaaagaaggaggaatttggtggtagagtggggaaggggtcggttaagttttgtttgtttgtttttaaaacacacagatgtatttttcagttgttttctgagattatttcccaggctttaaaaagtcacagatggaccagctcctggtgtattccctgatagcgttcattgctaagccagagagctgaatcccttgcaaagttgcccttttcttcttaaaagctgtgtgcacttcctggtgagggttaggtttaaaggacgccatgggctgagggtatgactaagggccaaaggcatcaatgacttaatatttcacctgttacgggctgggcttcaggccatgtgctcccaccccctatctgggctcccctctgagacccccagcctcaggctcttcacagcttctcaaaattcacctggggaatgtgtggaaatgcagctcccggttccatgtgtgggtctggggcagggcctgagattctgcatttccgacaagtttccaggtgatgtggatggtgctggttggtccaggaaccacaccttgagcagcaaggatttcaaccagcactgtccagtagaaacataataccaaacacatgggtcatatgacatttgctagttgctacatcaaaaaggtaagaggtgacattaaatttaataagatattttatttcatctaagatatcccaaatatctatctgatattgattacatatcatttcaatatgtaatcaatatgcaaatactgagatactttttaatttttctgtaataagtctttaaagtctggcatttgtttcacactcatagcacatctcaattcagactagccacagttcaagcacccatattgctcatggctcccgttttggaggatgcagatctaaatccagcttgagtaccctggtgatagggagctcgctaccttctggaaagtccactccatacctacagaatccgagctgagagttgccctttgagactagctggggagacccagctttactctctgggtccctaagccagttggcattcttggtccagagcagtcctgcaaaactttgggggctccaaccaggtccccttgaagccctttcccagctccctcctgtgagtcgggtacctcccgttctctgcctgagccagccccaacagcagccctgagatggttttttaggtagttcataatctctgattttcttgttgaaggaccaggctcagagaggttaagtggtatcctgagggtgacccagccaacaggtggcagagctggggcttgaagaagggactttaaaacctcttcctctgctgtgggagtcttcagttccttccgcacaccgtggtttcagaggacctttcaggtccactgttgctcctgcacatgcaccagccagcaggcctacatggtgctgacagaacctcagagacagcaggagggtgaggacccgaagccgcacagctgagagagaaacccacgtccctctgggccctgggtctccactcctgcagcagctccttgtagctcagagcactgagaaattggttatttctcaaccatgccccccacctgctctgcccaggggaagaggccccaccgcaccctcagctgggaactgcagacgcatagagataaccggggtgtatttccatttgcccgactggaaaacctctacaccaccaaaggcaggaacagaatatctcagaggtgtctttgcacacacatccgggggctgttgcggggcagcgtggaaccttggttcaggccagtccagcctcttggacaccagctcctgcacgctggacgccaacacaggtcgggagaggccagagctgctcctcatgtctcagggagctcctgtctgggatgggaagttcatagggcttctttggtagctggccacctgggcagggccttgctggggcccaggcagctcagatggaggtggtcaagggcacagaggatgttcagccaggtgtgacccggctcctgggtccttcctccatgttccagagcatcgtcgcctgtgtccctgccccagagactttccgggatgcttcagccttgatcttctgtggactaagtcagggcctcttctacaataacccaccatgaaagaatggctatctagactcctgagcaaaggtgaattcattcattcattcattcattcattcattcactcacccagaaaatgcttgctgggtgtctcctgggaggcagacctcctctagatgctcccgaatacagcagatgggggctctgtgtttctggagctgacattcaggaggggaggggagagcaagcaagtcatcccaaagtacctcaggtggccggggggatgtgagacagggggatgtgagaggggctgatgcggggcactgtggagagggggccatccagggtggctttacgttgctgagccggagctgaggaactggaggaagggtgtcacaggcagaaggatcagctgctgtggagtcctggggcaggaatgggcttggtgtcgtcctggaatacctgacattttaagtgttcacagaagggttttggcggggctgagaggcagtgggtgccctggggcctcagaggacagggcagaggatggtgttctcatcagaggctaccacttggcctccggtaactgcccacacccccaaaaccagacacccccagtaatgccctgcagtgtgctgggctccagccaggaggagcaaggtccctggctctcagcactcagtctcatggcagttccatctaggcctcccttcaggtcccaacttgccttcctttcctacctggggctgccactgctgcaccaagcttctcttctgcacccacacccgctcccttggtttttccagccccagggcattgcactcctgctcaggcacaggtgatacccttccctcgaatttccagtggcgaactcctcttcatccttcaaaccccacaggtcacttcctccaactgctcatgggccccatggcagtacatacaggcctttattttggaccagtcttccttctaccggtctggttgtctccctgactatctgggcttttcttgaagacagagactttgtccaaccaccctcactttactggcacccagcacaggccctgcagtgggaggttccactggagggttcaggactgccagagtggatggaggacatgaccagggctctccacccctggccacatgtgagaatcctgagaagctttttaaaatagcagacacctggccacacctgagaccagtgaaatcctaacctctgggggtggggtccaggcatcagcagattctgaaaggctgggattctgcagatgactctgaagcagagcctggggagagcgtgcggatgctgctgtgcccatctggaggccagggctgagccctgcatgcccacacgagggccgacacccctgtcattgcacgagcagctgtgctccatggcccaagttcctagggacactggcccaatggggtctcttgtcttttttttttttttttttttaaaaaccagctttactgagatataattctcatgccatacaatccatcctcttagagtgtacaagtccaaggtttttagggtattcacagttgtgcaaccgtcaccacaatcaattttgaaacttctcagcacccctcaaagaaactctgtacctactagtagtcactcctcattccctctctcccagcccctggcagcaactcctctgctctctgtctctatggatttcctgttctggacattgcatacacctggaagcatacacgctgtggtcttttgtgtccagcatctttcactcagcataaagtcttcaaggttcatccatgttgcagcctgtgtcagtacttcattcctttttatggctgaataacgtttcattgtatggaaagacaacattgtgtttacgcattcatccattgatggacatttgagttgtttcatcttttggttattatgaataatgctgttattgacatttgtggacaagtttgtgtgtgagtgtgtttctggtgttagtgttcccccagcctcgtggggaggtcccatccctctttgaagtccaccatctttggggttgtccctgacagagcccaggtctctggccaagagagaagggtctgaactgatgtagggggcccgtgctctgggtcctctagctctgtgtcccattgctctgcatccccatgggggtggccagagccaggcaggccagcaggagctgaggacgctggctcagccctcatcagatgcacagtttgtagctgatttaccaccaaaggggttcacagtggttttgccctcggagctggccaggcgggtggtcctctggtttctgcgtgctttcccgttctctctctggttctacctgactgagcccccaccctgcttcttcctgcatcgcaggacctttctgctcaggtctctagtctgtcctctgcgtggacacctgagagagcttctccaatgccattccacatgtgctcctctgaccccagcgagaaccatcaggacaaagaccccgccggccctccagcctggcccactgccctccttcctgtttcctgactgctccctgcttccttctgccctcggcctttgcccatgctcttccctctgcctagcctgccctttcctccctttttgtctcgtcgactcctcttcaacgtctggttctcagctcaaggtcacttccttacctgatcactccagtcgctttctttcttactgctctcagtcattcatttgcaagtatttactgagcacccgctatgttcctggtctagctgctggggacacagcaggggatggacagaccgggtccttgcccctgggcagttgacatgctggagggagacatgataagcacaactaaaacgtgtgctgtgtcacatttgacgcaagctagggagcaaaacaagccggggcaggggcgggaaagaccagggcaaaagtcagggagagcctcatagggaaggtgagatttgagcaaaggctagaagcactgaggaagggagccatgtggagagtggggaagagtaccccaaggcagaagggcagcaggtgcaaaggcccagaggcaggagcatgcctggggtgctggaggaacagcaaggaacccactgtgaccagcatggagtgaatgagggcataggagatgaagtcaaagaggagatgaagtcaaagaggcagcaggggatgcctggaggacagagggaaagaacagtaaaaggagccccgtacacccgactcccagcacgcacccaacccacagcgtgcacctgacccacagcgtgcccctgacctccagtgtgcacccgacccccagcatcagcagccccagcttgtggtccaagtcctctacctcgttttctctcctcagctccccacaactggaagggtttaaggaaaaccctagacagcttgttatttcacccacacatgactgtgtatctccaatcaatagggacttctaaaaaaaaaccatggtgccattatcaccctgagcaaaataaacaattgctcagtgctgtctaataccctgcctgattcagatttctcaaattgttttaaaaacattttccagccaggctgtgggggaaacttctgggagctgtgaccacaggaacgggagcaagtttgcgctttccttcagggccaccattggtggaagctggtatcagccttatgcccgtgtgacagttgacagcacagccacctccccctccagagcttaagcttcaagggagtcaggggcttgcctctttctgcccacctggccaccaacctcagcgcctggccagggaagggattaagttagcgtgtggtggaaaggtgaatgagtggatgaatgaataagtgaatgtatgactgactgccaaggccatttcagggtgctccagcagttgggagaagcacataggttcagtggctccatgtccccgctgtcagcctccctgcccctcacgctgtggttggggttacccaattgcctcaccccaggtcacaggccacagtccccactaacctagactctgggacaggcctgcccaaggcaacccctgccccgtagtcaacctagcagcctgcagggaggtcacttatgagagagaggcacccagaatgcatctaggagaggctgcactgtgtggtgctgcactgtgtggggctcgactattccacctccaaatgggtttgctactttaaatgccccagtttacaggggagcaaagctgagacctggccccaggccccccatgccagtgtgcagtgggtccatctgctagccaccaccatatgggctcccttcatgtttgagggtgtgtgtgtgtgcgcttgtgtgccgggaagtatgtgggcaggactgtgtgtgaagggctatctgtgcatatgttgtgtagggatggacggcatgagaagcacctgtgtgtgagcatatgtgtcatgcatacctgtgagggagtgtgtgagtgtgcgcacaggcgtaagagtgtgtgctttgagtgtgctgatgagtgtgagggtgtgagcctgtggggggttgcatggggccatgcctggggaggttgtgtatgtgtgagcacatggtgggatgtgactgtgtgcaggccacacaggttactgggggggtaggagcctagaaagagatgaatctggggtgaggggctgtgtgtccacagttctcgggctcctaagataccccaaagttgggcagagaccagttcatggagggtcttgaaagccaggcagaggaatctgggctttaacctcaggagccatagacagcatctaagcagttgtaacctggcaaacactgagtttcagaaggcccccagtatagaccagaaaacctctctctggcttgagtggaaacctctcttcctgtacctcccaggctgcattccaggggccctgtcctatggggtgcaccttttccctgccatcccctccatgtcaggcaggaatatttgcttgaagtcagtgcatccagaatgacttaaagaatgcaccaaaaagaaaatacctcaaatgtttacagaaaaaaaaaaaagccattttttctgctctttcatctgagtcgcccagaggtatacagctgcagctggctgaaatgcagctttctgctaagatggatcgacatggggagggagaggaggagcaggaggagactgagaaggaggaggaagagcaggagaaagagtaggaggagcctgaggagggggaggaggaggaagagcaggagaagcttgggaagaaggagaagcttgagaaagaggaggagcctgtgagaaggaagagtgggaggagcctgtagaggaggaggagtgggaggagcctgtggaggatgaggagcagaaggaggaagagtaggagaagcttgggaagaaggagaagcctgtagaggaggaggagcctgcagaggaagaggaggagcaggaggatgggagcaagaggaggaggagggggagaaggaggagcatgaagagcaagagaaggagaaggaggagcaggaggaagagcaggaggatcttgaggaggaggagggggagcaggaggagcctgaggaggaggaagagggggaggaggaggaggaatatcatcaggagcaggagaagcaggagcaggaacaggaggggagcaggtggtggcagctctggatgggagcctgtagcacctatcctggtgtgggtatccacacttattgtctcccggggttgggggtccaaggctgcctgcccgctgacctccacgttgtctttattcagtgccttggaaagggtccctggtttggacatttgcaagcaggacaggtcctgggcgggactctggggagatacacctataaggcagtgaggaaggcagccctgggcatcgagagaagttggccagtgatgcagcagccacagggacttatgctggtcccatgagaaacctggagctgggttagccccatggaggcagggagatgggcctttgtacccagcaccaaccagtctttggctggggggctgcccagggagggggagtggtcttgggtgagacagctcccatcaggggagggcagtgcctagggaggaactcagctgctagccatcagcagcaacactcccagcagctgcagagggagtgtctggtcctgaaggacagatcccagtggcatgcgacagtgtccactacacaagccagcccaagtgaccatcaccgagggagcaaggccatcctagcccacccaccttccttctgttcggccacattacagctctacagccagattgctggactccaataccagttccatgcttcctgactgtgtgactgtggtccgcactgccaccccttgtctccccagtctgctcatctgtgaaatgggctgatgatggtcaaccttcctcataaggtttctgtgtgcattcgtgtcaggcactggacaccgcagctacctcggaggcagcggcttttattagaggtgggcatggatcctgcccttgtgccgctcagtctgctgagaggtttgggcatacacgtaggaagaagtgacactgagcagcttgggcttgaggccggcattgagccctaggccgagaaattgtcctcactctgatcctgacaccaacaccaacatttcctgcagagccttgaacaatggcacaatcctacataatcacagtagtgattatgagcgcctccttcccctggaactccaccttcggtcatttaacccagctgctgcatcaccaggtgtgttccattgagcccatgtcatgaggagacaaagctggagctcaaggagggactcacttacccagtgtgcccaccagagtctgggagatggcgtagtcaggggtgacagaggcaagtttaggtaaaggatgactacagggatgtgggcaggatttaaggaatcctaaaaaggccttagggctggcaacactggggagctctgtctgccctggagggcagtgttagtagagaaagtgtggcttggggaaaaggggcctcctggcaggcgctgtggttctaggcagagggagacagtcacagccaccatgtggtccatggacagggagtccagggtgtaaaagtcctgcctgtatcttctcctgccctccagtccctgtgggatcacccactgggaagctggagggcaaggagggacacagctcagcctcccagggtagagcaggggtgagcagcagccagggacaccttctgccacacacagaggatgatggacccgtgtttcacttggttggtgcagggtgggtgcttggagacaagaaacatgaacagatggggcatggggcacaggagaggaagccagcggaacttggtgaccatctcctgcctcaagtctctggagtctgacccaggcatggctttctgtgaaaactaagccatcagccctccagcctgaggttgaggggcctccacatccagcaaagctcccacctgctttctgtccatctttttgaccggggcccacctttaccatgtgatcagctggcttggatctttttggagaaggttcaggaacgagcctcctgcttgggggagggtggctggggtctgagcatgggagatagcagtaccagcaatgtggatgggagaagacgctgcggggaccaggagcacattgtgtgaggggagaacaaaggcagccattgcaggggctgcttaaagatgccctggggttgccatgccaggcagcagcagcacagacatgcttccagcgctgggagggtgtttgcaataggacaggggttctggggtgagttgacctgggtgttggagaaggcaggagaaaggatgaagggctggggcttcaacagcagggctcccaggaactcctaatgacctctgggggaaatggtcacttcctctcatctctgcacctgctgcactgcacagaaatgggctttcactccagggacttctgggagagtgtggacaacttcagccaacctgcttctctcctccccctgccctccttgtctccctctgtccccgtcttttctctccgagatccccctgtgttgccttcattggtaaggaaaactgagactcagagaaggaaagggactcgcctgcaggcacatagcagtgtacagacagaagcaggacctccatccgatggctccttccgccccacagcgccgctctccctgccctgcccttctagccctgtgcgcactcatcccagcatccactgctcaaaatgagaaaagttcccacaggctgggcgccagttctgtgagatacctggtgccaggccgcaaagagccttctcctatttaatccccactgttccctttgagaggacttgtccctactttacaacgaggaacaaatctcttaggatgcatttggttgcaagtaacagaatgccttactagtaccaaaagtggttttgatgataggagtttgtttttttcctgcaaaataaaaatctggatatggtttctttcagaagctcaacagtcttttcttgggccccagctcttttcacccttccattctgccattgtcaccttgtcagcctcataggtcttgcctaatggtcacaagatgactgcctaagctccaggaatcacattcttacaccacagcatccaaagatagaaagggagaagttgcttttccgggtctctgtttttttcaggcgatgtgttatgctttcggcctccgtggtcagaggtaggccagcagcaatgaggaaatggagagccagagagtgtgccatgttcccttgggccatttctgccatcaccagcatgtggtggcagggatgggatttgaactgagcttcttgggtgacctgactctgccacagtgcctgcccttctgcttcaggctgcctttggccacatcatactttcgtggagactgattctggttgcccaggtcactgcttataacctgaggtacaagtagtccagaactgaccactccctgcagaggagccaggctggccaacctcagaggggtttcagaggggaggaagcagcagatactcaacgagcccagagtctcgagctccagccctcgaggtcctggccttccaaaggcctttttaggcaaaccagtccttggctccccagacctgcgccatgccatgtgtggcttaaaacccatcaacttggggctggctatctgttttacaaagggcacctccaccacccagatgaaaggatttctgttgcagttagggtactttaagttgtaatgggtagaaacccaactcaagcttgcttaagagcaaagggtattcattagttcctggaacacagtggtcttgggttgatgaattcaggtctggcttgatccagggtgcaaatgatattcccaggacccagctgcatgcaccccttccttgccccctctctatttctcagctctgctttcctagttgatgccatcctctggccccatgtggttgcacgatgcctgtccacagctctggcccctgcattccctcctgttcgtatctggtgggagataaccaacagctcttgtcttctgtgtgcgcagaatccccaggactcacttcagtttggccctgactggtctgagtcacccatccttagcaatgaccagtggggctacttcagtttcgggggctaggaaaggcctcattgaggactctctgtttgcaaagctccaaggtctcactgggcttgctagaaaacaaggcaccaagataaggactggggttgggtggggctgggacaggtggctctgtggaggaggtggcactgtggagggctgtagaaggctgggttgggctgggcctgcggagatgaatgggggcacattcctggagtagggcagcgcaggatcgatcctggagcgcccagtgcttcagagtgcctgccatgggtgctgggggcagggatgacagcaagcagtgtgttcaacgctgggaagcctttggtttttaaaattcgatgcccctcagaatgctatggagggtggcagacacttccagtcataggagcaccatgtggcatggaccctgtgggagccagaggttgctgtctgatgtcccctcccaaggatccttccttcttccaggaagttcacccctaggtcccctgggcagcccgagggtctgggacaggcccagaagcaccaaattcgatagtatctatttggcattatgaatcaaggaattttctggagccaagtttctccccagtcccctcccaggcctgagaaccccaccctgagtaattccgggctctgggcagcacctggtacattgttggcacttcctgggggacctgtcaaaaagagattgatttttctccctccagtggtgcagaaaatccttcctgctgctccagacaggtttggggcatggctggcaggcagaggaggctctggattgcagccccacccaacctggtgcaggagtcccctttacagaccccagctgctgcttacatacattccaggacagggagctcattacctcaccagcaaccctcttgaaccctggtgagctttgttggggaggttgccctctgactgagcaggaatctactgctctctgactcctgccaacaactggggtcccagctctgtgctctgggacacagtccttcctgctcactctgtcctgggtcaggcctgcagaccctgtggagtagtgactagggatcccagaaactaccttctccaggctgagcagctccagctcattcactgtgggtcctccagccctctcctctagacatgctctgtttctttccatctgctgaggcatagtccagttctgaaaactgtataggaagaccatccccttctttattgtgggcattaggccttagttaatatggccccagagtgttggcttttcagtagcctcctagctcatattgaacttgtggtcaatttcaatctttctcagtctctcccatactgtgattttgcaatcaattttttagatatcaaaaattgtagatgtttagccctcttctggctggtttcagccactgttttattctgtggaagggactgaagtctgcctggccctgcactcacattatcctctgtagatgcctgagctgactggagtcagatttcggtagcaccaaaagacccttttactccccagattcccctctttctggccactcaccatgcctgaaatgtcctcattatgtgctcaacatgtgctcttccttaagcctgctccctctttcagttctctgtgtctgtttcccaatctgaaatgccttttccccatctacctgagtttggccagttctaatttatccctcccgttatctgactccagctcagccctggccttcttgggggaggcttccttgagatgcacacaggagcatctcacgggttcaagtttccttctctgttgctttcactccttcatagcacttaccaatgtatgattagattcaggggaattattaattccacagttacttctggtttggaatcacaagctcagaggtggcaaggactgcaaactcagggaaggtggggaccggaagctcagagaaaaccggagcagcacctccttgtgtcatagtcttcctgggaactccccagcaggggtgacgccaaataccacacagtaggtcctcactgtgaaacaggtgcatgagtgaaagcctacgtggacagacatgccctaggtcctgttccccttgcaaacaccgggcagcaccgcttgcacacaaggctcttcatcagaggcgggggatttcaaggtgaatgacctggcccgaggagtgtggccggtggggttctctggaagcagaggctgagatggagtttccggtcccagctatttattggggatctgtataaaggaataaaggggaagaggaggagcaggcttgggcagatagaggactcacacttggatgctggcccagcaaagccttgatggggagcactggactcggtcctgcccattatgttggactgcctctggctaaaatggccagacctttatacccttgcctctcttggtccccagatgcagggccccacaccctgaaggatctgacagctggaggctatgcactaatcacactcccaggccagtggtgtgttggaacccactcctatgggctggaagacccgctactaaatattcaggatttgtcaattgttaaactgctggtagcttaaagtcagccatggtgggaacatttaatttattcctcagaaattgggaaacactacgtaacagggctttttgttttttctttcgagagccagtttgagcaacataccactacatgtagctatgaagcaagtcctcccttggagggcaattggcctgggggaatgctgacgtataggcaggtcatcacagtgctaaggagacaaggactctaacagcacaggccagccatggaaaccatgagggagtcactgtctatcctgacaatcagggaaggctttgtgaggagctgacttttttcctgacatggcagaatattcaaacactacaaaagacaatcccatgaaaagtaagactcctgtttgtccagctggtcccctggcactggtgtcctccccagagacagctgctcttaccaattcccctcatgtaattccagaaataccctgtgctcttacaagcatacatggatgagtcttctttctcatacaaacaagctcccaagctgcaagcctttctacaccttgctttgctctcttaaccacggaccttgcacagtgtccttggttagtgagtaagagccatttcattctctttagcagctatagggcattccaactcatagatgtgccgtaatttacataaccagtccccactggtggatcttcagattcttttggcctttggatatttcagataaggtccctgtgaggctctttgacatcttgcacaagcacaagcctccccgcagggtacatattcagtagtggaattgttgggccatcgtctgtcatggtgataaagattggccttccagataaggaacagcatgtgcagggccaagaggcatggaaggggtgagcttgctcaagcggaggcagctgctgcggagagagcatgggcctgggggccaggagggtggggctcggctcggccctgctgcagaggagccaggtgtatccactgtggtcatggctggatgccacaggcacattcagactggggaattaaggagagtttagaaagagaccactgtccaatgaccgatggatgcgtggataaaatgtggcatacctgtaccatggagtgttattcagccatgaaaaggaaaagaattgtaacacatgctacaacatgcacagaccctgaaaactttatgctgagtgaaggaagctagagacgcaaaatgccacatactatgtgattccatttatagaatagatctgtctagaacagacagatctacaaagacagcaggtagattagcggctgcctgggcctgggacaaggggaaatggggaatgactgcaatgggtatggagtttcttttgtggggtgactaaaatgttccagaattagattgtaatgatagtggtacaattctgaatatactaaaaaccattgaattgtacacttttgatgggagaattgtgtggtatgtgaattgtactgcagtaaagctgttttaaaaaagaaagagtttgctaataaaaggacaaaagtaaaggaattcaaagagttggtgcagcaccctggggctggctacactggggagtggttactccttacgcctgaagacaggggaggctgagctgctagaatccgggggctgtatagagaggacttcccagcaggagctgtgacctttgatagggttgtgcagacatcctgaagggcccagcagggagcaaccagggggaataactcccagaactttcctcctgccctccgatttcctgccagtgccttccacaggccaaaccatctggaagggcctactgaggccagacaccagattcacagatttacttcctcatttatttttctcatatattgtgatatctcagcatcacaagatggcaaaatggcaaactctagcagtttcatgcagctggtctttaacctgcaacccagtggtgcagccactaatataaaatactgacattctgccagctgctccaagccccttgattgtcccccacctttgccatggcttttccttgaatcctctcaacttcacctatatccagcaatggagggttgatgcctggctagcttggcagggcctgtgggaccctgaacattcaactgacaattgctcgggcctggggcatactgcttgtggagtgatttgaatgcacccccttggtgaattaccttctggcattttctgcgcaccggctgtatgccaggcactgggaagctgcatggagccgtgtcatcttagagcctgagcctgaaagccctcagacctcctgacactgaagcacagagcccaggctcttcaagtggggaggtgagctcataagtcccctcgggcagctcagaagcctggcctcaagcagtagggtgcagagtgcagctttgtccctcacacacttcctctgctattgtcccctgcctcggggagagggctgggtgcccatctggtgaccagccctggccaggcagctgtgattatgcctggcttaatgtggacagaatgcagtcactgcatctctcaaaatgcagagtgtgcagggctagcaggctggatgtcacctgatcggagcccattcaataccaccatggcgtcaggccatcagtggcttcagaagaacagggaggccacattcaggggaccaagaggggcagaaggagcagtgacccccatccaggacacaggagccattttctgcactagggccattgcttagggcccaccacggtagtagccctcagtatcacacacatggaaatacatgcaagccttggtattgctttcccacaaaaaccttccaggggcttcccattgccttttttaagaaaacaactttactgaggtataattcacatgccatacagtgtcaccacttaaagtatgcaattcaatggcttttaatatatattcacagatatgtgcaaccatcaccacaatgaattttacattattttcatcacctcagaaagaaacccgtacccattagccaccactccccatttcccttcttctctgcaaccattaatctcccatgtgtcattatggatctgcctattctaggcattgcatgtaaacggaatcacacgatatgtggccttttgcatctggctactttcacttagcatataatgttttcaaggctcatccatgttgtagcgtgtatcagtacttcattcctttttatggctgaataacattccactgtatacctcattttgcttatccattaatagttgagggagttattccgctcactttttggctgttatgaataatgctgctatgagcaatcatgtactcattttattgtggacatgttttcatttctcttgggcatacgcctaggggtggaattgttgagtcacacattctgtgtctaacattctgaggagctgccagactgttttccagagtggctgcctcctttcagatgcccaccagcagtgcaagagggttctgatggctccacaccctcgccgacacttgttattgtcttagcctcctagtgagtgtaaaggagcatgtcgttgtggttttgatttgcctttccctggggaccagtgctgctgaacatcttctcatgtgcttgttggccattgattgtatccattgcatttttataaattgagatattgcttatgtgaaaaaagtacacaaagcatccctgttcacttaaaagaatagttacaaagcatgatccatgtaaccataaaccatatcaaggagcagaatattgccaggacccccagaagacagctgggtgcccctggccaaccacagcccctccccgccctgggaataaccttgtcttgatattggtggatgggctcctaaacaatactatccagttttgtctgcctttgaccttgatccaaatgaaatcactctgtggaaatcatttctggcttgcttctgtccctccacactgtgtttctgagttagtccctgtcagtgtggcttgctagagctgttcattgtcattgccctattgtgttccactgaaatgcacacgctgtggtttatccactcactatggatggtcatctggatggtgcccaggtcagagcgattatgaacattgctgtgtggacattcttgaacctgtttcctttgcacacacagtgtgattctctagggtatgtgtcttggaaatggaaggtctgagtcataggcatgtgcatcctcagccttagtagatactggaaaacgggtttctaacatacgtgtaccaggttggcatgcctccagcagtgtctgagggctccaggtgctccatatgcttgccaacactcagtattgtcagaatccattttgagcatcccccaggtatctctgtcaaagcctccagctcaactgggcctgagtgcatcagaaacacctgcctcactctgcccccaattgtgtcatcacacctccaagcctttgctctttctcctgcttcttaagccaaggcagtaaggcaggctggagatttgggaactatcccctcactgacaacctgtgttggggatatctgtgttgttttggggacacagatttgtgggacgcagcctgcatttgaaggggctgctcatccagcatgggctgcgtgtgggggggtcctgggagactgctgcctacaggaggtactctgtgatgccaggtgttctggaaccagagccttcaaccagccagtcctgttcctgaacactttggatgcctgtggcatcactggctcatttgattgcagatactgaggttgaaatgtggtggctctccctccctggtggttctgttgaccaaacactggtcacctctcctggaaggagagctcttagggctaggaggaccctgaacatggacccaattctcagagtcagggacttaatcttgtcacctcagtatccccagcatcttgaacgggcccagggccagaggcaagactagcgagttttttgaatgtctcattctcttccagcaccctgattttctcagaaaagctggaattgtcttcactatatgttagagttaaggaaactgagacctggagaagaagcatcacatgggaactaagtggccagcaggcactcagttcgcccctcagctccaagccccttgcctcagaatgtctcacagaccagctctgagacttagtttagcctcaaggcttttttttttttttctgtaaaaaggagtcaatcatactagcttcatggaattaataagatgccatacataaaagcatgggcccagtgtgtgtgcagggggttaataaatgtccactcacttaccccttcctccattcattctttcatgatataacaagcaaaagcaatttgacagtctgaatgaaggagaataaaaatgctcacacatggtgaaccagcaactgtgctcacttgggaaatccccatctctgtgcctgtacacagtaggagctcaattcatgacttaggatggtggaggaagggagagaagctttagtcccaaagatatttctttatagttgaaaaaggaagaaaggggtggagggaggaaggaaggaagaaaagtgagagaaagaaataaaaacaattttttaaagtacactgaaaataacctgaatatgctgtactctgggtgttgggtaaaatgttgccttctcttattgctaggctattctaaaacaaaggtaagcaaaatatggctcatggcccaactccagtccactgtctttgtaggtgaataaagtttaaatgaaaaacatctgccattcaattcttgaacttcatataaatggaatcataaagtatgtcctctttggtgtccaacttctttccctcaacattacctcttaaagatccattctttgtgcatgtgtgagcaattcattctttctccttgctgtatagtattgcattgtatgagtacagttaggcactatcgttatcccccttctacatatggggaaactgctgcacagagggctgaagtggcttgcacagcacaaaggctggaatgagagggcctagaatccaggtctgagtttcctacaccagaaagaaaaaactaaagccagacccagataggtggggcaggggtggggggcgggggggagctgggggctgcacttggccttggcgtgcagtgacctgtgctgtgctcttccccgccctcccctgcagatcctggaggagaacatgaagctggaatgtaagtgccacggcgtgtcaggctcgtgcaccaccaagacgtgctggaccacactgccacagtttcgggagctgggctacgtgctcaaggacaagtacaacgaggccgttcacgtggagcctgtgcgtgccagccgcaacaagcggcccaccttcctgaagatcaagaagccactgtcgtaccgcaagcccatggacacggacctggtgtacatcgagaagtcgcccaactactgcgaggaggacccggtgaccggcagtgtgggcacccagggccgcgcctgcaacaagacggctccccaggccagcggctgtgacctcatgtgctgtgggcgtggctacaacacccaccagtacgcccgcgtgtggcagtgcaactgtaagttccactggtgctgctatgtcaagtgcaacacgtgcagcgagcgcacggagatgtacacgtgcaagtgagccccgtgtgcacaccaccctcccgctgcaagtcagattgctgggaggactggaccgtttccaagctgcgggctccctggcaggatgctgagcttgtcttttctgctgaggagggtacttttcctgggtttcctgcaggcatccgtgggggaaaaaaaatctctcagagccctcaactattctgttccacacccaatgctgctccaccctcccccagacacagcccaggtccctccgcggctggagcgaagccttctgcagcaggaactctggacccctgggcctcatcacagcaatatttaacaatttattctgataaaaataatattaatttatttaattaaaaagaattcttccacctcgtcgggatccgttttctgcaatcaaagtggactgcttgctttcctagcaggatgattttgttgctaggacaaggagccgtgtagaagtgtacataactattctttatgcagatatttctactagctgattttgcaggtacccaccttgcagcactagatgtttaagtacaagaggagacatcttttatgcatatatagatatacacacacacatttttttttttttttttgctgtttgctgctacttatccagaaatttaagctggtccagatttggagacgttttttccagagtatgttttccatccttttgccctccccagttcaaacttcaccattagaaaaatccagtttggaataaatagagaggaaaaataataaattcccagcagtttccatctttcggaaagtgagccaccggataagagagaatattttgtaagagactatttttatatgaatattttatttatatcgagtctactgtatcattccacggcctgtgcttcttcttaattctggtactcacttaggggtaaggaggggcgatgcctggttgtggcgtcaggccccatggggccccttgcacagctggattcttgagttctgtttgccaagtgggcacaagctgcccctggatgcctggggttgaggcatcatctcatccatgttagccgggaaagaaatcaaatccccagcctcagcctgttaagctcaggcctttcaagcagggccactgagtggtagcttcgaaatgagtcactgtggtgggtggtcatcgtgcccctcacagggacttgaccgtcatcctgcagcagaggccagttcagggagccccacacctcaccaagacactagccattgcctgcgtgtcctggaaggtgagatgtagtcctcaggtgaggtgacccaaagcagatggggtgaggggccgatgagcagccgggcccagcggggcttcctggatatcctgctcccaaggccaagcagcagagagaggttcaagtgaggccactttgctttgggtccagctacacccagagcctcagcctagaaagctgtcctccagcaggctgggggtgttctaatatgtgtccgtttgcatttccggtgtgtgtgtgtgtgtgtgtgtgtgtgtgtgtgtgtgtgtgtgtgtgtactgtatcttcttagggacttgagtgtagtcacgtgactttgcgccttgcagcgcctccgccgtactcgtgtgtgtatgtgtctgtgtgtttccgtgctacccaagcgtctgtttctctccgtgtgcctgggagatcaggtctcaggcatggagctgcatgcctttgcatctgctgctccccagagtctctgcttgcatgtgagggctggtggtatgaggcagacagcagagattgtgtgtgattgtgttgaaccgccaagagaaggcacctctgaactctgtccccacacccatgggtgaaaaccagacacctctgagaccacagcacagccccatggccccacctgctgggagcccttcagtatctaggctgtgtctgactcctcagtgtccacactgagcctggatcacagcatgggcaaataaaagtgactggatggttgcatggtttcttcccttggacatttttttccatttttcttttacttgggtgtctggaggagtgggcatgtgaaggggccatggagtgaatggatggagggatggatgaatgtgtgagtaggtaggtaggtgaatgggtagatgtgtggatggataagtaggtgggtgggtgaatggataaatggatggatgggtagatggatggatgaagggataaacagatgggtggatggattgataagtgagcggatgaatggatgaatagctaggaaagtgggtgggtggatgagggtgggttgatgaggtaggtacacctacagataggtaagtgagcagtttcttgggagtccacaggtcacattttatctttgctttggaaaacctagcagatctgccatgat

SEQ ID NO: 14582 - DNA, 62311 bp, Human
  misc_feature (1)...(62311): n = A,T,C or G
tatctttaaaaaggagggttggttccctaaaagaaccctaattcataattttaaaaaattcctatatgtttggaattgtggtctcggcataaaatgatgatcaactgaaaaaagatgaataacttccagtgaattcaataaccatggatgaggggaaaaaagcagcatgaatacatgctgtattctcctttatttagaaaaagcacacaaaaatacagcagagttgatgtgtttgtcaccagggcttgaaagtcgaatcaaccactgtgtaaaagataaaataagactgcacggatatcaggattttcccagcgtgctttattcatagccatctgacacaacaggacctaacagagcttttaggaaaaactgaattctcagcccacaatcactttccaggaacttccctgcaaacagtgctgtgcgctggcaggatggaaatcttagcaatctccctcctgcttccatagtttcctcctctctaaataaaattatttatggggacttaatgagagagcaagccttgtgtgaaaggaattcaagaaagtgcggcttctaaaaatacacctaggcagctctacagtccttattgttacaacctgacgttttgcagttcatgccatgaacctaactacacttcttgccaaatacacacaagcgtacaaagaagaggaaaagtaaaaactatgttactatgttttatctttctgcaatccctttgagtaaacagtagtaattttctgttgacatactcaatgcaaatttcccaaaggctacacaatacaaaacaaaagacctgttagcttcctcagagctggggggaggagaggcagggggagagaaataaagttgatggagctccagtttctcctaagcctgcagtcctgagcctccagtcaccctagtctttttgtagagattttttgagtttcagtctccacttgggaaggttccttggccccttctctcccaatgtcaataaaaccctcatctctcccgctttgcccccagctttttggggaaattggaccttgcctaggcgtcttgttccagtgggttgaaaagtacagctggtgatgtgaggataaatatttaaactaatgggctgggtcacagcgtgggggtcttcaagagagggcctcctcctccttccgccacgtgctcctcacttggggtgcagggctcctggacaaggggctaagacggacgagggtgggatgaaggggagatggacagaccagactgtaagtgaaggaggccctctaggaaacatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttctcttccttcccttggccccgcgcgctcgctcgctcgctcctcgcctcgctctcccctttaaacgcccacttcgtatggggaaagaggacaacttgaagtcaagttgcaattaacttccgcggcagccgcagctccggcggcggcggcggcggcaggagaggcagaagccgccgcctcggaagtccgacgccggcgcgcccgcccggggagccgttcttggtttcaggcccgcactcgacagccaccgccgcccccaacgtccatgcctgagtgagttctgctcttttgcctcccttttccccttgctactcttgctgttttatctctgtccctctttttccggaatcaatccaaacttctccgtagcacccactcctcgtcccctattggggcggctgggctcccctctcgtgggcgcagggcttcaacggtcttccgagccccttttctcacgcagacggaccttggaggggtgggctggtagagtaggggagagcggtcgggatgggggatttgaagatgccattcgttttctgtctgggtgtggacacaccaccacacctgcccaatagaccctggctgaacaaactccttcaggtcaccggtatggccccttttagaaaaggaaaggggagtggaaaagaccgaaggaagcaaatggggaaaaggggagcctctcggtgcgttctggagccgggcgggcagtaaggtgcctggaggagtgggctgcgggagtggtaatgttcccccaccggatcgcgagtctgctcagcatcctttcccggtccatctccgcctccctccgctccctgcctgcgcggctgattgtaagcatcggcgaagaggggcctgggaagtttgtggcaacttctgcatcccgggagctactcgggcgccggggcgctcaagttggagcccggagtttgaaagccgcggcactcctcatttcgagccctcgctggctgtagcgaggccggtcctggagaggctgctggcgtgaatgtgggtttggagttgggcaagaggcagaagaaagggccgtcctcttagcaggggccgggacatcacaggtgcagcctcgcagtccacaccgtgtttccctcctgctgtccagacccgagcgcggtggccttttcctattgctccagtgctaaggctcccgggccggcagaaccggggtttgggaaaccacgacgagaaggacgaagcaggcaggtggcaggtccggggagtgccacgtgcttactggggaaacgcagtttcctcttgggatgacctcagaagaccaacaggggaaaggggcatagggatctccttgaaagttttggccttggcctccactgaggtgttgcaaatttcactaacaaatgtcaaccacagggtcctctctcaaagtgtcctggttggcaactttgacctctgcgcccttccttggcgaactttctcagtggcattccggacttacaagcaaatgttctaagacttggactccacatggttataaaagagacagggaaaacagaaggatgccctattccccagagagaaccttactgctctgactgactgggtttccatgtttgcatccttggaggccaggggacctgactttctcaagggggtggcgggtagggtaagaatgagtaaaatgttaccgctcggtgtcaggttttgtcctaagcaatctgaaatttacggtgtttgtactgctgacagagtaactcatcccgttgaaacttagttgaaatttacactctatccaaagtggatttttctgagatgtcaggaatgtgagatttattctgtggtcaaatgtagctgcaaaaatcaaaaacaaaaacccatactttaagtctgaagaaaaccaaggttgaggtgtttgctctaaaaacctctcatctcctgtatggtactactgctatgatttagcagtagtcctctatttctattgcatattattttcttagaacagtagtacattcatatactggctgctccagtctgctggcaaacattagcattcaagcttacatttttgacaaatgtgcagacaggaatagcatgaataggcatcttaaatattaacaacctaagcatctgttgtgaaacaaatttaatatatttactctgtttttctcacattgttagaaaaggttataataagtgcataatttcaactttagttagcagaagtaactggctgtatctttcactacctctccaagtgtttattacacaatcatcagacataaatactttaattaacttggttaagcacattattaaatacactgtagacaatgtgtatactatataaaatgtaacagtagcaaactatgtattctatttgtacacgttttaaatgactatgcattttataaatataccaaatatgtttattcttcatcttcatttgacacttactacttcatagttttttctaatgaaaacaatattttaaatgtagagttgttcagtcataggtaatacataatatttaaacagtagctataaaatacaaggcattgtcaaatttggataatgctacatctaacattatacaagagaaataaaattacaattcaattttgtatttatttctgaataatgaatataaataatatatgaaaaaataacgaatagggatttccctcctaaagtactacctccttaaaatttggtgggagggcaggatggggggcggggggaagatagagaaagaagacctaaataacttccaaaagtctgaatagttatttccagaatcaatgcattcctcactttcccacaagctgaaatatgtaataaataatagttctttgtatgtaaaagtattcaaaaggaatgttttttgttcagatttgtaagaaattaatatattctttggttgataatctacaaaagtagttcttttgtctcccagcatcttaagaacgacaacaaaatgaatattggtttatttctgcaaagaaatctgttgccagctatatgaacctgtgattaaataagacatgatatgctgagtgatggtaaagaaatactacattaacttagtaaagactaaaatatctggaggagaatttttagttctttttcatatgacaggttgtggattgtaaattaggcctaaaaggtcaggtgacaggcacctgttcctcattattgtaaaaatattttggttacaaacactgttaagctaaacacaacatggatatacagcagggactctataaagcactctagtgggttttcatctgttctgtaaatttccaaaagggctatacatagatatgccctttacacacatagtttcttccatacatattgtcttggatggctgtaattaatatattagcacttggaattgatgaagtatttaaaataaatgcatatgactaaagcaatcttcagactatttctagacatgatgtagttgaatgcaaaaatgtttttaatctcttttcccttttcaatatattgattatcagaattttgttcatgttataaatagaaacctccccagattgccttttacactttttagataagatgggttcttattttaaatgctgccacgaaatattttgctcagtactcatatataaaaagaaaattagttgctatatactgtcatagctttgtggcatacataaaatagaaaaaacacgttttacatgaatgctgttaggaaggatatcatcatttgatcttcaaacttgccgcttctctcaggagagttcagcaatatttctattggaattaaggaatggggtttgatttttatgaatggtttaccttcagatatttcagagagcagaataagcatacatattgaaaagaccaaagtggcacaaggctgcaaaatattaaaggtgccaggtgcttttaattaacaaatgaggactatctcgagtaaatcagataacttggattaagttctatgatatttcaaaatgtttttcgtctttttcagttttgtgtggtttgtgcttattatattaagtattcatttttagcatttgtgatcagattacagaacagtcattactcttgcttttcaaattgatttggttttcaaactccaaaactctgtgatgatttttacaaattggtttacattttgacagaacagagttaagttaattaatagatcaggcacgaaaaatcatccacagtagggtatattttctggtaaaatgaaagttatgtttcagcatgatgagcatcaggcttcagtaatctgttcctcgtgtggaatgaacacttcctacttcgagctagcaggcacctactgtttatttacgctgcattaaactgacagtgcagcaatcagaggaaaaatattacttaccttcctgaagtaaataccagtttatagtttagtgcacgtatttatattcctgtcaccactaaataacggctctgtctccattttaatatctacctgtgctataatccagggcttcagactcttcctggttggggataggggtcgagaggagtttttcttatcatttccctatggcaaaactttaaagacaagtaatttcatcttttcatttctgtcatgtgagaaccagttgaaagaaatgttatgcacttttactttgcatacctcaactataacatcaaaaccccaaaagaatctgcatgccacttaaaatagtcatcttaaagcaacctcaggataaatatgttcaaacacattcaaatgtgttttgctaaattaactttctacaaagttccaaaaagattaaactatttgattcctcagataataacttcaataaagtgtctcctcttccaagtcttagatggaatgtttaagtttttaatggagttctgaaaatatgaatataaagtggggctcattgattgatttattgattgactcgctaagcttttctctgaaaatattcttaactccttcatttgacttcttgttaatctgccatccttaaaataagggagatttctactttgttgtaatactaaatgtatttgttgtttttcttttatgataaaaatcctttctttttcaagacccctttgaaacatcaaaatactgttaaagttgaattccagaactcacaattaacttgagaaaaggcttattttcacttaaattatctaaaaagcggttacacttaactgtctatacacagttatcaatacctagtcacatattccactgacatcagggtagaatatggtcttaataacaacatataaatcaaatctgttacataaggttctccttcactacactgaagaaaaagtgtctactatagtaatttatatatcgttcctaaatgctgttctcagtggtaagtctatttaaacttgatgtcttcatagagtgtgatcaacacattaacacacattatttcatacttttgaacttatgccaatggtatcttttgctgtttatttttttaagtcttttttaagattagatatttcagagtaaatagatacagattgtgtgtgtatatattcagggtgagatttagtagtgtagcatttcttcaacatattggcctatttttatgctttcaagttattttgtatcacttttacagttgttgcagtttgaaagttcagaagcgaaattctaataacctctttcaatggactttcaaggatgtaattcagtttatgcggtgatgtagtttagttacaagagatgaaaattagttaactggtacctcaggatttatgtccctggtttctgctgaaatttattcagtccagttatttgacatttggtagagaagtggcttgtaatcaaaaattaagagttggttcagtttccagtggagaaaagatttcgctggataaaacatttaactgtgcaatattttattacactcctcactcattttagagcctgcttattgttgcacacatttttgaatacctaggggtgcaggtccccagatgaggctgaaatgcttgcggaagaagcagatgtcaggctgcacctcgctgtgcctttactagtacctatgtggacttaagctgcccgccccccgcacccctttcccccaggtgtgcaggaagtagagggcgttatactgggtgaagtgggtggactctacccagagctatgacctgatttgtgacgcaccctcagaactgcagtaatggtccagctgcttcacaggcaactggtaaccacctcatttggggatgtttctgccttgctagcagtgccagagagaacttcatcattgtcacctcatcaaagactactttttcagacatctcctgtagggctagattcagagagcagcttctgatatttggagggtaagtgccagaaaagttactgtaatgttacatgtggagaatcaggactccagccacagtgacagataggcattgagtgttcgggggagggctttctgttgggatgttgctttttctcagctctagaaaatttgggaccagatactaagaaaaattcttcagtgggcattcttttttgggtggtgagatacagtagcaagttcccagggagaattattagaccttcttgaaatatttaaagaaaaggtagtcagtaatctgtgtgagggggcattctttagatgcaattttcctggaagctaggcatgtagtagagttgattgctagagattcctctatagtcttattcattggttcctgatatgccattaagagcatgtaaatgacaatttggccttttaatgtttataatgttaaggactttaaggcaaaagaggttttatgttataaatattttattgtaataattattataaatagaacctagtgtatgcagatatctttgaaatggagatagtcttgaatatagcatatccataattagctgtttgatattgaatgcaattgagttttcctgttctagtgaaacagacaatggaaatcattggggattaacaacaaggctatgtgattcttgatatagcaagcctttctttcccccagaaaatattttatcaatgaatgaagtactaaattaagatgcatacagttttaaatttttaaaaaatctatagaatttgtaaaataatccaaatgcttcccattgtattttcaccaactgaaatgatacttagatgtactgtttaatggtagacagtgatctccagactgtgggaggaaaaaacaatattttaataactatgttttaaaaattttcttagagttgcatttccctttgggtggttcaagaggactcagaaacaatttagaacattatcttaaaagtttaacaatgacagtttgtatagaatcactgtattttaataatactgtatgcttattagtgttattagagcagtagacagttaattacagccttttctgagacatgttaactatatattaacaaccatgttaaaaaagaatgatgtatactcttaacatacaagcggctgcttgcttgattctttaaaaaaaatcttttagaatgtatggagtcagggttttggttcagaattatgaaaggttttctactaaagcaacttaattttaaaacttttcactgggttataaaatttttctcctgtttttttttctttccagtgtcattagaaattattgctcctcagtggttttagtttttccaaattgtattttgagatacccatgttttcttgttttttgatgacttcggccaacataatccattaaaagcttatttaattgattttgctcctcttaatacttctttttgtggaataattttagtcactttttctttagccaaattgtgattacttaaaactctatataacctaatattctacatacatttcagcagttaatcacagaggtagttctaagattatttcattgtctaaatctcaaacctggattttcactatggcttctagaatggcaaaacaatgggttactgaaactagagggatttaaagctggacttaggcttacttagacaattctatcaaattggttaactatttgagttatcttggttgatttgaatttgtagatcttgtaacctcgtaatatggctcttaaaaacgcactagtattcccactttctgaagtttgtagaagctgctatatatttctgtaagtattaaactacaaaaaagtaagtaagtaataaggtatgtctgtgttatataaaacagaaagttcatagttagcattctgtgccttgtacgtattgagcactcattaaagaattgctaaattaatgataaaatataaaatgtagcttgtgccgataaagatttattggcaaagagaattttctttctaattttctgtttttactagggttatctgaacacttaatctgcacatgcctcattttctggataattggatgattttttttttttttttttggtagcacctgggtctctgttctatcctcattgtctgaccttcagtattaggttaagtgtgcctgctcagcttcattctttggtgtttggttgtggtaacaaacaataccggagtcaaacagagcactcccctgagttccttgcaatttgagccaccaagtagccatccttctgatattccagaaccaaaaatattatggactagtgcctcaaggctgattgaccttctatgcgttctttcctacaataatgattgtttttcaggctcccattgaataaatactactgtaattattgcataaaaagatatttttcattgcagcttaaatacattgtttgaaaagtactctaagatttggagtgtttgtatatgaatattttactccattccttaaaactaattctgaaattgcagtagggttgtgttagctgcatccaaaatattctgaaaagttctaggcattctatgaaagttatctaaaaaagacacttccttttaaaatttattttcattttaaaatatgagtggggctgcttgtaagacagtcctatttagttacacaaaagacagaatttcttaagtggtgcactgctgtgtgacctattacattatcatgcacattctgtctctttaaaaacacagtctcctctatttgccctattaattgttgatatgttgccatccacgagacaaaaattagagctgtaattaaataatcatgtgatgctccttagtgccaatgagagcaaactcatttttccaggccctgatggtcactgattattgtattactactggcttgctttatttttttttaatgattctctatctgtagattacctaactactgtccttcttttcaaaattaaagaaagtagaaaacattcagccagttaattggctagaggtcctcagggacataaggtagacataccttttttgcttttggtcacctggtgggttctttggggaggctacatcagtggtgtggttgcctgccatttaatttacactggtgttttggctgggatggaggcatatggggaatgccaggagaattacaaaaggagccgggtattaaaattcagaaatgattaaaattgaaataaaaggatgctgcttctttgccagtactctggcagtcataatgacacatagagattagtttccaccttcatcttttccttctttctcatttcctcttgtttattgttgacacattttccttatgtctgtctcctgtctctgtatctttttgcaccattatgcattcctacttctccctctttctttaagcatggagaagcctacttaaccttattataacaataacagaataggttattaatatttaatatgcacatgattaaaatttctctcccttaaacataggtcagctgtattattactaaccggcatgtaatttttcatttaaaatattggtattctgccccatgccgtttctgaaatgcagtctactttagtagtgatttaatacacaacgtttagaaaattgtggtcggctagtgagaaaagaatttaccagtcatggataatcaattatgcatgaattcagatgtaacagatggaatctggtgagttaaagtttctctttgccttagcggttattttttttttttatttgtttgtttgacacctgtctcttatatagagataaacatctaacgtagcatgtgagaaatttccttatatttatattttctctttcaagtgaacttaatttttttaattgaagaaagagattttttatgtgatcttaaagatgatcagactctatccattcattttatagatacggaacctgatcctgcttaactaatgaaggatcactcagctagtgagtagagtaagaagcaagacccaaatctagtttctctatcttttctccactacttttcccactatgtgacttatgttcctttttgtgggagttacttaatagtaggggtattatactacctctgagttttaaaggctttctgatgaaaactgtggtagactagttttaaattgtggaatactctcttgtataacatgcaaatattatctgtgtacatataaaaatgttatgctatgtgtatattttatatatatatatatacttattcttacttggatgttggccaaacaattggatttttcaaatctattgagaatgccacaagatttggttttacatcctaaactgcggcatatgccagccttgaagatacatttacacttggttgcagtgttgtaaatttttagtgacaaaacccctttgcacaaagcgaaataaaaagttatttttgagagccttgttacctcaaagaagagatgagaggttaatttttattaaatataatgtgaatatgtagtgtttcttcaactgtaaaagtaatagaagaatagtggatattgacctttaaagcagtctagccttaaaacagaaagctggtttccatcaaaatttttcataaatgtgctatttgtttctctctcaagtgtatttatgtattaaataacacaaatgaaaagtctttgcaaaataaataaaaataaatgattaaaaaacagcctcaaggctctctagttcttttttaaagttctactgtggcattatttatcaactttttccttcatgttggctcaaaatgtccatgtatagtccatgctagttatctaataaatttttaaatgaacacattaataaagaaaaaggcacctacaagataggtaactggatatgccttaagcatagctatactgtgaagctgtcttttagtattttatttaatgcttttacacataataaatatatgtttgtaagttggtttcactttattagcattccttaattatgcgtataagaaaaaaatacagatacgaacttcaataaaatgatttatacatgaatttccaaatcattaaaaactccatcattaatacaagtttttaatataaaatccataggaatagatgatatgaaaactgaatgtggaacagtacaggaaaagatgatatttcaaattattatatgtagatatactttcatccttattactagcactaaaaaagtaactgagctgattaaatttgaaagcgtttttttaaacaaaattttcttttattaaaaaaatagaatctaaagtctttttatgtagacaatttgcaaattagtactttatacagttgttacaattgcagctgttctgcatatatgagcgtgacactcaaagtactgtgtaacagagaaaatctatttcatgcatatagttaatttttactgttttgaaaaacattccaaaagaattttttggacttaaggaactcctgtttgtttttgtctatgcgcctttctctttttttggctaagatattgtattgaataaaaccttaaaagagaaccattttcttacattgaaggaacctcaaagtgagtgggatcttggtctctaattaccaatccatgttaattatccttgggtcaggtattcatcatattaattgtgtagcatagactggactgtagctgttagcaggtaaggacaaagcaatgtaagattggggtggggatgggattgttcaatgtgatgtagctcattgtttctctgaggcttggcatgatattttcctggtattatatatctgccaatgctaggcatacatgaaagattgttttgcttttgtttttttttttttgaaaatgtttatatggtaaaatatgtgtaaaaaaatacgccattttgactgtttctaggtgtacaattcagtgacattaattacatacacactgttgtgcaaccatcaccacagtttgtttccaactctttttctatcagcccaaatacaatgtgctttagttttgaatttaatttctccttcacttcaacaaatttcaagtgttacagtagtatttaattattgtccaggtgtgaagcatttgtttctgatggtggctttccttccaacggacaatgcctcgtccagtgccttatggtggtgggcatagcagtacaatatcagatattgcctttggctgatgttgccacaaaaatgacctggacaaggattcaggaccattgttatcgcgaattctttctccctccaattaagctaggaaagattagaaataacattcatatcaactaaggaaatttggttgatatgtacatcttggttaaaagttgattgggaacagttgctgttcgatttcaccggaattaaaaattggaggattttacctcgagctttctgagaatattaaaggcacagcaactaggtctaggatgctttgcagttggctccttgacatggacagtctaaatactttggttctgttcaagtgcagtgacagtctggaaataagttgaacagttttcagcccttcaaagagaagcccactcaaggttgaacagttgtctgagagaaaaatcatgttatattgaaaaaagaattagaggaaacttggatggttctggctccagtaaataatagactggtttgagaactgtacttccatgtataattttgtggttagtcacttaatgtctatcatgataaataacatacctgcacaggatttctggcaccccagtaaatctcaaacaagtgcccaaatgctagtttattatggttcctcaaatagcatgtatttatttgccaaatcaatgatccagtagcttcctgcccccacttttattgcctttttagaaatttgaaacaagtagcttgcccacatatacatttctcaaattttggtctactgctggttcatacaacagcttagcttttccaagtgactccaggagtgagttaaaaaccacctcagagatgtcctgagtatttgattctctgtctctaaaacatcacctaacctggtagatgccaaacctggctgtatatgagaatcaccttgagagctttaaaaaactgaatgtcttctcctcatcctcagccattctgatttaattgcagtggggttcagcctggacatctggattgtgatctcagtacctggttttacgtcctaagattgtcaaagggaatgcagaaatatatacatgagtaaaccttcaagatgcttagagtcttgcagtttggagaggcagacatatagatagatatgaaatgtcacattgcattcaggcagtgtgatggagcatggagaaggaaataactaacaactggagaaggcttcggactgacaaggggaaatcaagctgcacattaaagaagatagcagaaaggaggtcctcaagtgagaagggacatgaagggcactccacgagctacaggaaaaaaatgaggcatctttgtggactctagggcaatttcaagaatccttccttcttcttactcgattttggatctgggtccagataaaggtaccaattttggtggaattattaccaccgtgccctgtcaaataagtgatccatactgacatccatggaaggaaaggtagctaaaagatttttttccaatgaagttcccaatgaaacagtattgtttctgagtaaaaggcccagatatcctgtcggtttccagaagccagctgcaatggctgctcgttttccctctccagatctcccaaaacaaacataaacattgggttttttccccctcaactataatgacctttgtctattaaaactgtatcatgaattaccactctgtatttacatctatgccaagtaattagggaaataacttttgatcgctatcattctagctaaaactgaaactcaacttcttaggggaagaaaacaaaaccaaaaaatccttaaaccctatatttagagttcattatcatcactcctttaactcgcctgcaacattttgaagctttttgccattattctctgcagtgcatcattatttgttatctggatgccctcccagttcgagtaggtatctacattaatgcttccagagaggcatttctaagggtagctatgcttatataatataggtacaggggtaagggtgggaatgactgtgatttttaacttcacctatgagatacttaaatgttcacggaaagcagcttttggagtaaacacattacttaaaatgtattacagaaccctttcaagtacagacatgtctagaaagttcttaaatttgtatttagcagtatacaggtatcatttcctgcaactttacagatctacaggctaattctaaaatggaaaattatcttgactcagatgtcattggaatgtctgaaagccatttagcacctctaagactcctcctggccaggtcttggattcccttagttgtcttttaaaggagttctctagggtaagcactgtccaatggaactttctgcagtgaggaagtgttctgtaatctacactgtccgctattagagtattagtcacatggggctattgagcacctgaaatgtgaatgaggaattaaatcataaatttcatttaaattaattcaaatttaaatgatatagccaccttcttcaatgttccctcttcctacaatcactttaaaaaactgtcaatgcaatttgtagtggaaattggttgcaagtgacactgtgagcttttgttcccatttattcatttataatataaatattacaaggacactgtataaattcctagtaatatggcagtgagcaagacacccagtctctgctctcatagggcttacagtctagtaagggagacatgtattaagccagtaattacccaaattgttaattaattaagactgtgatgactgtttcaaaggagaaatacaagattctgtgagggtatataatgggggccagaacttcttgcataattagtcagagagtttaatcagagttctaattattaactagacaagaaaagcatgaggcagcttcctttccccaagttcaaggctgggtcaggttggctgcaggaggcacagctctcagagtagggcagctagcatgtgccatgccatgacctccaaagaagtgggatctgtttaagacgtaggatcttaatctgattaagctctgtgcatacaaatactgcaaacttctgaacttgaacaagtagattgtttcccaaactgtatgcagttgtaatgatgtcggtcacagataatatgtgagaagaagcgtgcaatgtttacaggatattgcatttcttctccaatatatattttgacaaagttgtttgggctgcagccccagcttcttcctccctgctctttcaaattggtatttggtccattcaggaaacgatgcagaaatcggtcctgacatcccagacagacaaaatgagacacatgacagcaaaacatatggctcagacacacatccttatatggccaacagagaaccatattcccagaaattcatatatggaaaacaccacctgcagctaaagccaaaaaacaaagagttgacacgacaaaaagagcaatatgctacataaattgtgctgctttaagagtgtagagatagccaactgtatttgaatttaaaaagatgaaaaaagaaaaaaaaacatgtccttagaaagtgttatggtggtaagcattgctttgctaacacagtcactggcggagttgctatatcttaaaagcactcgaattctaaatgctttctctgtttattacaaatgtatgtgctattcagaactctgaatgtgttttaatgcgttcggatatctgcctgcatatttatcttaatacattgccatctgaaacatgcagtagtcctttcattaagtttttaaaaattttgtgtgtagccaggataatgccttctcatgtgatagaaaattgatgcactctgttttaaatgtgcatccacatgttaaatagttcatgtatttgaattgcaatattttatgttcctgaggttttctattttgatggccagacttataaagtttaactttcttcaatacttgcatgcatcattattgcttaatataagatccctgtattgaagttttttcctcctgccgtgatagtttatgttcacatatgcctaggaaggtggtattttcttaattattgctattatttgaatacttgtcctctccaaaactcatgttgaaatttaatccccaatgtggcaatactgagaggtggggcctttaagaggtgtttggatcatgtgggctttgctcttgtgaatggattaatccattcgtggattaatgggttaatggattaatgggttatcatgggagtgggactgttggctttgtaagaaaaggaagagagccctgagctagcatactcaagccccttgccatgtaatatccagtgccaccacaggactctgcagagaactcccactaggaagaaggccctcaccagatgaggcccctccacctggaatttctcagcctccacagtgtaagaaataaattccttttctttataaattacccaatttcaggtattctgttataaggaacagaaaacagactaagacaaatttctttctttttttgttatttatttttatctggctttacactggccaatactcagtggcttataatgaaatattctaaagggtagttaatatatagtaattaatttcatcagtgatgtataccactagtacattaacctctatgtgccattttacttatgtcatttcttatagttctggaataaaaaatgtgcttgagggaaagtttattgtgctatattgttattcattataatatagtcattcttagatgcctttatgctcatttattctgtttatcattttccaaggccatgtcagtccttattacatactttcatgttttgtgtttttgaatagatttgtgactcagataaaaggtgctattcaaatttaaggattgctgtattaattcccatattatattagcattcaccaggtcattaggagggtaaaacattcagatggcattttgtcttatttatttctgtaaaatgatgtaataagcatgtttacaatattttatttcagtctatcttaatattgatatttcccgtgatctttgtttagtggtgttttctcttagtttaaattttattttgcccaacagctttcttttcttttataaaaaacattcagcttgaggtgacattgcctggctaaattacatttgtgtgtgtgtggaccactataatttttctttatttttaaatgttgctattgtttgtaaatttgtacaacaaggcactagagtgcacagtccctactgaaaacaaggcaggtttcagggaaacatgtcaggcattactagtttgaagcaactattaaagtatccatattggaaatttcaaatttaacctaccatatttctatttcttatactttagctaacatatcttccttcagatttccccacattttaacttttaaaaatttactatcatttgggctttttactaaaaatttgccttaaatttcttttcctatttttgatgctgtgttttctgtttatcacatgttcattcttttgctcaaggcttgggtttgtgtgccaagattcacggttgccttcccagatttggctaacctttctggtttgtgggtgaaacgtgggtgctattagagtgatatattttcattttgtttctcctaaacttactctcccctaggaggccatcatttcctacacttttctgctttaccttttggcttttctttagatttgtaatgtaaacagtgtgcctaagagtgtattggtggctttacagagcttaatttgcaaatttcccttttatctcagtacttgtgctaacttgttgcttttttatgtgtaacaaaatgtttatctgactgatttttctcttttccctaccagcaaattctgaaaaataattcttgttttttgttaatgattaactgccttcagggtgctaaaatggtagaactaaaacctaagcgataaatgaggcatttctattttgggttacattgtaatattctttatttttacatgaactatatttaatagattgtctaaataataggatcatacttatgtggtaatgaccatttatctaactgggtaacctaccctagattacagcagaagtgtttattgctacaacagatgtatttaccaacccaaactttcctcttttgcctagcgtaaattatttgaagaatgatggcatcttttcctttataataacaagtcaggtctctttcaagtgacccaaattttgtttaactcggccacgtatttcttcttccaaagtattctatggctcagaagtgagggcgatttgaaccaacgtctgactagtacagaacgctcttactcagttctttctaatgttggctcctcatagtttaaggaccaccctccttagaggataaacattccgagcgtttcgaggctcctggcctttattgctgtacacgtttctgcaccctccgcgcttccccggagagaactgccttccgtctgtacccctccagccacttcctgatggctccctacctcattcctcagcgcctgtcacctgcgtacccgcgcccttctcccacggggccggtgcgtctccctgtccccccacctcgcctgtccctctgcgacgctccaggcgtactcctttttgtggcttttgtggcgtgtgggtggttggttagttttctcccctggccctcgccccctcctccccgtcattttccttccccccgccccccgtgcccgtcctgcccgtcctgcccctcctccctcccactcacacacctgcccctgccgcccgcgcgccgcgcgctcccctccccgctccggcggacgctgccagggaagccccctctcctcctcccctctgcgccctccctggcgcgtctggcggcggccggcgctagccctcgcacagcgccctgttattctgggtattgtgtgtaataaatgtcgggccgcctcactctaatcaagctcattacaaattcttgcgcgcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcctcctcctccccctccccccgaacctcttctctcctcacttgctgggaccccagacgctcacagccccgcgtcaatgggcagggagagggtccttgcggctgttgtcagcgagggcagaatcaaaagtggcattttagtgcctttccggggcttttctcgcgaccccctgccccccaccctcgctgtcccccgctagatgccctcgttgggggtgcgaggctgtggggaaaagtttaaggtttgttaatattagtcgcgattgttggcggggggggggtgggggtgattggaagggaggcgaggtggccttcccaatgcgcgttattcggggttattgaagaataatattgcaagtgacagccagaagtagactttctgtcctcacaccgaagaacccgagtgagcaggagggagggagagacgcgaagagaccttttttcctttttggagaccttgtccgcagtgatttttttttttttaagagaatcctcagtcaccacgtcgtttccccagcaccatcacagtgtacagctcataacgggttttgctttgtttttacgatttccccccaacgaatcacttgtcagatcaattttatcttcttcctcctccctgcttcccactctcccctcctccccatcgcaaaccccgttctctgaggttagacattttacaaacccctatatgttggttttcgaattgtgattttttttttaaacccctttctcatggctactcttctagacgtttatttctgcccttcccccgcttaggggggcgggggtaggggaaaggaaaataatacaatttcaggggaagtcgccttcaggtctgctgcttttttattttttttttttaattaaaaaaaaaaaggacatagaaaacatcagtcttgaacttctcttcaagaacccgggctgcaaaggaaatctcctttgtttttgttatttatgtgctgtcaagttttgaagtggtgagtttcaggtcggttttgctaatttcactcagtaaaactgcagtgtttctgtttctagatagtactttgcttctttgtctctttaaaaggtcacagtgaaagcttggcctggatcgtgccggccatatggaatggataagggcacaatcttaaaatgtgattatggggttgtgtgggggcgaaggaggcgatccagctagaaactcattgaaaaggatctcgctttgcaaaaaatcggttcctaaaaaactagaatttcgagattttctttccttttaaaggaaataattgttgttactgagttcactgttttattcagtaattatcatatatggtcttagtttatgggcagataaatgggattttcagaaagtagcttgctttctgtgtggcaaccagacattgcactaaaatgggttgtaacgtgtaactcaaaagaaactcttcagcctggcatctgttgagaccatagttagttcctgctgctgtcatccaagcaggcctgttggaggttgctcttttcaatcccaaactgaggtttggtgaactttagcccgggcatagagttaaaatgagtaaattgggtgttttatgcgcatttaattttggtttgtaatgtaaagctttttacaccacgacttagtgtttaatagatgcttataggtgggtattcaaaggacagtttttcatgacctatatgatactttagattgtcaatacattaaattataatgtatcactttcatttgctgtacagtttctagtgttgttaagcctcatgattacttaatatgttttatagcattaactttgatgctgttgtctacaccccctccctttttttcctcttaaattgccccaagggctaaagatttttcttttcaaatcatatgttttaaaattcatcttctgctctaggatgaggcaaccaatttcagaaaaagctctgtgttatccacatgaaacgttataaagagtgttttgaataagttaataatcatctctttctaattttggctttagactgcagtttaatataatggaaaagagtaatcttgctaaaaagtggtttaaaaaggcacatttattgttaatgaacctcataaccaaaaacagatgggacctctatcaacggtaaacctttagttctcagtgtgccactctggagtacaaagataaatagccattaatttttctcaaactttatagttcttcaattggcattcttaaggttgcttttaaacttccagattaacattgctgccccccttttcttgattatatggtaagaagtaggctatggttaaacagaagaaaaaatatttacagaaaagccatgctaatacaaactggctttcaacaaatccagatttaaatagctccagtgtaagaatttacaacaaaaacaagctatatcaaattactagacagctaggaaaaatggtaattattctctctggttttcctaaatatgatccccttagtttcataagctcaatacttcaaataccatcaaagttcataaaataattctacttacctgttcttatcaattctaattaaaactatactttaaaaatgactttgatattgtctaatcactttactataaatgatgggaaaattgatgtctaatatataactgaaaataattatctgttaatttttttgaagttaattacaatgttaatgccattgcatgctgaggttatttctgaatactggatattttgttttaccagtatcatcaaggttttttgtttgtgttttttttttttttaattgagcttggcacttcaacctaatgtgcatatcacgaagtgtattcaattttttaaaaatatttattgttaacagccctctattactaatggacacctaaatactgactctaaaacacatgagttttaatgcatcagtacgttggatatttgaaaacccttcacttcttcctgtttctttaggggtaaactgatccaatcacatctttggcccaaaacttgactaggtctgtcacataactcttggaactttgatagtagaaaactttttctatgcattaatttacaaaagccaatggggagtttaaaaagcagttagatgtttgttaccttcttttgagatggtttatgtttttttcataagaattaatatacatacacatataaaatgtatacatataaaacatatacattagatttctaatattttgaactatgatcatctttccatcctttattaaagtgtttctgctgtattttgtaatgtgtttctaattgttaaaaattgggactacgtaaatgcaatttgctgttttctttttagctatacttgtaataattcttgttctaaaagtaagcccatttttccccacttagtttttttataggccagttatctttttattcatgtgtattggtacagtttccacagatcattttgttaatttgaataagaatgtaatgctatcatctagaaatatagtaacatctgtatcatatctagataggccattttacaaatacattatatttgtggagagatatctagagctaaaacatttacataggacacatatatacacgtaggtccccgcccaactataacgtgtcttctttttaaattctggcaggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggtaaataccttcaagccaaatcttgaaaagctgaaagccctgttgtctacacaaggccacactgtgtgggggtggagtggcagaacatgttttgtatactctgcctttattctccttatgatcgtacattagttacattctgggtccttagtatcaatcacgttggaaagtatagcctccatgcttgggtggagcgttctactgtagactggaatcatggaacattttgggtaataaggactgaattaaatataatggttttagttttggcagggtccattcaaaaggtgttgtagtcgaggattgtaggcagctgtttcttcaaactaacctgattaagaataaaacacttaggtgatttgagagttaccctagcttcttcctaagattcttagttgtagggcagtttcagagatcttggacatcttatgtagaagtttggtaatgttattttttgtggcttattttcttaagagcaaattcattagcagtaaaaaatctgatgattctagttttttatttttgttttaattgggtatttttgatgaagaaagaacagatttaggcaagtttataaggggaagatgtgtaactgtgtgacttttttctaccaatattaaattgatgcagtttaacaacttggactgtgtttaacagtgttgttcctgtaaagcagtgcctaccctgggtgtaatgcatgtgcctcataaggagcttcattttgtgtctgaataacatgtataggaatcagattttccttacatttgctaagcaatggataaaaatgctatattttagcaaccaagaatattaagtagataaagttagaaggcagaggaatttcattgtgtttgatgcgtaacatttatcatacaatcatttattttttccttggtttggcgaaaacaaagaatatattgatcctgaaatgaacagacacagcagtccgtattgttagatctttatctattaaaaatgggaaaacagcacttcagcaaattctttggcctctactcatgattaccctatttattgattgtttgccaagaatgtatgcatcttaagaaagccagggtaagagcattaaaaatataatttattacggcttttcaaacagagtgcattaatattgtactgtgaagcactggggctgtataaaaaagactttctgacgcctgcaaacatgtaagttccataaattcctaaataggagatttcagctgtctctggtattatgtgatatttgcacagcaaactttaatgccaggacagttttagacaaggattctacagacttcactgctccttatggcagacgtgctgtttacacaggctcataaaccttcagcaaaagcttctaagactgccttcaggtttaaatcatgtggtatttttagcattcagcagtgaccagtgctctcccctttaaatgctggaaggttatgaagttgctgtagttggaactctcgccaaacactagcacgaataatcatacagttcagaaaaggcttgtgttcagcattactcccagaaacgggagggtaaccgcaacagtttgctagaaggtctgtaattagatagtactattgtcactttatagccgtctttattattttagggtacctctaaacatgatcaataaaatccacaataaatccaatatatttcaatagtttgaaaaccctgcagttatttcatagatctaaggaaaagcatattgtagaatacatctgattcatcctacaaaaggaaaaatgaatgtgtacatttttgttgtacttacccaactctttgaagatatcaggacaggaggaggaaaactaaaagtacagtaaattcacttcctgctcaaatgctttttggttttgttttgttttgttttggatgtattctaaaaatgcagtttaattgtaggagggtctcagatactccaaataacaaaattactaaagtctttttgtgggtttttattaacattttcatcttatttttcatgtgcatggtttctgtctgataggtgctaaatgaaaattatggctgagatgagaaaacactactaagaaaaagggattgaatggttttatttgtttaggcgattttgccagaataccttcaagccaaggaaggaatcgccagtttgcatattgctatttttgctgtggtctccccaagttgtcttctgatccccgacgggttctttctctggtataaaacagctgaatgaatgacaaaaatattggcaagctctgcggcttgtttttcatgcctagcctattggtacctccgaatgagtttgtgagtttttctaagtaaacctaaagggttttgtcagacctagaatctcttgtgaacagttcactaaagctttggtgaagactcacatgtagaaagatgtagctgttttattgccggcttttgttcagcagaaacaagcaaatagagaatctttgaagggcctctctggtgtcagtaggaaatcctgatttttagctacggttggtgtgcactaagtcatcttcagaagttggtaggattctgtgagtccagaggacagagcttatagaggcattagtattgtaggactaattgtggatcctgggtgccctgttaaagtaacccttgtcatcatttatgctaaagatgatacccttctggcagtttgccacagtacaattcagatgcatctgcttttaacccttttccgttatcattggaagtctgacagtgcgctgcataaacaccttgagtaccacagcattccgtaatatcaatttctagaagaagcctctttctaatagtagtgtggccggtgcttattaatcatctagctactgagttactgtattggattaaaatatataaagagagagcacaccaaatctatgcagattcctttatcctagtatgtcagtttccttttctatctctcatttttaccttatttactgtaacaaagattgttgattttaaagacttatgggtaccgtgctctctttttagttaggtaggttaaatgagtattcataaaagcaaatgttatttttctacattatgcagatattgaaattgtgtattatgagcaccagtttggttaagtactttttgtggaaccagttagagctaatatctaaaaaaggaagaaaatgatttgtggaaccagttagagttaatatctaaaaaaggaagaaaatgaaaatttcgtggtcgaagataatttgtttggacacaaacccaggaaaagtttattattaacaaaatcatgtaagcagtagaaaggtgggttcttctgaagataaatggtgagttatgtttgcatactgtatactactcatagcaaattagagaagatacatttatttctctttcgtcaccattattatttgatcagaaaggtaattctgcattcattgcttttggcaaatgcactgttaatttagagcacagcttaccttaggaccaagttcatattctacttaaatatttctgttacgactttaaataatatgagaatgtatatatttgtgtgcatttgcctgtactgtacccagtctgccttggaagcacagtgaatctcttgtgattatttattttcatggctaatatttcctcccgccacccccaagctgtatttctgaagattgttggttttccatctcttcttcttcatctttttgataggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaaggtaaataatgtgtacgtggggttggaaaaattgcttagcattctttgtttaccttgcagagaaagcactgaatatttttattcaaagaactgtagcctgtgtattacattggttccttataggctgtggctttaaaaaattggcttaattcagtttggtttagttaacacacattttgctcatgtggaatgtcgaggtagattttttttttaaattacttcagctgaatcattagtatgcttattgaccttaataatctgctccactgaggacccacaaggaagtgaggagcgtatttgagcagatggactgttgagagtcaatttgcatttatgactgaatatctagttctgtttcttttattctgtttctgatggttttatgggctgcaaagtatttttcaatgctgattcccactgcaatagagaatcttatctaaatcataaagccatttagaactggttcggctatgtcttattagaacttcctgtaagttaggaaaatgtggccttatgcataggttttattgatggggttttatttccaaaataataaacaaccctacagtcatttacataattttacaatttggaaagctaagctgtgaatattttcattgacctgccttttagagggaagggaatcattcaaacagaaataacggtactgcttgtggtaggggtagtagaaaagaaaagaacacccttctagtagatatattatctgagggtaaaatatttagtgacatattctctttatctgaaatagggctaatccaggttggaaagtggaatccagttccactgtcttacgtgacagatgcccctgatgctacagtagcagatatgcttcaagatgtgtatcatgtggtcacattgaaaattcagttacacaggtgagtcaagacagcaaatctagggtgaaacattcttcttacctggtcttttgaaatgaagcatttctctctggtcgaccttcaatttttttttagtctgtgtttcagaaaggttaatacagatcgattttgttaccctatccttctgccttttttcctaacttcaatgtataatttaaaagcaatccccccccccacacacacaaaaaatgtgtaggtttgtgcaggttatcaaaagacaagactttttacgtttagtcaattaaataatgcatcacaagaaggcattttacataaagtttacttaagaaaaaaatatttttgcatatcatgaacagtgccatctgtgtacattttgtgaaagactgtcttattcactattaccacagtcttatttatttatttatttttttatgatttttaattcatatgaacagagtaatgaaaggaaatcggttaatacattaaagcttttcatgatggctcaggagaaagcagtacaccttaaattgtcttcccaagcgcatcagagcaggaaggtagaagtaacatgaaaaaatagccaccacaggcagctgatgtataattcatgcatcgatacagcagatgtgttgtataaagtaattaactaatcggaacaatcaggagaccgagagcaatctccagatgcatctgtttgatgcgcaaaatgaaatctgtctgtcttaaaggaatgttctgcagcgggatgcaatcttgtaataatcccctttctaatctatgtctcaaatagttgccccaaactagaagacttgcctcccgaacaatggtcgcacaccacagtgaggaatgctctgaaggacttactgaaagatatgaatcagagttcattggccaaggagtgccccctttcacaggtacttagcatagaatgtaataaataataagacatcatgggcaaccctgatttgaggtttgatggagctccctggtttaaagcaactggtatctgaagcaagaatctgccaaaaatgcaaagtgacttgaccactggtgaccttttaaaatatgcctgattccttgtgaacagagcctataggctttttctcccttggggaaaagaggcaaaggactgtttacaggaaaaacagttcagtggaagactccgctggctaatttttagatttgtcttctgagtgctattagcatgatggctaaattctcctgaatgcccttatttaagaaagagtcgaggtggtactactcccacgaagcttcggtgagagggaatggcagtgtcagtgttaatgtgtaaaacttcaccgtgctatctgagtaaaataacagtacaattcttggatactttactcattaccaaaaaattaaaagtattttagtacaaataattatgaaaataattactcttaactaaaggttgaatagttaattcattaggattttgtgaccagttttgtggctttggtttacttcttttctgtttttttaagtggaattttcttttttccctctgagatgcctgttataccatcagggatttttaaaataaagatttttttaatgattttccttgatttctttttttagaataaatttggtggagggcagctaaaactctagatagagactgcctacctgcttatagacagaaaatcaaacatcatttttgatgaaactcagctgatttcaaataaaaaataaaaaggatgctgtgaatctactcttaaagggctgcttttgtggtcaccatgtaaatgtgttatagtcatcccctcagtacccaaacccgttttaaggccattccatgatacagtataattaaaatgttggtccaactagatttttaccagatttttaatgttttcttttaatttgagttttaattctgaatattagtcttagccatttgaacttgaactgtaggatgctgctgtaaacatttctgcagtggagagatctcaaagtgtatttctgctatattctgagtagcagatattctcaaaatgtgtttctaatgtgaggcttatgaagattattgggtacctttgaagggaatcttgtcagctttgtgcttctgtttcatagaaactccatgcatttcagatttgctaagttacgttccaacacttttactttgatatttgctagaaattttaggaatgaagcaaatgaattgtttataattaatagctttctatatattctaaaataagctatagccacaggttacatattctctgtattgttaagtgtccatttcttgcaattcagagaaaactcttatttgtcatttcagttatacctacagctaatctcctgtcttccctctctcacccttggaatagagaggatatgaatttataaccatcaaataaaaataatttaaattaatcacaaatgaataggatgatagaataaaagggtgactcttacttcagggactttgtttcgcagacaactccagataacatgttacatggttgctaacatatgaaaatttgaaatgatctagaaataaactttttaaaaactcagttaaaatatgatgtaaacacccagtactggaatcgcatgtgtctttatgttactaaatgtcccattgatcttggaagtatattcagacaaatacttaaggcatttactatgagctgaagaagaggctgtcgttacaaatatttattgatacagtcagtgagaactaattgttaaatgacatcaacattcagccaataaactctacctcactataacttataaatagaattgtgaatttacttaatgttatcatggaaaatgaattgcatacaattataacattaagtagaatgacaaaatgtaattcaggacttggttttggagtcatacattggtgaatttctatagagagaggttttcagatatatggcttcctgtggctggatacctcactgtaatcattaagtgatggaactaggctacaatatcaacatcagttataattgcagtattcttttccataaaaaaacttctaaaaattatgcatagtttaggagtgaaagcaaatatttgaaattaatatttaataatatgaaaacatgtaaattgttctctaaatgaggtacttattttatattttgctgaatcatcttctctttttctatgaatctgatactccagtcagaattttttcaacataaactgttttctgtttgcttctttattatgtttttctgtctagagttattaaaatgagagatgcaagttccctaaagcctatgtccaaaatatatgccaagtttgacaaaactactctttttcctatggttaagatttggtgatgaagatgtcatggtgaaaaaagcctagcaaataaatatggcctcagtcttgagcaaaatgggacctaacaccaagaaatgccaagtgttaagccctttcttcccctgtggagtgttgattcattcatgggagagaacctttagcatgcaatacaccatacacattttactgtacagtaagggttttattttgttgaatatgataaagtactccagtagcaagtatggctacaggggccctaaatattatagttagtagaaagttcaccctgtgggcaggtaaattccttttatagagcaggggccaggaggagtggaactggggagccaccaggattttgcctggggtgttgaataagccctgcctccaatgctcttaggacgattgtctaatacttgctaagcaaatgtccatttggacttggattcttagaaccagaagggattatccttcctaggctcctccttttgataattgaaggagccagtgtccctggagattaaagtcacggtgcaatgactaacaagaaagtcctgacttgctaagcctatgtccttgcctgacaataaattttaaagtgctgatttagctacttgggaggctgaggcaggagaattgcttgaacccaggaggcggaggttgcagttagccgagatagcaccactgcactctagtttggtgacagaacgagactccgtttcaaaaaaaaaaaggaatacttacatttgggtacaataatgttttctttgatgatattcataaggttttcttcagctgcagaaattccataagtgggcttagtttgatttacaactcatacctttatttctgttatcactttcctatcataaatctgcccaaatcgattgacactaatttattaaattctttgtaccatgtgtttttttatttttgtaaaatgttctaagacataagaaacacttagctcattataggtctgaggttagatgttttgttgttacttttgtttttttcggtggatgtggttagataagttggatggtgcattctgaactgcagctaaggagagaataaacactgatttggggacaagagagcctgtagtcatgaaacttttgaggatatggatttgggaggaaaattgggaatttaaaaagtaaacatttttatttataataaaacattaacattttgatgcttattttccctggagttttagaaattgcatttaaaaactagataaatgtatatacattctgatacagggtagattcattttgttaagtaaaggtcagctattacttctaccagcgtaatgtcttccttctaaaaatgtttaggtcaaatatttcatggaggttttaatctgatttgcgcatttttaccttccctctttcaccacacatgtgggcgtacatactcgcgcgtgcacacgtgcacacacacacatcacaactttcacatttttaaggcattggattattttctatcttatttctcacctggaaaagatatctttaagccaagtcatataaagtgggtgagaagtgttatttttattttcaagtagcaaaatatatataaaataaatttgaacattccatttagaagtaatattgagaaagatgattttccaactttccttttattcacagcatcctgagatctcaaatatgttggacaatttatttattaatggaaaaataaattttaaaaagaaactacctcgtgctcctgaagcttagcttcagtactgctctcctgaaacatgacagtcatttccgtaggaattaaatacacttaggtgtttagttgatgttcagtctgtattataaatgatattggagcaacaattacaaatctatcatgttatacaaatgtgtttttaataaactgtactttatttcacagtttttggactggaatgacatgtttcttaaaattttaaatcagttttagtaagcacattcttaagagaatagccagcatcagtgttcatatactgcatttcacatgagagtctaatctatgaaatttgttcacattcatatattcaaaagtatgtattgacagtctgccgtatgccaggcattccatttcctatgtagtgttaaggatataacatcttattagttgaaataatagtattacactttgatttagtgcttttgatgtatcgagagcgcctttggtccccctaagtaggatatagtcttatatccccatttttaaatgaggaacctgaggcacagaatgttgacatgagtgagcgtccatggctacatcgctggtgaagcacaagggtgagacttcataccgagagcccgggagcttcaccaagtagccttttcatcacataccacagataaaggaagtttaaaaaagacaaaatgaaagcctctcagatgaattggataggttttataatatgctttgatttctctaaagtagtgataactacttgtagttttccaagtgtatttattctcattgctgaaaattttctttaccgtgttttggttttgtgtctttgattttttgtttgtatgttgtcttgttttaaaagtacattgctgtcatatcaagcccctaatcatgggtgatctagacaggaactgacttttgggataacttggtatttgggacgttccagaagatttgccggtatagttctgtgcagttacttctctttcctattctttcatattctcaagaccagtaggcataattatgctaatagccctttgttttgaaccccaaggtaacattagtcattttcattagaaatagtgggcagatgaatttcttgggtctgtttgaaaatacagactccagtcatcagactggtcttttacgagcagctccattttaaaataaaaggattcctgtttgagatgagctggaatgattttgtacttgccccttcccagtataaaattatcttatgtttaaacatcatatattttgaataaaagctctacagagaatcttctttcctttttaacattaaaaaactttccctagtttttaccctactgaccgtgggaatcttagattataaatatctgctttgccaggcactgaagtacttgatactaattggatattatgaccacttttcagcaattgtattactgtaatggtgggatccataaaggaaatggtaaacctgtcttatatgggtagttgtgtgaattgcaaaacttacatcaaataatttttttgcctcgtcttttgaacaagtcatgacatcattctagttcctttttcaacttagtgagatgtctgctctgtgttaatattataatgtgtataatctacaacagaattgtcctccaaattgcaagttttcctttttgaatctaatatatcaggctcatttttagatgacttagatgcataaggattttatcgtagcttgatgttagctctctgtaacctttcaggtatattaatcaaaaaagccaaacttaataaagcatctaatttaaaatggattgatctcaaatattttatagccactatcttttcacaatagtaaaacataaaagagtttaagctatgccaatttagagagtgcttaacaatgtgtaattactttattttcacttaatagatttttacctgtgccttgtttcagatctgaataggtttcctttgacctcaaaatcactaatgcagggaaaattaccatatcatgagagtatttttcctctttcttttttttgcctgatgcttagaataataaatactcccaaggcttaggagtagacatggcctgagagaaagcctattaaatgctattttctaatggttttaaaaaacaacttaaacaaatcatgctactcaaactgattttcttgctaaaacagaactagttttagagtatattttagacatctttttttctcaattactagttaaacttgaagttgggctctatctggatttgctttatagatctgcttcatttcatgccagatttgggcaaaccatgaacaacccccaactccaggaaaaaaaaaaaaacctgataatcaaaacaaacagatacacgaactcaatttccccctctttcattggaaactgcttgattataacgtgctctgagtatgaaaaacataagagagcctttaacataacagaggagagcctcagccctggttctgcagctcattgccaattgaagtaaggaacgctctggctgttgggacttttaaatctagacttaaaagttatttgttctgtttagcatttttaaaatgattctattaggaattgtatgtgcttcagttttaattttaactcataatgattgtaaagcaccctgggatgcttgcatgaagggcgctacagaaatataagattgtattgtgttctaatatgcagtcttacggggtgctggagtttcatcatggacaattcataagattgcagaattcctcatggcagagaaggtggctgacttctttagcagtctttttctctcattcttactctgaaactttgttctctttagtcatcatctttctctcttaaaaaaattgattattttctattgtaatattttcccatagaaatgctaatctaatttagtttactcaggttgaagatgcaaaccagttgataggttggaagttaagaaaagattaaagctttaattgctagcactatttgagatcacattcttatctgaataacaagacatggtacttcattactggataccaccaactctctcaggcttgtcccattttactgtccacctactatttgttccaaggaagttcagaaatgtaacaagtattaactttgtgaaatgtcacaatgagactcttctctgtattgaaactcctgtcttatgataacatacgacacagcttgatctagttttctttttactttttaatgggactgtttctttagagtaatggcatttcttcagcaacttcattgtgttactttttgtgtgtttttgtttgtcattgctctctagcatcactttaattagctcctagcatcgtaggaatcaggaatgtgagttatgttgtggccagctatatgagcttgggcagctgactccatgactcaattttctcatctataaagtcggaagataatagtaccaatgtctcgcattgtttagagaattaaatgagctagtacttagaaaacatttagaacagttttcagtcctaaagtgtgccataactagttgtttttctaaaatgtgggcattgagagtttgaaatcacacttgtgcatgccacatggtctatgtaactctctggctacatggaagattttggtgcaatcttcatttttagtgaaaacaaccaaatacttttcatttgtgaaaaaagtaaaagactatattataactcaatctcaacattaaggaacacttacagtcattataaagttatgatgtattttaaattggaagtggaagactgcagcttatactttaaataaatccatttggaagtttagcatatatgataccctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttcataggttttatgtaatttccagaattagttctgtggccctgtaaagagctaaaagccaggaggtattttacccccaatttttaggcagtatggcttaaaaatctaatatgctcctgtacagaaggaatgcaaagaggtaatataaagtcttcctgtgaagagttacagaacctaattctaatatttacttttggaaaatgaattgctcaaagtactttagttcttgttttcgctctgtggtttaagggttttttggttttgttttgtttttttaaaaggctctatttaggacctctggaacttaacacgaatttggtatctttccagatactagaaattgtaatctctagagaggatgagcgatttaaccacacaagggcatcagagaaagagatttctcaaatgggtacattggtatagagtgcctaagattcagaatcaggaaacaattttgtcaataaaatcaaataaaattccttggattcatatttatctaatgaaaaacttgtgaaaattctatttggatataacataatatataagttaataatgagtgtattttaaataatcataagcaggatgccaatggggtcgtaaccttcctaaaaataagactctagttggagacatttgcacagtgagtacctgagaatgaataatgtgcgttacaattgaatcttttttagtcactctgtttgagaagacatacagatttcatagacttttaaatctgttagaggagacgttggagattatctagttcagttcccttcatgttacagcttctgtgtgcagttaatttggaatatcacatgctcttaatataccttttaaaaatattttatagtttaagctctttaccagtatattcatttggtttgagttaggtttcagtgtgataagaaaggtctggctaggtacttatacaaaagggcagaatagagaatctggtcagaacatactatctgggcattatgtaagttattttaactatatggaagagccatataaactgtgaaccaacattttcttttaaaagttatgaatcgagtatttaaataaataaaatttctgtgctttgatatgatcacattttcatctttaggaaatatagtaggaaaattaaaatagaattggatgtgttctctttgtgcttccttttgtattcctttggagctttgtactgagtttccaattttagcaatgtgccagggttactttgtatgaaaatgccattttcaggcactaggattgatcaagatggcaagagccataactatgacaactggagtttaagtaaaatttagaagtgattagtctcttctcaacaaattgagattccaaatatgccccagttgtatctcccaagagaatagcttagaaagcaatagaggatccagagggaaagatttgggaaacagaagctgacaagcacaaacagaatattgcacttagaaatcctgccattcgctgtcataaattgaagcccatttcctgtccttcccaccccaaaataccagatgggaactacctgttaattttcaacaaattcatttcttgtcaatatatcatatctcatacgatgcctcttagagcttgtttgtagtatttggtgtcctttgagattaaaagaaaacctcatttacgaggaatccctgtgaaaattgtatttgaatgtgtagttgatgtgaagttaaagtttgacctttgaattttccatggacagataaaaagctgctgtaaaaaatcaggccataggtagtcaggacatgcacaaaggggtgggagattagaatgtatgaagttgaacttctcaaaaaataaaaatataataaaagccagtagtttgacagattgttcagtaaatgctcattttattgaaaactacaaaaaggtgcttaatgcctttgcgccattaatacaatacataaaaaggttactgtcaagattagtgttccatccctgaaaattaactgtagggctttatacatcaccatgcatagactgagaagttaaaggttttttttaaatacacattttgcattgtgcaggcatttatttcagaaaacaattattttagactttgtgccaaagacattaggaatgatgtgctttcatttaaagcacagacataacagatatgtattataaacaggtagaaccatgaaattttccttatagaataaaacctgtgcaagattatttcccttgctgtctctctagagtattccaattcaaaacatacattccttcctacagaaaaaagatattcagattccttagttgaaattaattagcattcagaaaccagatagcatgtttttgggtattcatgagatctctgtttgaaaaaaatgtttttaacttgtagaaatgtgttgcaacacacagatgggaagaaaaagaaaaaaaaatctctttagcaagcactgtgtgtaaaaggaatattacattttgcacgctcctgattgctctgtgtaaacagtttttgacatctgtctttatagttttcgaggagaggaagactttgttaaaagaatcatttttatacagcagtcaccatttcagtcttgctttacctgtattatgaaagcagatggtctgcatgtcttttgaatatttataactatcaaaaacaatctcttgctattcacccttaggcttatgagatgtcaggactgttctggttgaaaaaaatcatcttgggtgtttacagaaagaggattacattaagctgaaatgactatacattttccagtttaatatttgtccatcagctgtttaatcgtatttagataattgtgtaaataagatgttgtagcccttgccctctctgctgatggagcctgaaagctttaaacatgggtgaaccaccattttgtagatgctcttgctacctcctccccacctcagctaaaccatcggcaagtccttgataagttttgatcatgatatcacagtcctgttttttttgttttgtttttaaagtagtgcaaaaaacgcaagcatgtagatcatatgaaatactaggaagctgctggcttccggtacaggctgtttagtttattagggtatattgtaatatgcaaatatggtacagcactccaattaccctttaaagctgacatggttttctctttattttctatgagcatgcagagctctgagggtatttggaaaacttttggtatagtgggggttaactgttttttgactggaagctgagcaatcagtgataacagattttgctgtggttggttgatttggcagaaaagcatgaacagttttggtttaaatgattgaataacctgattagcattgttttggggtggttttttttggttgttgttaaagacacaacaaagcaattttaagggtaatcagatcactgcctttccccatctgatgaatctttttttgagaaggcctcacctctctcaaaaccccttcattggctactgagatgaacaagtaaaaaaataaaaccatcttccttcatttttaaacgtgttatagatatatacctacagtacatatgatattgtagcaggggtttaaaagaataaaattttttgaaacattatgtaaccttaaccgattctttgtggtttttgtttttcaaatttaaaagagctagagtattttagagcaaaggttcagaatgttctatctatctttaagttaggctttagaaaaattccacccttaccttttcacaattagaaaggttataaataatgtatttggctgaaaaggaagctcagcctgtggcagatggtatcattctagagtactggggtttctgtgaagatggcattctttcagatcggaacttcagcagactctcagaaagaaccgaagctcctcatagggagtagacatgtgctttatggatcttagaaaagcttacaacttggctcctaggatgagaatattgtgtcacactggggttatgagacccacagccaatttctgccaactttgaaattgtatttcccaacactggaagctgtggcctatttattggttggtgtaccgtgtagcatttgaacttggtatttcaaccgactgagttttgtcggttggtttattttattctgtgaacattgatgttttatacagaccagccactgaataggaaacttgccatacaagttgtgtctttttcaaagtgctttggatagcttatataaatagacactgagagagaactggaataacataaccaccgagcactgcaacttccgagacatctgtgtggatgtattttgaaaaacctgggaagggatctcttgcaaattaatgaacaaaggttcttgaaactatgatttctatcacgacagccaaagcgatggatttgaaagattcgtgtcatagttaagctgctattatgtttgacctttaaggggaaaaaaggggaagaggatttctggtggcttgtttcagtgaccctttttattgatcacctagtctgtgtccagccctctgatgagtccaggatatattcagatgagacctaaggcccacagtccagtgcaaaataaacagcaggatgagtgctctgctgcaggaggtttgggaagttaggaaaggcctcatggaagcaaggatgcccaggctgtatcctgaaggatgagcagctgttagctagagatgggagagggcatgggccgtgcatccaagccagaggagtggtgtgccttcttgatgctttctaccagatataggccagcttcagaaaacaccaccaaattggagtatgagaaggaaagaaatatttccccgtggtgttttcctttactattccttgtaccaacttgtaacttaataatttaatcagtatacttcattctacattaaaaagactcaaaatactgtatatcatttgaaaattttatctgatactcaaaacatagtcacctgatatgaaatgtgatcatataatgaaagcccagtgatgaggaggaggcaaaggattgtcatagtaattaatatctcttcagtctatatgtaatatgttacaggctctgtgctaattgtatcacatctattatttcctgtccaagggcagataatatgtctcttcaagtcattattttcctagtgacttgcccagtgcttggcacatagtagaatttaagtatatgctaaatgaattttaaaaatgcctgaattgatggattctcagaacaactccatgaggtgtatgctattatcattcccatttagcataggaaattgtgatggaatggtcaactatttgacccaaggtcatactaccagtgtgtgacacatcctcacttgaatatatgtttatttctattctgttttgtcagatgaacatttagtgtttatattaatgcatgccaggcattgagctagaaaataatatggtgccccagacctacgtgaactcacagcttagtgcaatctttttaaaccagtacctccttttaagtgacacaagaatcccaagcctttctaacatggaacttggcctactatctgtacatcccaccacctaggaaaattttaccaatcatgacttttttatttgtgttatcaaaacattacgtgtttttttcctgatattctaaatttaagattacactactgtatatgatttttcaaatgccatgtgcaccacaaaattctgcagtctctttcctgccattgaaaccggctggctggtctactccaatgctatgcctaagcctttagtaggaattttaccacctgaaacacacacacacgcccacgcccacacacatacacctcatgaagtggctataggagcaatctaattggacagattattgcatattgtccaataaaaatagacatgactccaagttacctgaattaggaaatatttcccagtcacccaaaagcacagaaagatagggaatccaaaaagttgctttgtcatgcattataagttacggattagccttttgatttaagtcttgcttaggctattatttacattaatcagagtttcctaagcatacaccatgtgacagaaaagcacttaagcccagaacctaccaatttagggttaagtagggtagggggaagctttgacaatgatgcacatatggatattattttccatgtacgaataataataaactgtatagcactattacatataggttctagttttataaaactatttcagacattttttcacacacaccatggatgattcttccttccgtcgtcccctatacattttccactgttgatataccaaatcacattaaattgagatgatctatttacatatctgtgttcttaatagatagtaaacttcttgtaggcagaggctgtccgccatctttggatgacaggtgcctcatctttgtaggcagaggctgtctgccatctttgcatccttactaccagccaggcatatagtaggtgtgcagcaaagagcaaatttcatatatagaactgttggcaaactggagtagactggatgtttgtcaaaaacctcggcaaaatttggatattccatacacttctaaaaagtaagacataaaccacatctagaactcatgtgtattattaacatttaaggaactgccagaatgtctagataaagagtaataatttttttaaaaattggaccagagtggaagaacatcaactgtcatccatttgcagaagaatcaccattatccatcagcgatctcaatagtttttattagtgtctgactttattgatcccttattacaagagagtaagtgagattgaagctgacagatcaggtaatcttctggctctggttttggcaactttgctaagtgtctttttacactgtggactgtgggaggctcttagtgaaattgcaagctattggattaatggcagagcatcatgaacacattaagaatgtctttttagagatataaaatgtgaaaatgactatagagagtgtcaaaaaaaaagatatcacagtgcctcttaggaaagatagctgtgttttacataaataatgcgactccagcttatccttcactggaagttctttagagatcccccaaatttacatattccagaaatgtgtgcatgctacagaattaacactgatagtggatgtcaggagaatgaataataactgaaagagctttacattagaggtaacttaaagaagataattatataaaaatacttttgtccccaaactggcttttctggttgttcactgcctcctgaacaatgctgccttctataaattatttcaccatagaccaactgatgtctgaaatgtgagttctcatgtttctgcacataggggtgagggatagattggtgctacaaaatcttactcctaagactcggtaggaaattaagttagctgttactagagaatatgggtaacaggttaatatggaccatgaatttagtcattgaaattaccataaccaaaatttgctgggaagattgaaaatgatttaaaaaaagaaaccctcctagtgattcattaaaatcatgtttttcttcatttttgtatgttaaagggctgacagttttccgggcatttattaaaagcaggataaagataagtcacaataggtcatctttttgtggtatccttgagaaatttagaagcatgaaatgtataaatttaaaatttttatgatcggtttgaaattcaaaacttaagctttactattgatgaagccagtaataagattgcagaatgtttttctcttgatagaggatctctgtgaatagtttgtttcttctcaaatacggtcagttaacctttgatcagtgttaatgcgcgtccactttaaatccaaataatagagtggaaagtgcaagttctgtttctcaaattttaatatacatgtgaatcccctgggatcttggtaaaattcagctgctaagtgcactggtctggggtagggcccaagattctgcatttctaacaagcttccaagtgatgcccatattgctggtccctggtctatactttgagtagaaaagatgtagagtccagtcaaaaaatcgcgaagtctcgtatatttatgagtcacaattataaagtcatcttcatgtatttggatttattgggaccagtgagtttgacagcctagtaatagatggcattgatggagattcaatgaatgctagagcaaagtctgtgggtttgatagctttatactggtctcagtgggctgttgctttctacttaaataagcatttgatgatctacttaatgaatattaagaagtcgaagctttaggctaaagtgtgaaaccaaaatgtattggtactcagttgattaaaaaaatacagttgccacaattgagatcatttctgtgttccatcttgtgctgctgtgtattacaaatattctccccccttcttcatgcagagtatgatttcttccattgtgaacagtacttactatgcaaatgtctcagcagcaaaatgtcaagaatttggaaggtggtacaaacatttcaagaagacaaaagatatgatgggtaagcaaaaaaaacattgcagcagtggctacataccattacgtgtcatttgggggtttatcaaagtcacatctaaagccaggtcttttgattgcccaattagagatcaatttagaatgtttctttgggggtgggaagtgggtatgagtataatgagataattaaattcaataaatgtttgtgtttaaatcagccaaactgacttggttgtcagacatgcaggaaattgaggcgttgggaggggagctgtcattttttaacaactcagtgaagacctaaccaggccttgaataactaatattagctgtgatttctttctctgataagtcttgcttttaggttttttgtttttgtctggttgaatgagaaagtgcctatttttacacccaattttaaaggaaattaaacttcttaaattaaactatttatagtttccacagtagagatcaagtgatttttatagctctaacccccagcccccatggatgggcactttgataagcacattgctttaccatccataccagaacaattattgcatcatttctgaacttttaattccaaggtagcattctatcttaacacataactttaggtgaatatttgttatgcaagaagtacactaaaattatctgcagtgtaaaatgatagataaaagttgtgtatggtacctaagcatttagatgatggcattttctctctgttgagtttgttaatgttcacaaaagcaaacactgtgattaaggttaatgttttaatttttattactgttctctttcacctacttttaccctccaaaacatatattttaaaataatataggaatgggcattatgtcctgttttaaatctatttctatttatttctttacattcatttaatttttttttaattttttaagaaaaattaatccaaattttgagcaagttttagctcttaatatttgaagaaaaaccatccatctaccaaaatggattctttgccttttatagcttaaggctgtaatgaagacaatgcatcatttttggaataattgcttgaattactgttctctgtgaatggcccacttgggctgatatcactggtagaaattgaagatttcttccccaattcttagttatattttgcgtatatcaggagctatagcgctatgataaagttcctctaaatgtaaaacctgcatatttaatgaaaagagaattgatgattaaaatcaaactagagtctacatgtgggaagtctgtgtacaatttggaaagtcctgtttatgtacagcttcatgctcagcccttccagccaagagcatcgaaccagtctcctcttcgtacagaaaagcatttacatacttagagatgatgctcagccaatccatatgaggaacctagccaaggaagaagcattcatcctgggtaggtgggaataaattgcaaaatcatgacagcctcaccattgtaccagaacgattccctgcaagattgtctttagcatctggtgatggccatagcttcctgaagaaaaaacatttggatcttagcaacactgggtatgctggcttgatatacaataaatcacttgctttattctaaaaagtatttccagatatacctactgcccatgatggttagaattaaaatgaagcaaggcatataagatattcagcaagtgttcaatatacacttattattatgcccatttttatttattacattaactacttctattcactgctgggtaaaaattgaaagtaggtgactttttatgtcatattttttcttttacacctttttcctagagtactaaagttaatgaatatcatgagaatatatttgtaaatttttttagttgcttattataagcttattttctcagctcagctcactgtttgtagttgtcattaagcaaatgacattcttttagaagccatttttaaaaattgttgcttagaagccttcttggggtaataagtgagagtgaacaactagttggaaagagtttgggtaataattgattttatgccttaaatctaaaccactttttaaaaataagattaggaatgctgtcccatttccaaagtttgtagaattgttcaggaaaggagagcaaaaacacagcctggtaagttgcaacttgaaattttcttggttttattggatttggggtgtgccctgtgcctacccttttttaatttaggaaatggttagaaatctttatcaatgccaatcattgttggctgaatgtgattttactctttgtccactttagttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcaggtcagttgtgtttcataagtggttctgtgctgtctcctattttctctttctttagtcccatctataactaaagtttattcttttacttctgtactaacattttctctctctcttcatgtgatcatattacctattcctggtggagcctcaattttaccactccttttcctatgatatacttctgaatcaagggaacctatgtgcagattgatcccaattcagggcctttgaaagactaattaaatgtcaaacgtactttaaactggcattacttatgcttttatataatggaatcataagctatagtagatggttaagaaaagtttcatgactcagtcaaggctattggcaggattccaggcttctagcctattgtcttttccatttatgttgttactacccatatcaaacttaggtatataaatgttccctcttaaagttctactgcagcgttgttgttgttgttgttgtttgttgttgttaacaccttggaagcaataatccacttaattctaagcagccattttgaaaaaatattatatgacttattaacataaaatatttgtaagctgtgtgcgctccctcatgctattgtcttccaaattcattgtctagaccaggcatcagcaaactttattctgttatcgaccagatagtaaatattttaggttttgaagcacttaaatctcggtcacactgtagagtaataaagcagccatagactataaatgaatggcactgggtatggtagtatttcagtaaaactatttataaaacaggccatggagtaagtgtggctggcaggccttagtttgcagactcatttgtagagatctcactgcctgcttatacccctaatgtgcacacctttgtcttcctggcccaattcctgtgaaggtactatctatcagcctggaagatgtttaagagggtcatggagaaaaagtgatatatatgagaggtcataagataaagatatttgagaagccctaaacaaattgactctgttgaactgtgaatgagaagaatttttttctttgtttggaaactagtatgatacgtgatatatatggtgtttatttttggcccaggtacactaaaacaaaacaaaaaacaacaacaaaaccaaaaaacaaacaaaaacgaaaaaccgcgtaactttgattagaagaaggacattatgccttttcagctcttttgttttaccactgttctttcttttgtcaatttatcttattttttggcctgactcacattttcctttcatatttaagttattttgtttattacatgattatgattatgagaataaaattctggtacagaagtaatctagtattaattcctagtttgcagagtttccatacctaggagaatcccagctgtgacttatttttggcgtgccttaactagatggggagttaggagacctgacaaagcctctaattcagtgtttgttttcagtcgattcatctttttttttttttttgtacgttcgtctgtttttgaaaaggcagttgcacaaggctatgtctcaggttaaaattgtatggttttacctagttctatatctttatagcttaaaaaactgtgttcatcattagctggtgaacttaatatgacacctatattcagttgggggataattattgaaaatgaatggctcaaaagtcaaccctctaaatattcctgtttctggtagcattctttattttagtaaatatagtaagtactaataattctccgtactaggccaaaaaaagtaggtctctacataacatttcaataatgcttttttgaattgagttaaaagcccacaaagacatcatgacatagacacaaattatatatatatgtatatatatgtgtatatatatgtgtgtgtgtatgtgtgtgtatatatatgtatatatgtgtatatatatagttactggtgtcttaaaaattgagcagttatttcttaaagcactaagtaagtgtcctttatatagtgaagaatgctaagacagtagaactcagagaagtgaggataaagttgtcacccatcattacagcttttctccttttgggtttatgatgttacagccattactatgaggagttggccatttgttctgcctttggtccttaaaaggacaaattccacaatatctacaggatttgttactggaagaaaggcaaaattttctcttttataccatattaatctctttgaaaaaggtaatcatctctgtggttaatatcaaaaacagtgacttttttttctgtgagaggagaatgaaaactttaccttgtatagcttgattgcagatacctccttattaataatagccaatttaggaaaaaaagtcattaccaaaaaaatatttagtgccctggattatgaagggtgttttaaagctttatattgataattgatactcttcagtcaaagtagatatagggccatatttgaagatgtttgacttaagaggaaatttgtatatatatttcaatattaattccttgagaactaacttttgcacatgcaggcatgaatttattttcattggtcattcttaaaaaccacacacacatacatacacagctgcatttattttttaatgattatgcattggtatgactggatgtagtgtgttgatttcaaagtgtatgcatttcaataaaagcaggtgcagagggtatggtgtgagtgtggagtatgaaaatacacatgctaatgcgtatgtatagacaaggagctctgcagagttaaatcacacatcacacatttgtgtgcacctagtacaatgtgcagttccaactccaacttttaaaacattaaaaaaccaaacaccgcatattctcactcataggtgggaattgaacaatgagatcacatggacacaggaaggggaatatcacactctggggactgttgtggggtggggggaggggggagggatagcattgggagatatacctaatgctagatgacgacttagtgggtgcagcgcaccagcacggcacatgtatacatatgtaactaacctgcacaatgtgcacatgtaccctaaaacttaaagtataataaaaaaaaattaatgtaaaatatgtacatacaaatacaaagttacatgatagggtcagatgaagatactgtttcttataaacggcattaagaccttaatatgatagaaaacacttgtatgaattgagggttattttagtcattgaagctctgtataactttaaaaccctgggtcttaggttttaactattgagaattttcttatcatcttaatagggttccctatattaacacattaccctcccaagactttcgcacatggcttttttcttaagcctaccttttctgaaaatttatggtaaacttacatagttacttgttttaaggaatttttccccttctgaattgatgggcatgggttctttaattgccgttgaagatatcagcttttagcatatgtcattcattcagttatgcctacttgatgtctttttaatggaaacctatggctaaaagtaattgccaaagcttctagatttctacttttcaattcacttctctatcttattgctatttaatggttctgatacatgcaaatacattccttaataccctttgatttttaaaagaataaaattcagagtttaactctgatcccactctgtggcttttttcccctttttcttccccctcctcttgtcttttggcacactttattttccagtaaaataaagaatgaagatggattattcaaaactgataacagtaatggaccatcatgtaatgttttattaaatttgagttctgtaaattatgtggtggagagaaatttgcctgcttaagtataacagaaattgctactgtgtttctataattcttcacagtgtaatttaagaaaagtccactatccatatcactattgaataaaaggtaaaaaggtgctattaccccaacaagacagctctctggttagcctgccaaacgacagagataaatgtgtctacttaaaacttacttggcatgaatccatggtagtaggtggagtttgaaaatagtcttttacctggacataggattaaaaattcaccaaacaacagaggcaggtagccttgaagaatattctatgtattttctttttaggagggaggtttcatcaaatcatattttcttcctgagggctttgaagttccatgaagctgataaaatctatttgaatcagtgattatgttcaaagaggagacaaacgggaggccagacagcctttttgttcagattggcagtctctttcgcttatctgctgttttaaagaattcataattagcttttggaaatactgataatatttattggaggttttttctttcttttacaactactaatgaattttacttgtaataacttgtaaactgtttttggaatgtaaaaacaggtttaggaattcagcagtaaattcattctttagttgaaaaaattagaactctgacttaaccgctatgtaatgacaatgcaaaacaattttgtgttttcatagatacagcacacatctaattattggtaagatgtgaagtcccaatgaaaggcagcttctgattttcaataaaatgaatatttatgaggtactggtaacttcctacataacatacaagttctcaggttcttttcagacacaagaatgactaatgattttgtttaatttaattcaacaaatttattgagcgccaatgattcttgatactgatgacatattttagtcctgatgtttcagcatattctatgacataaataaggtacatgatggccttttcatactattttttagcatgaagaatttttggtaaaaggtcacgcttactgtccactgtgtgggcagtactacaaatgaccttggcaagtctgtactatgtcttcaattacaggatatgggaactggtggccacatatatcttgaattcagcatataaatatgagtgcagctattcaagtaacaacaacctgaacaggaccaaaacatacattcccatatctgggatctgatagcagtcattttgcatccaaaattattctaaagtgacttttttttttaagtaattatcactaatcaaaatgttttctgacaatattttcaagcatttccaccagggggcactcccctcattgaaagctctgggccaaaaaaaaaaaaaaaaaaacccaaaggtttctgaaacacctgagactgtctacactggctgctttaaagctctttgagtgtttcagggtttgaaacatcactttataccatcaacatatttcagacgaacaaaaaaccttgttccagtagaataattaagtggtagtaaaatgctttgcccctaaaaacacttgtatgcttaaataggaagtcacaccaacatcaaaatataggtagagaacttttaaaattttctcccaagtgacataactaccttccaatctcaaccatatggaaatgacttagtcttatatgttagcaagacttgagaaagaatattattttgtatgttttcctgtatttgactttctcactatagatctctgctgcctcaggaaatatttttgatagaaatatgtgatatagtactttgttatttgggatttttaaatacctaatttcaagtttcccaaataacatcctaaatatttataactatgttttgccctaatctaatttttttaattattagacaattaggaaaaacatctcaaaaaatgccacagaacttttcactgtaggcccaacatgagtgctaataactactactagaattgactcatgggtaacacatcttgttcttaagtttctatcacctgtttgtgattgttttctccattgtggtctttatacacatgatcagtccatttagtaaatacttatcaaacatttacatgagagacattgtgctgggatgatgaaagtgaatattagattattatgctcaaggaatttgtagcatattgtgtttatactgatgttttcatgtatccatatctgtgtagttgagaatatattgctttgtcaagtacattttttaagacataacatttggtggagaggagtaaagagcaagggttatttcattacacctattttcaaactttttttttttgagacctgaatgttttactttcaatatggcacatcagaaacacagtcaaactaattaggtggccttgtgcaaattaaatagctggatgattgactgcctgtttgactgaattttagttaaattgactagatgttttgctcttgtgtagacacagttacagcattactcgttagtatcctaaggacacatgcccttcattcttcagtcacatttcttagggtaaaaacgaaagttcaggtccaatttccaggctttagctgtaagagactaagtgagagacaactttaaaatggactctgaagccctctgcacctgttaaaagttctttttaaataccagcttataaatcattttaagaagtatcagtacttttgtattgtctgcacccaactgttgcatttcggcaacatggtacattatctttaaatttgggaacaaaaccaggtttgtacttctaacaaaccatgaaaaaaacaaatgttttaaccttggggcttcattgttttgacatgacacgttaccttccttcccccaatatacctttaactgtttctgcaggatattggaaagtagatttgcaaattatatagaaatcctgacaaaattttattctgaagctgatactctggctaagtgaagaaaccaaatatgtcttactattccaagcattatttcatgtacaagattaaagagagaagagctgcttagcccttataaaatgaacagaaaattttccaattcttttatttcatattgtctcttaaatgcaatggggagaaccacccatttttgaaagagttcttccaaaagttaaaaaaattagttgaaaattgatgttctgttatttaggggggaaagacaccttaagagttttctaatgatttataaatttcttctatcactaacaatttttattccccaagaaatttgataattacagaatttgatactcttttccttggcatgctgtgatggactttcgcaatgttgaaaattagttaatatatttcaaatcttgtctatggtttttaaagttcaaaatttaaacctgttacccagtggtataatacagcaagatagtatttagaatcatttgtgataatcagtgaggttctctgaaaatggtaaattgaaagggtcacgtagtgtcatgtactttgataagtcggagtttaaggaataattttaaacattgcctgtgaaaatacagcataaaccttaggtgatgctttagtaataacctttgttctaatatgttaaaattcattttctggtattttctttgaaagttctacttctctagaaatggctttgtatctttacatattgggctgtaggcattacactgcctttgtctaggcagcttgggaactatacagttcagtgctgttgcattataaggatttcgtttattcttaacttccctggatcgtctctctgtgaaagatttcatggcaagttaagctactcaaaggaaggagaccaattaggcagtttcagtttatgttatatgtaaagcagatgcttaataaaattaagaatacaattgaggctctcttctctaccacttcagttgtaactaatatattcctatgcagaattaatgcctctgactgttcattttctaaacagagtggagaagaaaagggaaggatcactgctggccaggcaaagcaaggcagcaggctcaccctgtgcctttcatttcttgcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgcggtctccttttcctccttgcccttctttgtttagcttttttttaatgcttgaggaagaatctcaataagaaattagatagatagatacatagatttatatgtttttaaattcgtatagttgcttgaggagaatttggtcccaaatcattaattctgatataaaaacaataagctcctaattagatagagggaagaaaattgctttgtgttccttcattctttgggttatttgggggtgaaagtagtctttaaatgggatatttgtctctactgttgttattaagtaaagtattttaaactcaatagaaaaagaataaagtcagttttttcccaactggtttcagaatcgccatttgaatagtaaataaataaaaataaataatttcatttgtatttatactttccagtacgaactgcagctggtaccaattacacaccatctcatttgtaatctttcataattaagtttaataaaatccttgaaggcagctttaaatggggctgataaggaattctatccatactccaagatacgggcatgttttctctttcttaaaatttttggactttttaggaaagaaagttgccttccgggtaactttgggtatgtgaatctgtattgttttttaaactaagttttaaaagtaacctcataactgttataattcagtaaatcaatttgcattacaaacccttagataaaagtttgctagttagtgtattagactcaaaaaccacaagcaaatatattatctttttttttttttcttttgagatggagtgccgctctgtcacccaggctggagtgcagtggcacgatcttcactcactgcaagctctgcctcccgggttcacgccattctcctgcctcagcctcccaagtagctgagactacaggcatctgccaccacgcccagctaatttttttgtgtttttagtagagacggggtttcaccgtgttagtcaggatggtctccatctcctgacctcatgatcctcccacctcggcctcccaaagtgctgggattacaggcctgagccaccgcgcccggctgcaaatgtgttttcttacatgtttaacttgtgacatttacagctcttaaaaataaggtcagttaaaattggataaaaattgaacatggaagaaaaagtcgaaatattcatatgacaatctcatagtgaaattgtatctcgattttacttcattctcatcaatggtagaaagtggttatacattttcatgtatagaaatctagaaaaaactcattcaacactaaagagtgaaagtactacggatactgcataaataagaaatatttagccacttgttgagtagctaaataaactgcttatcataaggttctgaaactattactttttagaaatgtcacaaaatccattttcactagtttatttaatgaaaatcaatctggtcttgatgtctataggaacagactataaggaaatcattgctataattgtgaataaaaaagtcatgcttctttaggagaaaagcatggcatctatatacgtatgtacacacccacctgcccacgcacacaaagttattgaatttgatctctaaatgcttctataaaatatttcctaagataaagaatgaggaactctttatgtataaaaaatatgacttctaagtatggttaaagagaaaagataaactatgacttctaggaatgataaaaaagaaaaaatatacgaaatgaaataaaataatttggtttggtactttttctgtagtgtttagtgttaatacacacacttttattagttaactttgctcctgaagtcaccactgacagggctctgagcagagaattactttacttatcacttaatctgcaatactaataaaagaatggcttacttaagaccaatatgaacttcaacattgaactgcttttaaaaaaaaaaaaacatctagccagatatttgactttgtggttccttaatacagcttttgttttctaatttttctagga

SEQ ID NO: 14583 - DNA, 4695 bp, Human
  misc_feature (1)...(4695): n = A,T,C or G
attagtcatctgtgggatgagacatcaaagcactgtgaacatcttattccccggcaaccttcacgagctggtttcagcgtcattgctgaagcctcttggaaacattgattacacccgtggttccaatggtgatttttctcattccttttacattgattacctgcctccttgagtaaggtagatgttgtctactccccatgttttcccttcaaaatgtttaattttaatttaaatgattaatacagctaagttattctttcaacaggcaaatgaaaacagtagcctaaagtgtcagtttcaaccagaaaataacagctctgatttctcatggctcacactcttctgaaacgactcgggtagaggctgaggaaggccgtgttgtttgtctacctgggactagtaagtatagaaatagaattcctttgttcttaaattctacctttgactttacttttaaaatataatttctttggtacgatttagctcatgcctgtaatcctagcattttgggaggccaaagagggagaattgcttgagcccaggagtttgagaccagcctagacatcacagggagactctgcgcacgcacacacacacacacacgcgcacgctaaccgggaatggtggcatgcgactgtggccccagctacctgggaggctgaggttggaggatcatttggacccaggaggtgaagactgcagtgaaccatgattgcaccactgcactccagcctgggtgacagagcaagaccctgtttcacaaaagaaaaagaagaagagatcatctattagtgttcttgatttttgttaaaatgtgatacgtgatagttgataagctttaggcatatgtcaatctgtggccatttaattttgggctaaggacttgttctattatagcacagtaatcattttactaaatagtgactatttgtcatgaaaaacagtatatttagttttaatacagttgagtactcacaaatttctgggggaacttcgtcaggacatttcaactgagaattgtcaggcaccttctcactgataggcatgctgctcggtggtgcagctcataagcagacaacccccttcatgtaatttagtaggaaaatgacagaaatacttgtgtaactataaagtaaagcagaattctggttattgaatcacagcacctactgaaagaagttctcaagttctgactgagttctaaaattttttgaagattagaattcttcatatgtaagtaaaaacaatttctgatgacccatttctagtccatcttctaaagaagtatttaatctgggccacgcatggcggctcacgcctgtcatcccagcactttgggaggccgaggcaggtggatcacgaggtcaggagatcaagaccatcctggctaacacggtgaaaccctgtttctattaaaaatacaaaaaaggccgagcgtggtggctcacacctgtaatcccagcactttgggaggctgaggtgggcagatcacgaggtcaggagatcgagaccacggtgaaaccccgtctctactaaaaatacaaaaaattagccaggcatggttgtgggctcctgtagtcccaggtactcgggaggctgaggcaggagaatggcgtgaacccgggaggtggagcttgcagtgagctgagatcgcaccactgcactccagcctgggtgacagagtgagactctgtctcaaaaaaaaaaaaaaaaaaaataggtctcactgcacctttgcagtaattatatgaaggggtagcctgcccatccatacctgtgggtatatcttgtcaggtgggatgagagactgagaaaagaaataagacacggagacaaagtacagagaaagaacagcgggcccaggagaccggcactcagcatacggaggaccagcactggcaccggcctctgagttccctcagtttattgattaccattttcagtgtctcagcaagaggaatgcggtaggagagcagggtgtcagcaagaaaacctgtgagcctttcctttcgctgctgcggccgcagccatgagcatgctcgggcctcagaagaggctcgcctctagtgtcctccgctgtggcaagaagaaggtctggttagaccccagtgagaccaacgaaatcgccaatgccaactcccgtcagcagatccggaagctcatcaaagacgggctgatcatccgcaagcctgtgacggtccattcccgggctcgatgccggaaaaacaccttggcccgccggaagggcaggcacgtggccataggtgagcagaagggtacagccaatgcccgaatgccagagaaggtcacatggatgaggagaatgacgattttgcgccggctgctcagaagataccgtgaatctaagaagatcgatcgccacacgtatcacagcctgtacctgaaggtgaaggggaatgtgttcaaagacaagcggattctcatggaacacatccacaagctgaaggcagacaaggcccgcaagaagctcctggctgaccaggctgaggcccgcaggtctaagaccaaggaagcaggcaagtgccctgaagagcgcctccaggccaagaaggaggagatcatcaagactttatccaaggaggaagaggccaagaaataaaagctccccctttgtctgtacatactggcctctgtgattacatagatcagccatgaaaataaaacaagccttaaaaaaaaaaaacatgtgagcaaaggaatctgtgtcacaaataagttcaagggacggtactatgcctggatgtgcacgtaggccagatttatgttcctctccacccaaacatctcagtggagtaaagaataataaagcagcattgctgccaacatgtctcacctcccgccacagggcggtttttctcctatctcaaaactgaacaaatgtacaatcaggttttataccgagacattcagttcccaggggcaggcaggagacagtggccttcctctatctcaactgcaagaggctttcctcttttactaatcctcctcagcacagaccctccacagatgtcgggctgggggacggtcaggtctttcccatcccatgaggccatatttcagattttcacatagggagaaaccttggacaatacccggcttcccagggcagagttccctgtggctttccgcagtgcattgtgcccctggtttattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 14584 - DNA, 6153 bp, Human
atagcagacaatggtacattgccttctaatcctaaaagacaaccgttttcaacctagaatactatagtcagacactggcaataaattgctaaggtagaacccaaaatactgtgacatgcaagttacaaaaactcatgtcctagatgaagttcctaaagaggctgctgcaggagatacactactaaaacaaagaaatgaaccatggaattgttcattataaatagaaagttatggaatatagaaaacaagacaaaaagagaaaagtgaaagaaatgcccaggagggcttagaagggagaagcaagccagtcatggaagtcaaccagaccagaacaagtcaataggctgtgggagaggtttttcaaaatgcagaaactgaaagaatatctgatgtatccgacaactggacatttagacaactggcaaagaatttgtgataaatgcaaaagtaagcatactaaaagaaaaaattctagacaattagagaaaatctagggaatacaaaatgtgcagaaaattaatgttccattctgaatcaagaaataacaatgttatttatttgtggagctgtagaggtaaatgccaaaatgattaacttaactaatagaattgaaaatggttaacttggagctggaagatgagaatgtcagtgtactctgggtgtgtagcaagccttgaacaaaccttgtagaactatttgactttttaatccatgtagaattcatgcatgcatgtagaactctgataaaaaaataataaaatacatttaaaaaccaacctatggatatttaaatcatccagataagaaatcctaataacttggactaaggtaatgagagcagagatagtggagaatgcatggatttgatatagaggatgaggaataatgagttgtttgttaagggtagcttttaggtttgttcatgagcaacaatgaaataaataacattagagtaagaaaaacagaaagaagtatatgagttttctttcataaatgcttagctagaaataacatggataaattgagtaataactctgtaaaacattctgaaacttaaaggaaaatctaggctggcaaaaaaagcagaagtcctgagcactgatgtaactcattaattatgacatcagcatttggaatgatgcacatgtagagtcaatagaaaaaaatagcaaatcaacagtctttccattagctgcttacaaatatatgtatagtctccttccattctgtcccttccatgcacattcttcctcctctttctaaacctttggcctcttctccagggtctagttgtttatggtcctcaaagtcataaaaatggtaattcttggcaactcatgatacaatcttactgtccacgctacaagaggacattccagtgtttaaacttcagcttggagagtaagtcaatagcatttactcatcaccttgatgaccttgatgcattatgggtttaataaaggatattttcggccgggcgtggtggctcacgcctgtaatcccagcactttgggaggccagggcgggcagatcacgaagtcaggagatcgagaccatcctggctaacactgtgaaaccccgtctctactaaaaatacaaaaaaaaaaaaaaaaaaaaaaattagctgggcgtggtggcgggcgcctgtagttccagctactcgggaggctgaggcagaagaatgatgctaacccgggaggcggagcttgcagtgagccggcatggtgccactgcactccagcctgggcgacacggggagactccatctcaaaataaataaataaataaataaataaataaataaataaataaataaataaaaagtatattttcccttctactcaattatactagactcccttcccaccactagcaagaatataaagaaaaatacttgtgggatgggataatggggactacctttctgttaaatgacactaaaggctgcaagttaacctagggtgaaaatttacattaagaacaaaagaggggagccagcctcgggaaggaagcgcctgtcgcgagcgcgagcttctgagctcgatgggccgagctggcagctggttggtgcttacaccttggccgcagcggcaggtccctccacgtgctttcggcggcgacctggagctggaggagtcggggatccgagaggaatgtggcgtgttccggtgcatcgcctcaggagagtggcccacgcagctggatgtgccgcatgtgatcactctgggacgccgcagcgccggggtcaggagagtgctggtattctgactagtgacgggagttcagcgccaacattcaaatcacacaagggaatgggtcttgtaaatcacgtctttactgaagacaatttgaaaaaatgacatgtttcaaatcttggaattggacacacaaggtatgccaccacaggaaaatgtgaactagaaaattgtcagccctttgttgctgaaacactttatgggaagatagctgtggcacataatggccaattggcaaatgctgctcgattaaggaaaaagcttctgcgtcatggtattgatctgtccacaagttctgatagtgaagtgattacccagttactggcgtatacccctcctcaggaacaagatgacaccccagactgggtagccaggattaaaaacttgatgaaggaaacacccacagcatactccctgcttaaaatgcccagagatgttatttacgcagtatgagatcattatggaaatcgtcccttatgcgttgatcgtcttattccagcgtctgatataaatgacaaagagaaaaaaacatcggaaacagaaggacgggtggtgtcttcagaatcttgtagcttcttatctattggtgcaagatattaccgtgaagtcttgcctggagaaattgtggaaatatccagacgtaatgtccgaactcttgatattatatcaaggtctgaaggaaaccctatggctttttgtatctttgaatatgtttattttgcaagaccagacagtatgtttgaagaccaaatggtttatacaataaaataccgtcgtggccagcagctagctattgaagcactatggatgcagatttggttagctctgttccagaatctgctacgcctgctgctcttgctcatgcagggaagtgtggacttccatatgtggaggtgctgtgtaaaacctgatatgtagggagaaccttcattcagccaaacatgaggttaagacaacttggtgttgcaaaaaaatttggagtattgtcagacaactttaaaggcaaaagaattgttcttgtagatgactcaattgtgagaggcaataccatctcaactatcataaaattgctcaaagaatctggtgcaaaagaggaacacattccagtagcttcaccaccaattaaatatccatgcttcatgggaataaacattcctacaaaagaagagctcattgccaataaaccagaatttgatcaccttgcagaatatctaggagcaaacagtgttgtgtatctgtcagtagaaggactggtttcatctgtgcaagaagggatacagtttaaaaaacagaaagagaaaaagcatgatattatgatccaagaaaatggaaatggtctggaatgttttgaaaagagtggtcattgtacagcttgtctcactggaaaatatcctgtagaattagaatggtagctggtagggttggatgtgtgtagtttcaagatagaaaggtggtcaagaagttatagtggtcacacctcatctatttactgttactcagttggtacaatgtaaaatgccatgcttatgtttacctttataagttttgagattttttttttctgaaaaggataccaaagtgggataaccaaccgaacatttctaattgcatataatacaacaatatgtggtgttcttttttttacacaagcattggctagcctttttaacctggtcagagaaggcaggtggtcactgacatttgccatgtccatgctttaaagggtttgcaagaagttagggttaaggagaggtgatgccaacaagacaggtgagttaaatgtaacatttcacacaaagtttgaatagaatacattatacctcataggtgtctagcttgtaaagttctggctgtagttatgaccttggcttccctgtctaactgtagacaaatctttaaaaacaaaaaacacaaaatataatctgtggtgcctcagtttccccacatgtgcaatgggatacttattagactaaataattaataagaatgtgaataagtgtcatacttttgtgatttgagtcatcatttcacttctgattttaagacagctcatgattgttagctttcggaaagctaatgattattaactttttgaaattagtttacaattaagatttcattatgatggaaggagatataattggcagatctttgccatctctctttgagatgtcctaaaaagggttgtaaaaatctgtgaaaaagtttttcctacatttgattagaaaatgtgatccacagtatttagcgccctgatactataagctcagcaagtaacctagtacgtttgaaataaaaaccaaatttttagaataaaacaatccctttatccttaatttaattaattatcatatagttttttaatgaagggcttgatcacttgcaagcatatatacatgtagatgtacatatacatgtacacatacacataaatattattgcaattaagtgatcaagtacagacacaataggggccagttttgtttaaggatcaaagagtcaaccactttggggagttagtatcaacttataatccaagtccaagtatcatcttataatcgcttttttctactttattaagatctaatgaatttgatttcttttttgaagttttttcttgtaacatctgagatttagaagtttaagatgaccccaaacctttatgtaagaatttttaaacataaaagtgtttgtttctgttatgttaccataatttgatgtatatagtgtccagatccatttagaaatttaatattaataactgaaactgcttgtcttcctttggtatatagtctcacatattatattatagcagaccaagataaaattttgaaagctctttaagcccacatgcagcagtgggtcagacaaccctgtggcagtgacacgggcaaattggcatttgaataaagccctgggaccacttcaacatgtgtagcctcttgtcttaaatgtattccccatggcagcatggaggaggtaagacctgtgggtcaattttgaactggacttactttgatttttaaaacaagaaactcagggaaagtactaaaccaaaatctctgattttactttgcgttttctgtagtttttgttttactgagatgcttttgtaaaggaaaataatactgtgacagttcagtaattctacagatttcttaatatttctccatcatggccttttacttcacaattttctgaagtctgaattcaatttttttttaccaatttaatctcaaatgttgtttaactgctttaaatttatatacgtagagtattataaactgcagagatgaaaaatgtgttttcaagggatttatattgtgaactgaagtaagcctactttttgtgacttatttgtgatgtcttgttgataaatatgtgtaataagtatgtttaaaaaaaagaacaaaagaggttataaaaacaaggcctataaaactacatttaaattttggatagaggagaagcagaaaaattgtgaaatagtggccaaagaaagagagaaggaatgctgtgaagatttagtgttactgaagccaaagtaagagagagtttctaaatggagaaatcaactatttggaaagtgatgggaggctgtttgtaaagtgaatcactaagaagggaagttagatttggcaaaattgtgttagttgatcattttatgacacaggttaattggaataatacaagcattggtgagctcgtagcattgttttgatggtatctctgtcttctcttctcgctctctctttagacattttgaagtcttgcataataattagtcaaggctcagcatatccaggggtcatagttagtattgagtttaaaatcaaacgtattaacccctacatttgagttttccccttttgtaattgaaggtaaatagcttaaactg

SEQ ID NO: 14585 - DNA, 26502 bp, Human
gctgggccttccacctggaatgtccatcccatcctgtactgagacttcaaagcccaccttcctcctccctcaaggcaacacagagccctagagaaccacttgcttctcttatcagagagcctgtcaccctacactggcaaggctagctgatcccctagaccaatagcaggacgactctgacatagggcagagtttgccagcccttttcttgtgagcccctggattttcacctgcttcatcaaaaccctagaccaggctgggccaggatcccaagggtgatccagggtggccataccatcaggctggggcagcatactcctacctggcaggaggaaaagtgggccaccataatcacccgtccagtgcccatcctcagcctgcagccccacgtaaaatgtcatcccgttcagagccccctcaaaggcggtgtgggctttgggcaagtccttaaagtaattcttctgcaaagagatcgaaaaaaaaaaaaagagatagctgacgggactgttgcccggccagaggaaccctcttcacatacagcccaagtcaaaacagtgaatgtaaattactttaaaagtttcagctgtttccatcaaaagtctgaaactctttgatgagagcatcacacctcagcaaagtaaaagaacagctgcacattttcgttgctttatttgccagtcatgtattcttcacaacttctccaagatgtctggaataaaccaggcacccagactgtagggtggggcacgggtgccgacctgggcctgggactcgggcctctcaaagagggcccaaggggcggcacagcctttccctcggtggccggggctcggcaggagaccctgtttacactgcagactctgacgaccaaaatctcttacaatgcacacaactaagacagtggatccaaacactttttgtgaataaaaacaaagttacaactatctttgcaactctcctataagtcaaaaattatctcaaaataaggtgctaaaaaataaaacattaggagtctcctatgcgtggtttagagatgaaggggctgaagcggaggggcccgcgaacgcagttcccgtgggcgctcgccttggggatgggcgtcgctggccgggtcctcccacccgcctttctgagagaaaacgtgctcctcacggctcacccctcagggtcccgagctcgctgacgctccgcggaagcaacttacggtgtccagccccagggcgtaggcttccaggccggtctgctcgcggccggcgcgctcgtcctgcaggtaggtccacgtctgccggcccctctcgcagttgagtcgccagcggccgaggtcggtggcgggctcggtcttgtaggggccccctcggcgccgcagacacctgaggaccaccggccatcagcgacccaggccccgccccaacgccggccgccggcccactgccccagtcgcgctctcctcagcacctaggaccaccccgcattcgtcaggagcccggggcgaggggactcacgtgccctccgtcattgctgctgcagtgctctacgccgcccactgccagctgccagatgtccgcacccgggacctgccgcccagccccgcccctcccgcccctcccgcccctcccgcccctcccgcgcgcactacgcaggcgcaggcctcggcaggcgctcaggcttaggtgggccgacgcccacgcaaccaatcagagcgccgcgagcgtgaccccggggtgtgccaggcgaccacagtggtggagcgcttggtgccccatgcggcgtggggcggggcctgagggagcggggatggtgggtgaaggcgacgggacgggggaggcgggtggggccttattggcggggcatgaggggcggggctggtgggtggggaggtgggggcggggctggtgggtggggaggtgggggcggggcctggtgggtgcgggtgggggcggggctggtgggtggggccgaagggcgggggcggggcctctcgcgcgccctctagaggcttgcgtcccgggagcccggcctcgtgcgccgcgctttgaggtgagcctctctgagaaatttgtgaggagggtccagccgcgggtcggaaggaaggacgtggggagcgaggctcgagcgagcgacagcgagtgcgaaggtcgggtggcagggaattgctctcgcgctgcaggatttgcccggacgccggggccgggggtgggggcgggaggccgccctgaggtgaggtgggcgcgggccgtcggctccagtgcgagaccagggggagggcggggcggagcggaggagccgagggcgccgccggcgtccctgggaagctgagcgccgcgtagcttcgccggggggagtggggtaggcgcggtgaggccgtgggcccccacacctggcggaccacaggggccagaagccctggagccccgccagggaagggctgcgtcgctggccaggaccgagcgcggtagagcctcagctgctcacggggtcgctggagttgggggtggccccaggagaaattaaaggtgaaaagccttagcagcagagggaagaggaagatggaggcagagcgagtgaccgaacttggaagggacagccgggcgcaacagggcagggggcgtctgactgttggaaacatggctgacgtctggaggctgcagccagtggtccgtaagtcaggtcaaggacccacagaagaccccagcatgtcttcacctggcccacagaagccctgacatccagttacaactgccccagcctagtgagcatttcggcacccactcctcaattcctacccccagcctaacttcgaaggggcggtgagccacagcaagccggaggagaaagttggaagagagagtggacaaaagaatacccacaggcaccttccccacagtggaatagcggggttttagacaatcaaggataatcacctcttcctatcccagttcagaaacggatgaaaaagacacagcaataagatgggtgggtatcaaaatatcagctttgccacaaattaaaaacctagcttgaaggacaaggcttaaatctgcaagcaagagggcaagctactaaatcacccgtaagtcagacaaacatatcccccagcctctaggccatgaaactgcctcaccaagcactatgcaattgagtgcccaccagaagacacccctccagtcaacccacagaccccagaaagagtacccagaggagcctgagcacactccaccctatctgttctctgaaattcaatcaaatgagtcactctacttctctggaagcagaaagaggctggaagtttttctccaggtaagttcctccatgtagaaacatgaagaatagggataaggggcttcagcctggatggaatctcacactgaacctggcaaagctaggtgagggaagaggtttcaactggataagagtttgagttttgatatcttaatggactggactttttatgagtaaaataatccgctctttttaatgtctgaaagaaaagaaaaagctgtaaactacgtctgagaattgacacagttaagcttctaggggcagtcatgagaaaaaacactgttcctatctgcttacatactactgcatccagcttattcattaagccagatacagaaggctctgaggattttggcctcaacaactgggtatatggtggtggtcatttactaaaatagaggtgtcttttatttatttagtgacaggatctcagtctgtcacccaggtgggaatgcagtggcacaatcattagctcactgcagcctcaaattccagggctaagtgatcttccgggctcagcctcctgaatagctgggactacaggcgtgtgccaccacacctggctgatttttttaaagtttggtagagacacggggtctcgctatgttgcccaggatggtctcaaactcctggccacaaggaatcctcccacttcagcctcccaaagtgttgggattataggcatgagccaccacacctggcctaaaatagggaaagtttgattggaaaattcagattaaagtggggacaagttatactagagatgcttattagacattcaagtgaaatattgagtaggctggcattcaggagagaacataatgctagagataggaatttgggagtcatttgctttcaggtagtatttgaaatcatgagattggacaagatgaattaggaaatgcacataaaaaagagaagttctagaatgagccctggggcaccgaccttttccagtatagaggaatggccagagagaggaggaaaaccagaggaatatgaagtcataatataagtgaagacatggtgatctttgctgaggctttgaagggattgcaaaatgaagacagaatttattattggatgcaacaaaacaatgtattggtgactgacaagagctatctaaagagacatggggggaaaagcctaatggcagaattttgaaagaaattttcagttaaacatggcagactgagcataaacattaacctccatttcctgcccaaaccctactcacataaagtaataaaagaccaaaaaaaccccacaaagaatgggagaggagacactagtaagcaagagaagtcaacaaaattatagagactgggaatggatggagaagtgataactgagttagctagagaaagttgagacttacgtttgtgggtgaagccaacaagagaccattcctgccagcaaataccaggaaggtgcagaaattggaataactggtggaaaatttttgtgaggaacagtatgaccatagatcccctctcctacttgggtggaggaagtctccagtagttgaatcagagtaggtgttacctcaggcatgaggcatagctgaggaccactgaaagcagacagattgagttaaagtctacacatgtgggtccaggctcacttctcccacttagccagatagcatgagatagtgggaggatccctctggagcagctggcccacaagagtcctgcaaacactggcaactatgacctagtagaaaaacaaacctattagctggcagactgtacccattgacagtttccaacaagcaccatcatcagcatgagccagacatttggggaaaacagtgcaacattacctccagccatgcaagtgatccatcttggaccactgacccagtcaagccttcagatgactataacctcagccaatacctgactgcagctgcatgagagatcccaacagaaagctgcccagctgaatcctcctcaaatttaagctactatatttggggtaatttgttcaatagcaacaaaaaaactagaaaaaaggactacaaagtgcccagcacaataaattgggcaggggttggggagggaatggggaggcaacatatgaagtaatgtcattgagaaatttgagaacaccaggaatagagatgatctcaaaaatttccagcaacaaaaaaagcaaaaacacaaaggaacgatttccaatctaaaattctattctcattcaaatgatgaatcaaacgtaaggatagataagtccaaaaaacaaaaaaaaaccatttctttactctcacaacatccttttggcaccagatgtagagaatttctccccaccgacaagcaagcattcagctgtacagcagacaccagctgggtatccgcttcaatcctgcaccgtctacctggagatagcagcagatcacacaagttgaggactctgtgccgcaagactgagccccatgtccagtgtcaatcacaagccccaggttgttttacctgtccttctgggttcccaagaccccttccttggctttaatttacaagagcagttcacagaactcagggaaacacatgtttattacaaggctattttaaaggctacaaatagccagatgaaaagatacacaggatgaagcctagaagagtcccaagagcaggagcttctgtctgcaaggagttgcgaagtgccattctctcagcatgtggacgtgttcttgtccaccttcctggaagcccccacacatttggctatccacaagctctctgaaccctgtccttttgggtttttaggagccctcattacataggcatgattgattaaatcattggccactggcgatcaacgtcactttcagtccctctcccccaacctctgggagtttggggggtgggctgaaagtttcaacccctctaatcatgccctggtctttcagatgtccagtccctatcctgaagctacataggagctgtccgccatcagtcatcttactagcatacaaaaagacatcactttagagatctcaaggattttaggagttgtatatcagaaggcagagacaaagaccagatatatatttgataatattacagtagaaataaagacattttagatattcaagctcaggaggctactaaaggacaggctccatcaagaagagaaaaccaagcaagaggaaaatatgattcagaatccaggaaatgtccaagttatggcaagaagacagggggttctcaggaacatctcgaagagaaagtggagcatattacctgatgcacatgactttgttgggaagagctttacatttagggcagcgacttttgggtaaagtagtgacaagagcatagaaaaccaagcaaatgagaaaaacaatgtaattaactccaggaaaaatcaaaagttgtacctaaaggaaatgtaatcataaaccaataaagggctcaacaggaaatggtaaacatacagttatactaaactgtgaatgcaggtttcagccaatatcaaactgcttagggagactaataggagaggaaatgtgggtgtcgagggtgggggtgataatatgttgtgggaaagacagtgtaagagaagctaactcctcttccattgtaggaagtcaacaatgtcaagtcaagattaagaaatagcattatttaagtctttacatgaagctaatcactaaagatccctgagttgagtagtgtgtgtttggagaagcagggattgatttggtggaggaagaggttctcttcttagtgctgttgttttctcagtgaaataaggaggacatgatctaagaatgttggaggtttgaagagaatgagaagacatgaaatagagtctggggatgtaggattacagtcaggagatgctgagtgccagtttaagattggtggtcatacgcaacatcaccaagtctattaatacctctttctgtatatggctcaaattttatcccctctcttcacaccaattgctaacaaactcaggcttattccctttgaatttcacctggatggctgcagcacccacctctcaagattcctgccctacatgccattcttaaaagaaaatgtgaccagatcacttctctgcctaatcttcaacaacgggttctcacagctctcagaagaaggtgacaagaatctctgacctcaccctgctggcctgttcccctcacctggccacacaaccaagctggtacctccacgctttcatcatgtcctctcaagtacactgtctccagctacacccctgcactcctctccgggaattctgtttctcctctacccaaccagaccctgttccatcctctgttttttccttgctaccaattcaggcccacgcctcatgcacattctctgagaattatgtacataagtacctgactctcctggatgtaagctgggtgggcttagcaggcagaggccctgtgtcttactttatctctgcatcactgatgtctggcacatcaaggactgcaagtttgctgagagaatgaatcgccttttatacatggaaatgtaagctctaaactgcctcagagcatatgctggtgggtgacaatctgaggaggtcatgaatataggagaatattgaagaggtcacacaggggaaacaacttttcattatgaaaaactgggagactgacatttaaatggtttatctgcatgattaaattaatcacatttccaacagtgcatcaagcatctgagaataacattattttgagtaaaaacagaaactcttcgggagagaccccctccccacaggtcaggctgctcaaatgtccaccatgtctagcagcgcagagagatggagctcagaggcaacttcctcttcccttgaactccggatcagcctttccaggtgctttagtcgttcgcctagacacgttcctgtcgcctctgacagctgcagttgctccctcatcatgtcactctatttgaataaaaaagaaactgaacagttttgggatgtcaataaaccacgacctatctctgggaaggtactagatctggatcatgttagaaacctcatctgagtagtcatttatttttacagagggaaaaaaattatcctttgtatatccttccagcctcatttagctcgtacattcagctggtatctgtatatagactgtttgcctttgtattctatcatgaacaatttccagtgtcagtcatttttcacccaggctggaacgcagtggtatgatcggagcttactgcagcctcaaactcctgggctcaagtgatcctaccagctcagcctcctgagtagctgggacaacaggcatgtagcaccatgcctggctaattatgtactgtagagatgagatctctttatgttgcccaggctggactcaagctcctggacttaagcgatcctccctcatcagcctcccaaagtgctgggattacaggcatgagccaccacgcccagccagtcatttttagaaaatatcatcgtcaagggctgtgaattattctatcacatgaatgtgttataattgtttaatcagactcccatcttcggatatttattctgtttcgactttcatacaataatgctacagtaaacatttttatacattaatttttggggaatatctggtaggtcagaattctttaggttagaattggtaattcaaagggtatgaatatttttaaagtatttgccaaactgatgaatggaaacagtacatcattttaatttgcttttctcctctattgaaggacttcctaaagccagtccaggagcacagtttttacctgttcagtggcacatatctgtgattgaaactctgtttttgcatctttaaccactgaaggaagaatggtaaggtaaaaagaccttaggctttggagccagttggatctggctttgaaaagcaacctgaccactcactacttgaacactcttgggtgaggctcttgacttctgggagcttaccttcctcattcattagttttcctcaggaaaaattaatcccagaagagaggtctgggtaatgccaaagctcagacaatatgtgctccaacagaagctgctgtcatcaccttaatgcccttaattacacatcagcacacagttacaggtcttattcagttcttaagaatatttcaattctattcttcatttatttcgtaggcagaaactcaaaatcagttgggtctctttaacaatgatatggataaagtttaagaaaaggtctaatttgagctaataatttgtcggtcatcaaaacatcataggataaatcgtgatattacttttttccccagccattctctcaatctttaattcttatgtaaatgccaaatgtatacgttcttctcacctgtgggctagtagttacagatgttttcatcacaggttcaatagtgtgagaaagagacactagagtctgaggaagatagaggggaagggaagttaaatccgtaaatgctcctgagtcttcagacaaccattgctgaagctgatcttcaaacctgaaacaatatgtaataaattcaaaaatatttgagcattaggaagttaactattgttcattaatcttctatatatacttaaaaactttttaagcctttgcttttttaaaattttatataattttttttttttttttttttgagacagagtctcactctgttgcccaggctggagtgcagtggcataatctcgggtcagtgcaacctctgcctcccaggttcaagtgattctcctgcgtcagcctcctgagtagctgggattataggcaagtgccactgtgcccagctaattttttgtacttttagtagagatggggtttcaccatattgcccaagctggtcttgaactcctgacctcaggtgatccacccacctcggcctcccaaagtgctgggattacaggagtgagccactgtgcttggccaattttattattatttttttttgacaaggtctcgctctgttggccaggccggagtgcagtgttacaatcttggctcactgcaaccttgacctcccaagctcaaatgatctcacctcagcctcccaaatacctgggactagaggcgcatgccacccagctaatttttgtatttttttgtagaaacgggattttgctgtattgtcaggctagtctacaactcctgaactcaagtgatgtgcacacctcagcctcccaaagtgctgggattataggcatgagtcaccacacccagccttaagcctttgctttttactaagaatataactaagttatgacatcaactgagaagcagaaatgtacttattaaaaatttaacaacttcctatgataaagcttaatttaaaaaaaaaaactaggctgggctcggtggctcatgcctgtaatcccaacactttgggaggccgaggcgggcagatcacctgaggtcaggagttcaagatcagcctgatcaacatggtgaaaccccgtctctactaaaaatacaaaaattagccaggcatggtgacacgtgcctgtaatcccagctacttgggaggctgaggcaggagaactgcctgaacccgggaggcggaggttgcagtgagccagatcacgccattgcactccagccagggcaacaagagcaaaactccatctcaaaaaaaaaaaaaaaaaaattagagaaaccacttccctttaatttataaatccaattccaatttatatttaatgaaaaaggtggtattaatccaaaaacaactgcttcgatgtgttacttaacattacttgtaattgtcttgtttggcttatcttatttaatttactttggttttatgcatctataattaattcttctgacattttccaaatgagtggattgctgcttatagcttaaaattaactcaaaataatatcccactgccacctaacatactctagagctgtctacttccatataccggtcttttcaagaaaaacaatcttggccaggtgcagtggctcatgcctgtaatcccagcactttgggaggccaaggcaggtggatcacctgaggtcaggagttcaagaccagcctggccaacatggtgaaactgcgtctctactaaaaatacaaaaatcagccaggcatggtgatgggtacctgtagtcccagctacttgggaggctggggcaggagaactgcttgaacctgggaggtggaggttgcagtgagtcgagattgtgccactgcactctagcctgggcaacagagcgagactctatctaataaaaaggaaaaaaaaatctcatcccaaaccacttaaattatagagactgattttagtaatcggacacattcattcacccttccaaaacatattcattaagcctcctccagatgctaggcatcattctaggtacaaggaatattgcactgaaacaaaacagaggccctgccctaagcaatttatactttagtgaggagagacagacaaggaacacataacaagagaaacatggtttgaagatgagaaagacaaagcagagccatggaaacaagaaggtcggagatgggcaagcagggcctaacagaagcagacatttgagtagagatctgaagtgagtacaagatcagccatggggatgctggggagaatggaggggctggacagtcctaggcaaaaggaacagcaaactcagaggcccaactgtgaactgcctaccatgctcaaggaaggagcggaggtcagagaggaaatggggggcagatcactcagggccctggccacccctgcaaagtttgcctttgattgcaggtgaaagagggaaaccactgagaggctgtaagcaagcaagtgacacgacctccatcttaactcacttgaaaggcacccaccaggtctaccaagactaaactgcagcctactgtaataatccagaaggaagatgatagtggcttgagccacgtggtggccatggaagtcataacaagtggtccaattctgaatgtattttcaatagagccaataggatatgtgaatgggctgatgtgaggggatgattccaaggcacctgatctaggcagctggaaggatggagccgccatcaacagagatgaccaccaaaggaaggggttggttggaagaaagccgggaactggatttgggatatgttaactttgcagtggctaccagacatccaataggtgtctaatgaagatttcaaggaagcagtagcatgttcaagtgtggagttcagaggtttgagatacaaatttggagctgtcagaatagtgatgttacttaaaaatccatgaaactggatgaaatttctgaggagtaggtacagacgatgcagaggagaggttgagagaatgaatccagggggcagctgggggatgaggaggaaccagcagggcaggagggggaccacggacatcctaggagcaaggaggggaggatcaagtatgggatgctaccaaggactgggattcacggtcatgttcaaccctgggccttcatccccatgggaaagaaggctgaagaagtgagtatcacaagcgtttttgaggagttttaccattaagagggcagaaacatgaagtggtggctaaagagggaagtgggaccaagacagggaggcatgtttcatgtctgtgtgctgctgatgggcaccacctaatatggggaggggtggtagcacgagagagatactcattgaatgaatgtccttgggtaggtgggagatgagatcccagcccagggaagggctgactgactacgagctgcatggttcgtttccagcaacaagaggcgtcaggaaggggatatagggaggatgctggatgtggctgggagggcagggaaggcagaggacaacctgtggaaggtcccttattcctgattctactcagtaaaatggtaaacatggccatcaaatgaaagcaaaggaaaggtatgcatgggagggagggaagtgggcaatgtagaggaggggcagccccagctcctgtccattcacagcatgggatgatccaccaatgcctcaggctcccaagggcagggtgcctgtggccagccatagtgttcagcactcaccatcttctgagcagacttaaccacatgaatttcccagaaaaacttaacactgactttcaataataaataataaatgaaattcacttcaatataaacagttagaaacatactatctagggcactgcttctgtcttcaaagagcttttaaatagttacatcactaaaactgttgctaataatccacctgcccttctccatcctggctgtcttatattaatcaagcaataaccagtctcccctcacagcataaagcagactaaacacacatgaattagaaggaagtgggcttcacctcttgttctcttctttctccagcagcagactgctcgacaaacactgcgccaagagctcctcagcagaagctcctcgcatcagatcctctgtgctgggaatcctcccctcttgagcacactctgtgctcctcttccagttacggtgcatgtgaagcaatggtatgggaaaattgtttgcagaaggatgaaaaggctttattgccaaactgtaagtacatgatttgaaatgtttatggtcaagagaaaatatttctacagcatcatgtaaagcatgtagatacatttgcacatgtgcattaacatgtaagaacatgtgcctcagacacatgtgccctcctggaacagctcatgctggccccatgcctgcttccaagcttccatcaagtcagggagtggagcaaagagggaaggcagcccctgcactgtagggacccttatgcacagaggcattgagactgcctgttcctcttggaagcttctgctctcaagaggcagctaggtttttggagtttctctgcttcatgtcttgcttcccaccctagggttccagattctgttcttccctagtattggcaaggttttttatagatagctcttggatacatttggaagtaatgtttacaaatggtgagagagaaggcatctgacatttttttctaaacacatgccaatgtttgtcttttccccactaatttcaataatttggcctaacacttttgtcacatattctgactctttattctgatccatttatctactctggcatccccacatggttttaagtactggagctttactgtatgtcttggtatcaggccaagcaaaccatgttagtcttatttaaaactttctcagcaattgatgcatatttgtttatcctgatgaattttagaacttaccagtactgacatcttcacagcattgtatcctgtcaacaacctagtctgaacctcaatggttcaggtttcctttgcacatacaggccctgagaactcatatgttaatgagaaagacattccgggaaaccaggaggtgaggagaccaaggattaggctccactcctattatgaagatgaacagtttttagagtatcatggagttggagaaggtacttcaaggatctctatggggaacaagaaggaacagcaaagttccaccatcctgtgccctttctgttcaggtttattgttgtgaatgagaatttttttttttttaacatgttgtggatctatctatctgatcaccttattgaactgagaatggttctatggacttgacttttcttggactgacaactgtactgtctggaaatgacagtttctccttcctttcagtatttgtgcctgtctatcccacatccctgtactggtcaggatttccaggacaatagtgaataatagtcgggacaacaggctggttctgattccactgttcctaacattctaccaagaagcatgttttttttctattttggtagttttatgttaggtagccttatcaagttaggactttttttttttttaacccaagctaaagaaagtacccaaaataaagaaattttatcaggaacaggtataaattttaagaaacgtatttcaacgcctgctaaaattaccacttatttttctattatggcaacaaattacattaatagattttcactgttattgtttatcctgggagaaagcatacttgtgaacttttttaggtactgtgctttggaaccaaatttggaagtgagatgaaatgtcagctgtactctcctggttaggtatgatttcagggtcaggtatgcctgataaatgaagtgagatgctttaactttgttctagaatagtttctactgcatgggaatgatctgttccttgaggatttgtcacagtctgcccacagtggactggatttggcatgtaggatgttaatttctatttactttgcaagaaaaatacagtttagcaagcaacagaaacatactgaacatgaacctcaccgtccctctctcagctgtagctccttctgcgtctgcaacctggcttgttcccacgacaaaggaacatcatattttttcaaatcgtttttaaaaaaatacacacatatctgaccatcttcactcagcgcctctgagaaaacaatacaaaaacagataaagaggccagcctggccaaccctgtctcaaaaaaaaaaaaaacacacacaaaaaaacaaaaacaggtacaaataatatttaaacagcgacaggtggcatgtgcttaaattcactgatttaagtgcaagacctttgattaaagtcacacaattatgtgacttccacacttgggttaaataggctcccagggtccatgcatcactcaaagtccagacaagcttacatcgagactggcagggccagtaatgactactcaaaagccacaaaatcctctctaagagccatcctagggggcctgtttcagggaggtgagttcaggctctaccagaaacttcctagcctgtctcaatgtttttaagtcactcacttgaagagggaagtcctaaggaaaggaaggatagagacccaaaagaaaagcagcaacatcaactaaacatcttcctttgcagaaactggaccaggaaagtctcgtgaggagctgatcccattgcatcaagctctaattacctgatgtaacaggaagccgggggggcgtccagtctctcagcttgtggttgatacacaaggcgataagatcatcccatgggatctccatgaccgaggggcctgccccatggactggggagggactcttgctcttccacctacagtaggttctgtggagcaggttctccacctgggactggaggacaggctgtgtctggcgtgagctggggatctgggaggcgtactggacaaccatggagcacacggggagccagggggctggggagaaagtgcctcattagttacaggtttggccaaaatacaggtgaaaatgtacatgaaaacattttctcaggagaaggcaactgtgaagttgagaagtctgctttctaaacacagcagaaccacagttgttgagggggaagagcagcttgctcccagggtctaggtgagggatgcagacagtcccccttaacagtgttgctagccaagttctacccagaagttctgactgtacaggcctgtggttgtgcctaggaaatctgtattttaacaagcacccagatgagtctggtataagcagtcttagcttattttggggaaccccaacctaaccagagcaccgagggcttgtgctgagtggtttgcttccctttgggttccttcaataatgagcatgagttagacctactacagaccacacaccacaatttagaagggcgcctgaggcccaaaggggagtgtctgtgctaatgccacaacttctgccagataagcagctcattcccttctgagtgcataggaaggagcagccccatgccatactgggcttgagccagccagatggcctgtcggatctgtgtcaaaacagcccaaagacctcagccaggaacaggggcacagccagagccatagaagaaggcctctttgacaaagaaagaatgttaaatcagcactgagtgccatggctgcggcttggggacagggctacatggtccccatgctctttgccccttgtctgttctgaaaacagggaccctgtgggcaggcaggacaggatcagggttggtgttcctcccagtaccacttgtcacttttctcctgaagctgagtgaactcccatggactgccttgctggtcaggaaaggctaacagcccccactccacaaaacccagcttgttctggctcatgaacccaaaggaccaaaggaaggtgcaggcgagcacagcatggagacacacggaggtggacgtgcagccctcacactggtgcccaacacctgccagacggttactacagtgagaaggaagcctgagacttggctgcagccacccaccagacctccccaggtcaagcacgtaccccccaggggtggaaggtccatctgcggaagctggaacccgagcacagcctgcttcagccaggccaggtgctctggggcattccagtgcaggtgaggaagcagccggctgccccctgcctcagcaaactcagtgacaggccaggacaggtcacacagctgttcagaggacaccacagaagccaggaactgcagcacactgttaaacagctcaatgatggcgccaggctcctgagaagcaagaccgcccagacgcctctctcttctgtcatggaaaaagcggccactaaactcatggccaatcccgtcttcgacgtactgaatgagagtctggcagcagaggtcaagggaatgggggcagtgggaaaccagccactgcactgcttgcaaaacctgagaagaaagaagagacttggttgaacaattcacactgtttttcaaaaacagctttctgaaagggcttgatcccccaaggttgcccacagcaggtaataccagagtactgggctctcaactgtggtaggaaggggaacagaagtgtcctatgcagttgagtttagccttctagggctctggagacatgtccagtaggggcactaaagagagcccccagatcccacctggcctgaggaggagtgtgacctgcatggttgccccatggaaaggcccaggccctcaggaaaccagccctgaacatccccttcaccatgcacagaaatggagtcttctcctttttggaaggactaacagcttcactatgtgccaaggtgccttcacaccctatggttatcttacttcctatagttattttaattcctggcacctctttctctaaattgttagcaaagactccccctgccctattttttttgtttttgagaagggggtcttgctatgttggccaggctggtctcaaactcctgagctcaagcagtcctcctgcttcagcctccgagtagcagagactacaggtgcgaggagccaccacgcccagcttcagacttcctttttaaaggaaacatcaaataacattatttcttcatatattcagaggacaattaccctagaaaaataacttctgtatctgaccttcagatataagacatgttcatattttaaattcatagaaacaaaaacactaaaaaattttacatgaacaatttaatttgcagatagcaggactgtgggcaaattttatcttttattttgatttctgcttatgtttttagaaagttatctgtataaaacatacaactgctgccaggcgcagtggcacaccacagtagtcccatatacttgggagactgaagtgggaagattgcatgagccctgtagtttgaggttgcagggagctatcatcatgccactatactgggtgacaataaaaccctgtctcttaagaaaaagacaatgcaaacgctaatatacactcaattcaagatacagcaaaaggggaaaaaacaaaatatcttgacagaccattaaaaatgatgaaaccttaccttagttgaaccttgtagatcattaatggtatcagggatctcggtaacagtgtaatctgaaatcagcttagctgaaaccaagtcctgtagcatcagacctttaagacagacatagatgaaggtcacttgcattctgctgtcagcacacctgctaacatatctcactgtgctgaccccacccagtcctgcagtggacagtcaccacaggggttgctgtctcagtgattcctgaccccaacactactggaccatcctcagacccagggcctccacccatttattaaacaatgctgcttcataaacgagacttccttcacaaaccatcttctacttccttctcaacggcgtcccctcctgggctaggcacaagaaccaccagaggaagcgcaggctggaagggcttagcctgcaggagctgcttgagctgcagcaaggccgacagccagtacacgtcctcctctgccatgtcctcactcttcattttggggggaagcagcagcatgagcccactggctcccaggaggtccttctgtgtctccacagcatcaatggcaccatcactgagggcgccatgggccacctgcaacagcatcaagatcatcaggagagatgcaccatgggacgcatcagcagtgactgatctgccccagagcaagtgcagccaaagctctccgtgcactaaatactgactgtactccagacaggcctccaagggcacagctgggcataccctgtagttatcttacttcctgtagttattttaattcctggcccctctttccctaaatccaattgttagcaaagactcccctcaacctttttttttttttgagaagggggtcttattatgttgcccaggctggtcttgaattgctgggctcgagcagtcctcctggttcagcctcctgagtagctgagattacaggttcgaggagccaccatgcctagcttcagacttcctttttaaagaaaacgtcaaataacattgtttcttcatatattcagaggacaatcaccctagaaaaataatttctatatctgcccttcagatataaggcatgttcatattttattttatttttatttatttattttttgagatggagtctcactctgtcgcccaggctggattgcagtggcacgatctcagctccctgcaatttctgcctcctggattcaagcaattctcctgcctcaccctccctagtagctgggattacaggtgcccaccaccacacccagctaatttttgtatttttaatggagacagggtttcaccatgttggccaggctggtctcgaactcctgacctcaagtgatcagcctgcctcggcctcccaaagtgctgggattacaggtgtgagccaccgcgcccacccatgttcatattttaaatttatagaaacaaaaatgagaataaatgcaacagaattagtgcaagaaacagccaggtcaacaggtaatttagcctccagctagaattgtgtttgaccatattactataactttaattaaccttaaacaggtataaaaaagttaaagctaggcacagtggctcatgactgtaatcccagcacttggggaggccaaggcaggagaactgtttgaggccaggagccaggaattcaagaccagcctgggcaacatagcaagaccccatctctacaaaaataaacaaaaatataagcccataataatagaaagagggaaggcaagccagcagcagatgagggattctgatacatttctagaaagcagcaaataggtgtgaccaatccctgggttagggaagcagaggatgccatacctaaaggctgcagatgtgggtgtgtaaggagtcaggttgactgagcctgcaaaagccctgtatacccaggcgctgcagacaccaggagccaaaggtgaagttcagagcctgaccctattggcggcacccaccactgcaggcaacctctatgcaaaaccagtccccctgggcccctgaacaggagtcctgagaggatccagatgcagggccatggtcaggcacagtggaagggactcagcgccaaaccactcccaaccctaccctgagaataccagcagctccccagaaagcagatggcacaagtcctttccagaaaaactgaacagtctagggaacagccatccagatccagacatttgggagtccctccaaaaagcctggcttgccatttagctaccatccaccccaccccaaacacagaacttcttggctagccttttagggcctcactcagatatagacagatagccttgggtaaggcatctgaggagggcctccaacataaaagagataaactggagtaacagagaggaaaaaaaaaaaaaagaggaaccagataatacgtgaaccaaagaaaacttagaccccaaaaaccctaatttccttggaaagataagatgatgcatccaaaaaataagatgctatgaaaaagtcatgataaaaagaaagaggaaataagtaatatatatggaataaaaaattcagtaggacaattggaaaataaagtcaaggaactctttcagaacacagtaggaagagatgagattgaaaataggatagaaaataggataagaaactcagaggatcaattgatgaggcctaacatctatctaatagaagttcaagagagaacagaaaaaagacagagtgtcataaagacatgaaaatgtcccagaagtgaaataggagtctctagcctgaaaggacctgctaagccctgcacagtgagtgaagctagtccagtgccagtgtaacaaagtgaatttttaggacgccatgaacagagagaaaaggcttccacagagaaaaccaggccacacagaaaggaacaggaatggtacagcaacaatggatgctaggtgacagtggagcaaaactggaaggcaaataattttctttcttttgagacggggtcttcctctgtcaacaccggagtgcagtggtgcgatcacggctcactgcagcctcgaactcccaggttcaagcaatcttcccacctcagcttcccaagctactagaactacaggcacacaccaccatgcccagctaatttttgtattttttatagagacagggtttcaccgcgttgcccaggctggtctcgaactcctgcactcaaaacaatccgctcacttcggcctcccaaagtgctgggattacaggcataagccactatgcgcggccaggaaaataattttctacctataattttacaaacgtagctaaactatgaagcaaatgtcagaatgaaataaatgcattttctttttctttcccccagcttaaggtattttgttaataaaatcattttcataatggaaaagactcagaaaattcccctcgcatgacatataacatccaacaaggggctgaaccaagaaaaaatactgcagctgctgctaatggcaacactgagcaagcacctggcctgtgccaggcactgtcctgtgcagtctgtgtttgcactcattttatcctcaagagccagatgagcatctccaccagacagcacctgcagaggcttgggcagtttattttaccgtctctgagtaaaatagggataataagtaacagtacccatacacaggtggcagagacgctagggaacttgcccaaggtcacagagcttccaagtggaggagcagggacacatatgctcacaatgatggcactaaggcacatgttgcctggatggagaccagcccacagatgagagttccaggacagagggaacatggatggatcaagtgaagtgacagaacatttggaaaactctaccgagatatatacggccccccagtaaaattaaagagataaagagaactacattaagtgagacaataaggcaactctatttcttgcaggaaaaaaataattgtggttatagaacactactggttctgaggtgaatagcagtcacagagccatcaaaatatgaccccactcactgaagtaatacaaagtgctagtgtagctatcccgggaagacgtggaaggccgagcaaggaccatggcacaagaggccacgctgtacctagtatggtatgcagtggccaagaggacccccctgattccacctagtgttcatgcccacgtgtgatctcctgccccgtgagctgggcctagccactcacttctgacagacagaagccaacaaaagcaacaggatgtcacttctaagtttaggttataaacacactcagacttccatctaggctcacctcttgctcactctgatgaaagccagctgccatgctgtcagctggggagaggcccatgtggcaggaactgaggaagtctttggccacagcctgcaaggaagtgaatcctgacacaagctcactagagtgagctgggaagtagatacccttcagtcaagctttcagatgaggccacaatcctagccaacattttgatttccacccatgagaaaccttgagccagaagacccaagctaagctacacctggattcctgacccacagataccatgataacagacattattttaagctgctatgttaggagtaattagttatttaggaataaggtaactaatacatttatattaatgggaagtcagcagagaacatttaaatggataaactgagaaatggctgtgtaagtgtgtgatctggaaacaggagaaaaatgcagccctgaagaaaggagttaagagaggaaggaggagctactatgtctcattttaaatcacgtgggtggcattatttgacttctttttaagtacacggaagtgttactttcttaaatgaaaatgaaggtaacagcagcagtaaactaatttccagtagatgaaatgtgactttgtaatcccaggaaaagggaagaatttgcaccaagaagttactgttacctcagaatggcaagagcatggatggctcttatcatcatctttatacttcttttacatttcctcattttttaaaagttttgtgtacatattacatttaggaaatccaatatatagtattaaaacagaaaaagtaaagaagcaggctgggcttggtgcccactactcaatttgactggcttaaaaaaattttttaaacgacatgtacggacagacataatacttgcttctgagcctcccagtctttcaaaaccacattagggaataagcagtatttgcatggttccagtgatatctgggagtaagtgaaagtaatgaaaacacagaagtaaacacaaagtaattatagttcacctttatacacacgttaacagaaatcatctgatcccctttgctgctaagtgagttgaaaagcgaaagcgtctgaatcccaccagcatcgctggatgtgtcatccactgagccttcatctcccatgaacttgacttttaaccaatttgctagaattctacagatttaaaaaaaacaaaaaacaaaaaaaacacttgaagaatctaattctatatttgaattataaagactttcaggaaaagaagaaagaaaaatatcacacagacctaggtccacaaataccacatcttactatgaagctgatctgcacaaaacaggctgttgttttaaaatggagcaacgatctgtactcgttcttttttttttttttttttttttgagccagggtctcgctctgtcgcccaagctagagtgcaatggcacaaacttggctcaccgcagcaagcaaacctgcctcagtagctgagactacaggcacgggccaccatgcccagctaatctttccattttttttgtagagtgtcactcaaagggtctcactatgttgctcatgctggcctcaaactcctgggctcaagcaatcctccctccacagcctccccagttgctgggattacaggcatgagccactgctcccggcttctacttgttcttaattgggcaggaggagggggcactccattccattagaatggaactggctcattctaatgtgacttaaaattctgaagcattaagattttcagcaatagaaaacatccctagagtttgaaatacatgttttttacagatcaaatttctcatacctgagaccttaagaattcttaagtgacatacgaacttagcaaatgagaagacagctattttaagaaatgactcaccagctgggcgtagtggctcacgcctgtaatcccagcaccttgggaggccaaggcaggtggatcgcttgagcccagtttgagaccagcctgggcaacatcacaaaaccctgtctctacaaaatatatacaaaactaagctgggcgtggtggtgtgcgcctgtaatcccagctacttgggaggctgaggcaggaaaattgcttgaacctgagaggtggaggttgcagtgaacaaagtgtaccacacgccagcctgggcgacagagtgagactccatctaaaaaaaaaaaaaagaatacaggctttctaagtgaaaaggtgttctggaattattaacagtgatggttgcaaaaccctgtgaatatatctaaaaatcactgaaatgtacactttaaatgggtgaagtttatggtatgtgaataacatttcaataaagctattttaaaaataaactgtaagccgggtgtggtggctcacgcctgtaatcccaaaactttggtagactgaagcatgcagattgcttgagcccaggagttcaagaccagcttgggcaacatagtgaaaccccatctttaaaaaaaaaacattaaccaggcatggtggcacacgcctgtagttccagctactcaggaggctgaggtgagaagatcagttgagcccaggaggtcaaggctgcggtgagctgttatcacaccactgccctctagcctgggtgacaacaaagcaagaccctgtctcaaaaaaacacaaagagactgtagttgctttaaaaatatgacttctgtatgctatgtggttacagaaaataagatcatgtcaattttttcttttttaaaatgccaaaagtttctttaaggggaaaaaaatggaactatagtaaacagactataaactatcttactgaagagtctaaaatgaagcaggtctatcaatgtaccttaacacagcttgaaataacaatcaactcttaaatgcttttggtctaagactgttgccaagtaatatggtttggatttgtgtccctacccaaatctcatgttgaactgtaatccccaatgttggaggaggggcctggtgggaagtgattgtatcatgggggtggaatccccctggctgttctcatgatagtgagctctcacgagatctggttaagtgtgtgacaactccccctcactgttctcatgatagtgagctctcacgagatctggttaagtgtgtgacaactccccttcgctgttgtcatgatagtgagctctcacgagatgtggttgtgtgacaactccccctcactgttctcat

SEQ ID NO: 14586 - DNA, 27180 bp, Human
ccaaattttttcttttgataaggaccccagtcatattggattagggcccaacccaattacctccttttaacttgattaccctgttaaagaccctgtttccaaataagatcacattctgaggtactgggtgttaggactccaacatacaatttttggggggaggacactaacacctaagtcaaaaaggaccaaaagacataccatacaaagcaaaggccctctgccctgcaccttccctcttctgttctcattttaaatgtttctactttcatttcttctagtagattgtccctgtctttctaaatactatgctatttctatatcaactttctaatgttttcaactttagacattgctgacttcttcctatgatagatgagatcacttatccattcctctttttatgtacatatttttaaccttggattttggaaattgatcaaacctatacaagattacagaaaatagtataataaaccccaggtgttcatcaatgaacttcattggttatcaactcatgacaaattttgtttcatctctccctgccattttcccttctccttttactatatagatttattgccatttttaagttttctattgtttacttttgtatctttaagtaatatccctaaatctgtatttctctttctatgaactggggacagcgactattgatttattattattattattattatttttttgcgataggctggggcaaaggagacaatcctaaattgctaaccctaaattaatgtgcctacatttcctgccatctcccttcctcctcccagctttttgtcaactgttgctgcaggccaggttcccaaggaagctgactaagatgtagagtaatgtgcaggaagtttcttagggagtactcttaggatcaacacctgtagaaggggaggggagggaagaaatcaaaattcaacagacagagaaagtgggcagtctcaaaaaaggcttcagttaaccccacagggagctctgaagctgaaatggcctttcagagatgtcccaagttggggtaaggggctgcacctttgtaccttcaagttgaatcactgatgtgggcttcctgagaacaggggtgaccttggctgaggtacctatctttttctaagacaatttctgatgagggctaacgacagctaacagctctcaagccagctagggaaataaaatttttggtgttgaagggagatctgagcagtgcaccacagcaccatcacagctgtatttgtaccttcccattgtccattgttgtttagtcataattaagtcatctgggctttgttatagattgattctcaaagttgaaaatcaaactgtgtttgcagtattaggacggtataatagtattcagtacagtacagtgtagggctaggattccatctccccacaattgctgctctctctgtttggcgcacccttcttgcagacctcaatgcggcttgctccctcacttgcttcaaaattttgttcaaatgccacttcactagtgaggccctgcctggccaccccatagaaaataacaagcatgccccgcacccacgctttatttttctccagaccgggtatgcccaccgacactctctatatttttttattgttttaagctccaccaaagcagggacatagagccccagtgccaccaacagcgcctggtatacatatttgcgatacttaataagaattagttgaagaaatgaataggaaagggagtccctttagatggaggaagggactttctcaaaaggcctcatggaaggagaatggcattgaggctggcttacaagaagtgtgtcttttataaaaagaaggaagggcagggcttccaggtgaaaggcatagcacaagcaaaggcaaaaagacgggtaactgctagttgttaagggcagtggctgaatcgctatacccctagcagttctacacctaggggcctgcgggccgctgggtctgcgaagcttgcaaggcaactggcccgcccccgctctgcgcctgtctctcggccacgcctattgctgcaggatgacgcgcacctctagaacccgccccggaggggaggggacgcagggaagagtcgcacggacgcactcgcgctgcggccagcgcccgggcctgcgggcccgggcggcggctgtgttgcgcagtcttcatgggttcccgacgaggaggtctctgtggctgcggcggcggctgctaactgcgccacctgctgcagcctgtccccgccgctctgaagcggccgcgtcgaagccgaaatgccgccaccccggaccggccgaggccttctctggctgggtctggttctgagctccgtctgcgtcgccctcggatccgaaacgcaggccaactcgaccacaggtgccgcccacgccctccctgccatctcttctcccttcctccctcccttccttcctccttccttctttccttccttctttgtttatatccattctttttacccttcctctctcctaccattccttctttcatccatcattcgttccctccctccatttttcactccttcctaccgtcccttcatccctcccttccctctttccatctattcatccatccatctcctatccctccgtgcttcccttcctctttccccccatctttcccatctctatccatccatctttccccctcctttcctccctccattggtccatccgtcccttttaccttctatccattcatatttctctctcttctcccctccttctctccatcctttcttcccttcagctattcatcttttcctccttatcttcctccatccaaccatctgtcctttcctgcatacatcattctctttttttcctaaattcatctttcctttccaccatctttcactcactatctcgcttcctcacccaggttggaggccatgaccaaagcctaaccctgccacccaggactcaggcttcctcctcgagccccactcccacccttgctgaggcacagcgccctccctggctaggctgttaaggtgcagggtccagccttgggcctcttagtaacctagcacctaccatgagggagggttcagtgtcagtgcaggttacctcaccaaagcccctccctcctgtgtagatgctctgaacgttcttctcatcatcgtggatgacctgcgcccctccctgggctgttatggggataagctggtgaggtccccaaatattgaccaactggcatcccacagcctcctcttccagaatgcctttgcgcaggtatgtctgggaacctctagctgtgggtgtgtgctgcttcgtgcactgagggttgggggcggggagcttcagctattgtcagatggcacagattgtgcgggacatcttgttagagggaagcatagtctggaaaatggtagtggagaaaatctggttttccactcatgggaaagcttgaccttcaagggtggccttctccttgggtgcaaggtgcgccctggccctgatgtgttcatggcagccctggccagctttctcccagaacgggcgcttgcctggtgctcagaaggaaggggtgctgcagaagggcacccacaggtctgcaggctgggcctcaggtgagagctagccagggtggctctgctccctggaccccctcatggctctgcccccagcaacactggccgctctgtgtgcctggggaggccattgcgtaggaggagataagcaactgctggtttcaggggctgattgcttcccttttctctcccggaagcagtctgttgcctaggtgacacccaaatcccagtgtctggtttgagctctgcatgactcagctaccaagctgtttgctaggggcctcgggagggcggttgcttggttacctaagagatggcagacatgttttgctgtggcgatgcttacctctgcttctgctccctaacagcaagcagtgtgcgccccgagccgcgtttctttcctcactggcaggagacctgacaccacccgcctgtacgacttcaactcctactggagggtgcacgctggaaacttctccaccatcccccagtacttcaaggagaatggctatgtgaccatgtcggtgggaaaagtctttcaccctggtactgctccacgtccagagtctgggttctcttggtttgtggtgtctgaatccagcattcccatcctggggatggggctgtctttgcagagccctcttctggctgggcgagtccctcgctagtcagtgcttcctttctaaaaaactgacttgtcaacccagccacgttttcacccaaagtgaaaaagggtagaaagagctttgcttcctttcagaaaccactgagggtgtgctgttgggtctttcagctcctcgggtggtagggaggacacaggctggggaggtggcagtgttgggtggagtccagctcagggccccaccctctcccctgcagggtacctgtcagtaaacctaggggtggggtgaggacacctgagggcctcccgtgtggccagcattgctgttgctgacttattgcccaatgagggggctgtgcttaggtaggggctgctatccactctggaaattaagtcagaaagatgagtgtaatctggtacccaggatctatagggtcccagagacggacattccttacctcaaatgctgcctgataaactggctctctttaatgccaatatggggatagtgaaaagcaaacaaactttaaaactttttatttatagaagtaatgcatgagtatttgagaaaaaaaatggagaaaaaagtattggaagacaagagcaccatagggacaataatgcttatcatttgggaatgacgaatgttttcagtctctttccctttgctcagtggttacaccggcaggcttggcagccttctgcaggagctcagctggccagcccaggttgagagtgacattcagctctactaagtcaggccagtttcagaggtgaacctgtcaggaatcatattgcacagccaaaagtccagtgtcaggagaactttctgcagtttggtgttctcattaccataccccttgcccaaatgcagctggagggaagtgatgattttggagagaggaggaaacacagcagagggaggagattgtgctttgggaggggaaaccaggcaaggactgagtgatgttgcttgacctcctccctcctgatgattggattttggcaccaggctctaagcaccatgtccttctcagagaataaacctttccctgcagcccttgtgggaacacatttttcagctgaatctttgttctcaagacctttttctgttagcattgggcctgcttcaagatgacagtagccaccactgtgtgccaggtatgtaccgtttaccatgctggccactcctttaatcctcccaacagcaagcaaggtgggtttttatcatcatcatcatttcccaaggaagacatgaaggctcatgggagtcaagtagcttgccagaggttgcaaggatgctaagaggcagcatcaggatttggacctgtggttgttggcttcctgtgtgctctttccacagtgcttgctgtcttcataggccctccacccgctgccctctttctctccattcctgtctcttctggtactccctatgggagtcccactgtgtgactgctgctgatgctttctcacgaggttctgcctgtgatcccctccactcccagctaaccactataggcagcacttcccttcagatccctcacaggcctcactggctcctagaagtcctccctgccagtcctcacctgactcacaataacctctgtgcttggaggatcccccacttggcacttcgatgcttttgaaagctggaagtccttccttggtttccagtgctgttatactgtcttcacaaataaactataaactactaagcttaagggtgggtttctgcttcatgaatgagcacttgaacttggaattctaaaacaaggttttgagtcctggctcccttatctaatatctggttagcataggtaagtcacataccttccctgagcctccctctcctgcccccatcggctccctgatggtgctgatgcctctgctgcctccttcatagggtgagagataggtttcagcatgggctctaaggagctgactgatcttgtccttgtgggtcccttccacagagcctagcacaaatcatcagggcttagggaccaggaagtcagatgcttagttctcaaatagaaactagagagtttggctttagaggggacttttgtagatgaggaaactgagccccaaagaagggaggttccacttgcccatttgtttacagagttttaattatggggagtggggtgttgaaagactcatcatgttttaacaacctttttttttttccaagggatatcttctaaccataccgatgattctccgtatagctggtcttttccaccttatcatccttcctctgagaagtatgaaaacactaaggtaaggctgtgaaagggacatttctgaagaggaaccactttttcctttgtcacataaactactgggtatactgcatgttctgtgaagctggttatataccacgaagttgtgggtttcatttgtgataatgttttgacagaagtaagtgttgggatcttcagcattaggcccgacaggagcagtggcttcattctagaagctggtgggtgctacttgttctaaaaccttgggctctaacgtgtcagactcattgaatagctccccagtgctcacgctggatgagactgagagttgtaggagatgctgagacatgggagggagaaaagaggctgagctccaggagcctcagcccagaatgggagaaaggcatgccgtgtatctgtctctgacctaatgtgtatgttcagcagctgagacctctgataggggttttgaatttttagagcattatgaaaaaaagtaacctacaaagaaaatcttggtttagaggaatcccaaatgtataaatgaaactaaaacccacatttaagaaactcagaaaaccagctagggaactgagacatgaaatgtatctctgaggttttagtaaacatcgtgttgggaagggtgaggatttggaagtgaggtggaaggtattgttctaagttcttgacagctttccatttcagaatacagtgaaaactgtgagctctggcctttggcttgtggcttgaatagggaagatcccatcttaattccctgaagccatcttgcttctttttagtggcctcacttacgaatgccaggtccctgccctaacttccccctacccatttcttctcaaagtggtgggtctgacaatactaaatctccctcgagtgctgcaaatcgtgtatatatagatgatgaacaagtggtctgaggcgggtgctgggctgtcctgcccaagggtggggtgagcaaggcagggctgtgaaaaggcaacactctttgagatggaacagcagctgacacagcccctcggtctttgtggtatacaaatcatggtcagaactaactttggtctcacggccagcatgtctactttaggaagcaaagcaggaggtttcattctgtgcctagtgtagctgaagttctggaaattccatggactgtcaccttatcaagttgattgggaccctgtcacttacaagccttagcctgtctttgaaatttgaaatgggttttttttttctttttaaatttttaattaaaatagagttcatataccataaaactctcccttttgaagtatataatttaatggtttttagcatactcacggagctatgcagccatcacccaaatcgatcttagatcatttttatcgctctcaaaagaaaccctgtacccattaccagtcgttcctcattttgtctcagcacccagcgtgggacaacaactgaactatttttggtctccatggatttgcctattttgtccatttggtataaatagagtcatacactatgtagccatttgtttctggcttctttcacttagaataatgtttttgaggttcagccacataacagtataaattggtacttcattcctttttttttttttttttgagatggagtttcactcttgtcacccaggctggagtgcaatggcgcaatctcagctcactgtagcctccacctcccaggttcaagcgatgattctcctgcctcagccttccgagtagctgggattacaggtgcccaccaccacacccagctaatgtttgtatttttagtagagacggggtttcaccatgttggtcaggctggtctcgaactccttacctcaggcaatccactcatctcccagagtgctgggattagaggtgtgagccaccgcacccagcctttcattcctttttatggctgcataattgtctattgtaccacattttgtttatcagttcatcacttgatggatatttgggttgtttctacttttgactattaggaataatgctgccctcgacatttttgtacaagtgtttttatgggcatatgtttttaatttttttgggtataataactatgtttaactgtttgaggaattgccagactggctttcaaagtggctgcactattttacattcccaccagcaatgtgagagggttctaatttttctgcatcctcgtcaacacttgttattttccatcttaaaaaattataaccatccttttgggtgtgaagtggttttgatttgcatttccctaatgactaatgatgttagccacatttccatgttcaattggccatttgtatatcatctttggagaaatgtctatccaaatcctttgcccatttttaattggcattttttaattgttgaattagagatggatttttttttataattagtctatcggggtttcttttaattagttatgatctggagaaagagtattagtagcaagaaaccaagtgctagtggatttctggcccctgcctggaaaacaagaaacaccttttctgtcttagttctacttctgatgtctctgttcagtctgagtgactaacacgtgaagggctgattatgtgaacattaaatctgtgtgtgtagccttcatggcttcatttcttgcacttaaaaagctgatgttatattattttgttttgaaagacatgtcgagggccagatggagaactccatgccaacctgctttgccctgtggatgtgctggatgttcccgagggcaccttgcctgacaaacagagcactgagcaagccatacagttgttggaaaagatgaaaacgtcagccagtcctttcttcctggccgttgggtatcataagccacacatccccttcagataccccaaggtgaagagctggttgagggctgatccagcacagctgtgacagctgtgttgtttgttgagggagggatttgcacagggaaggtggctacatcctgccatcgccaggcaccatggttgcctgatgggcactagtgtcctcagtggagtaaagatgggatttagaggtcaaggccaagaacatgtaagaatcttgtaagaaatgcttggctttccgcttcactccactggagggtttgatttcctttccttgaacttattgagcagatgttgggttggatggtgagatcaccacagagtagtgaatcagagctggctgccaaagcctgtaataagggatggcccttccaaaacagccccagggaatgtgaaactctcttcaaaaactgcctgttccccctgagcctgtcaggttagatcatctaaacacaaagcactgcattgcttcttggaacctcaaatcctgtacttgcttgtatgtcatttagagcatgtagtcttttctgttttagaatccttttccatttttccctatcatgttttatgagggcctgagcatcccatccttttgactttgcagagaatgcccctcacatgtaatgagagtagagaccagcagtatgctctttgatgttgcaggtatcttgctttgattggcccaggggatcttgctttcctagtaggagctgtcagcccccttgatagaagaaggctgtgaggttcacctctcctgcctctttgcagaaaacagttaacaaagctggcctggctgtgattctttgaaaggcctgcttataagtctagcccttggctggcatctgggaactttgatttctgaagtgttctcactattcccagaattggcttactatgcttaaaccgtttagacaaacattatggttgatgataaacccttgggtttgtttttttttttctgggagcctggaattttgatatgttccagacagatagtacctacctgaccagccccaaataaaaactggataatgaggctttaatgagcttccctagttagcagcatttcacatgtattgtcacacaactcgttgctgggagaagtaagtatcctatgtgacttccctggaagaggacttgaagcttgtgcctagtttcctctagactttgcctcatgtgccttttttctttgctgagtgtgtttcactgtaataagtcatagctgtgagtgagactaaatgctgaatcctatgagttcccctagtgaattgctgaacctgagggtggttttgggaacccaacacctcaccacacttttctagccaggcaggaggtggggacaggaacagaagggcgtctgtttgtatgaaggaagagagttgttgctgctcagtttgtaggaaacagaagtcgtatgatttcattgccattggcatctcatgagagtaacttaaggctggacttccaggtcagggccgagcacgtggggaatgctagtgagccaccactcaaatgcatcccaggcttagagaaaaggcagtatagacagtgatagagccacaagcttgtgcttttgctaaaagagtgacaactttgtggctttgtgtttttccccaaggaatttcagaagttgtatcccttggagaacatcaccctggcccccgatcccgaggtccctgatggcctaccccctgtggcctacaacccctggatggacatcaggcaacgggaagacgtccaagccttaaacatcagtgtgccgtatggtccaattcctgtggactttcaggtatcaaggacatagtttggggatgtattggacactgatgacatagtgtcgtaggtgaaaccactcttctcagtagacacaactccacctataatgtcttattaagagctttctttgtgtgagttatcaggcaaagtgctggggtggaggtgtcctataggtatttaggacacaggcagtgttgcctggatcaggactctcccaaccagtgtcttactttctaaagaagggaatgtccagagagttggtgacttgttgtgtgtggacacagaggtggggaaccagcctgggtgaccgttcctaacccaggggatactgttcaggtgacagctcattaattgtagagtgatgggcaactcccgagcagcccagaatgcttggtttgctggtacttgcaggttccctctgtgggaaagcccatcctggctagctgtcactctcagggggtggcttggtgaacaggcccttggtgcagagggaactgggacaccatcatggccagtgccacccagctgtgatgtccggcattcctttgccatgatttaggggcggagcaaccacacaattagaatcctcacactgactcatcagtcaccctttctccctggagagcagaatacacattgactaatgctctttctggaatattccacacagaaccctgcccttctcttaccacatgaatgctgtggcaggcaagctatagcggatggaagatggcagtgttttcaaagtgtgcatcctggactacctgccttagaatttctgggagggcttgttggaaatgcaaagtcttggcccactcagatttacacaattggaagctggaggtggaacttgacctgacaaccgacatttcttaaaaaaaaaaaaaaaaagcacaccaggtgattctgattcatcagaagtttgagagcctctgctgtagagtattgtttaaagcaaacacagaacaaaaccactgcatacagatatcccttgctatccaaacttacttggcccctgagtttgcacaacaagagtttggttggtgagaggtgtacattcctcaaatgtatttgattcctgtttcactgagagtttggaaagcaatgcatccatctgtttgttttctaattttgtgtttctgggctcctgatggtgaagtggcttgaactggctctgaggctgcacctggatgctttattagtgatggtcacttaaaatgacccttcaaaatggactgtgtgccaggaagggcgctgattcatgtgtggtatcgcctttagtcctcatggggacttagtgaggtacctgctctctgttgtctaggtgaggaaactcaaggcatgggaggtgtgctgacttgtctgacagcacaaaattagtgctgggtggagccaattcatccccagggactgtaactccaaagccccatggttggatctgttggttcccagcagtgtgggttcgaattcatgttctacctcataccagctgcctaacctctgtcaagtcatgttacctccctgagcctccctgagttttcttctctataaaactgaaacaaggtaggtaaagtttttccatgataacacctactttagagattttcagcaagaaccaaagagagcatgtagaagtatctaggaccgtgtcggctgcacggagctatctccttcaagttctcttagtcccctccttacacacagtggacagcatgactcagagggcctccctgatgcctgcatgtgctggtctcagccctgtgttccccttgaactctggcctgctcactgtcctcttgtagctttggatgtccgcatccaagcccatctcactgcacccttgagactcagctctgggatctcttcagctccagccctctaactcagctctacatgagccagtgacctcaggggccacactcaggagtttgttgcctgctccttccgagtcaccatactgaccacaacctcttctcctagcacttcccttgctctacctcacggggattgctagagtatggatttctatctcccccttgtgtccaggtcctgttggctttgttgcttccctaaatagctaaggcctggtggcaggtgacttactgtacttcccagccgcccagctcaccatacttgtccatttatccttgcccctcctgcagtacctttatcgtcagacactccagccacaccctctgctctgtagtccaagtcctgaaagctgctggagaaaatccatgcccccacgaagcagggaggccctcagatgccccgcctccagccccagcagcccaggcaagctctctgctcagctcacctcacttgtcctctgcagctgctccgtttgcatgacctcttctctactccctttcactgctcccctccaggcctttgccacccctgtgccccatttctcagtggatagcacctttcctcttgtagaaatggaagctggtggacagccagaggtaggggatcggacagggtggatgtgggtacgcatcctggctgtgccccttatcagctgtgtgactctgggcaagttaacctttctgagtcttggagtccttaatgtgccgttcacaggatcagatgccacctagtgtgtacttgctgaatgggctctattaataatctctgtcactgagacctggaattttgtgtatgcatgttctgggctcgaggcctcttccctcaactccccaccactgtccctgcttcccacgtctgcaagcagaatgagcaagatcttccttctcacctacctaccctgcagcctctccatccactctcatccctcccagctgcaaaagtgccagcccccttgcccctgcctgtttctgctttccactccttcacctgacctccaaggcagagcgagtgcacactgggctgttctggctgtgtctgtggcctcattgtccatttgttcttcaccatcctctacacaggcttccacctccccaatccactaaactctcacctcagcactgaccttggtggccagtaaaatctatctgtgtaggtcctgaccttccttgagctctgtgtcacttcctcactgttggccagctccaccccttctgggactgttggcctcccaatcctttctgtgtctgccacttaggtgccacttcccaggccccccactatatcctttccacctcttcttcccctgctgggctcagttgagccttggcagatgactccagaactaccccttcagcccaggtctctcctgattttcagatatgtgtgttgacctgcctgtgagagccattcctaggcagatgaccctggagacctcagctccataggcttccgcgtggtcaggccaccacccctgccctgccttttctccttcctcctcctcctcttgcgccccctgcccccaaatgccagcgaattatgccaccagctgaatgtgaaacctggagtcacccttgggttcctcaacacctcctcctcctctgctccctgcccccatgtctgcttgatgcccctgaattcctctcacatccacacagtcctctggatccttcagcacattgttctggaccacctcagtgggccttgctttgttttgttcattcagcaagtgtagtgagcacctcttatgtacccagcagtggcctagtaccattttgtctaaagcctctggaatctgtgtctgtgtcctgttgcaacaggactcttaataacttgaagcccagatcatgtcaatttctcgccttgaaagacctcagtgactccattggcctagaacttggagtctccactccctggatagacccaccaggtccatattatctggcccggacctaactttctagtcacccctctgccctcccatttgattctccagtcacatgggcctttcattggccccaaatgcaacctgctctgtcacaactccacactgttccgtgccctgcagcccctgcttggagcatctgagccccatttgtctgactgcaggtgcttcttgtcaaattctaactcctctgtgaagccttccctgaatctcccaggcagatttgagggcttattcccctgtgtcacccctgggcctctgtgggggatcggtcagagtggtgggaaaaactatagggaaaggatgcaaaccttctgaaaggtcagaaggttctgcagagccccaggggagaatagctgttctataaccctgaggcagagggcaaggagtaggtacaagggagtgtgggagaatttatcttaaacaggcttgtttacttatgttgaccaggaactgacctttgatcgtctgtgcttgtgaggttccctgaaaggggaacaataaatgttaattacctgcaggttggctctaggtttttggcattatgcctgcactgaataaaagccagcagctccagcttctcggggctgctctctggccactagagccaggcagtaacctagctgctcttatgctgcatacctgtgtctgagtactcatttcatccataggccagggtctgcaggacagacccagcaggcctcactgataattaagcattttcttgtctccatgattgtgtcctcactggatggggtggctcatcaagggtgaggaccttgtctgcttattgccttacgtccaggggctagcataggaaggagggaatacctttgtataggacatagccatcctgacaggtgtctttcatccccaggaggaccaaagttccacaggtttcagactgaagacttcatctaccagaaagtataagtaggccagggctcagcataatcctgctggaaggctagatgtatatcttttctcttgactgcaagtgagaacgggtgagtctcatgattgtcctcaccctggcagtgatgagaagaagctggtgggtccagctgataagtcaggggctggtctgcgaagacacggctctcttctcacccctctttggggtggaagattaatttttgtccttagcatttgtgaaccaggttgggaatgagagtcagcccaggaggggccggtggctcatttacttcagggcatgatctggctgttcccaaagtgcctcttgggttcagggactgtgaaggacgtgctgctctctggtatctcctttgctcttctcctgcctgctgacagtttgttagaaatgagctccacgtaacggccatagttcatgaagatatgcagttgtaatctgctgttgggttagcaagtgatcagagggaaaggctcagtcagggttgctgttatgtgttaaattatgaatttttttttccctgaaaagggctgttgacatcctaaccccccagtactgctgaatgtaaccatatttggaaataggtttattgcagatgtaattagttaagatcaggtcatattggagtaaggtgggctcctaatccaatatgatcggtgtcctttaagaagaggggagagagacacgggaagaacacatgaagatggagacacagtgatacagctgcaagctgaggaatgccagggactgacagccaccaccaccagctagggagaggcaagattcttctacttagagccttcagggagagaatggccctcccagcaccttgatcttggacttctagcctccagagctaggagacaatacatttcagcttaaaacaacagagcagtaggtgacacattcatccactgtgatctgtgccctaaagtgaaatctgatttgcttagaaatgtatcttatttgtagacctacagattttgctgtgactctgtgggtgaagtgatgctgatggtagggaaaggagtgttacattttggctgagaaaatcattaagggcatcaactaaggggtagggattgggagagatgcacaggcaagcattatctctgtatgccttggcaatttaaattgcagtcactctcatttttattttttttcaatttgcagcggaaaatccgccagagctactttgcctctgtgtcatatttggatacacaggtcggccgcctcttgagtgctttggacgatcttcagctggccaacagcaccatcattgcatttacctcggatcatggtaagcattttgaaattccctggtgagtcaaaacatctgaactttcctgtgaaacatgctttgcaaaattgccattgacataaacatgggtgtgttctcttttgtgaaccagtggttcacaaacaaagtgggatcctggggcatttttatgatcagcttgttagtcctgagacctctgtcttagatgcttgacggataggtgtgggtgggtgggggagggtcttgtagcaacttttttttttttcttgatgaatgcagcaggaaccctccatttgtgtggcagagctcttgtaacccccatttttaacctggagggttggaggacttttagtttgggtggagaggatccagaacaatcctggcagagcccagcaagctcttcacgcctggctccagccctcccacccctatccccgctgtcttctctgccgagagcctgggcttttcaagtctttatctccccctaaggctgtttcctacttttccaaaaatgaaactatctttttaaaagcattttttaaattcttcaacattccaagagcagggaataaaacagcagctccccccgtttcccactcacatagtcttgttcctctcatcctcacccactcccccatctctgaattgtttcaaagcaaatcccagatggttccattttccgatcactgtctctgaaaaatattgcctcttttgaagtataaccataatactgttatacttagagaaaggaaaataattttcatatcatcaaatatgaaataggataatagtaaatcataacatgtgcttatcatgaaaagaaaaaaggatacagagcatgtaattcagggccagaacatcctgcccttttctcccacctgctcagggctaacagatgacaatggattagggatccatctgccagccatcagttgtgcacatatgcacacagggatatatgttatacatgtgtatgtttgtaacatgtatgtcacaagatgtgattgcttgttctgtgtgtactgttaacgttccctggttttgtacacttaatgtcataggcaatctctgtgtcatttctcagaagcctaccttttcccttagaaatgtctgtaatattttattatatatggaggtgccataatttttcacatattcctgattatctgccatctgcttctgagccctcggtgcccagtttcctcttctccacgaacacactctgttgtgaggcagttgccgtagattacaaatagcccatctcagagtcccctcctgggacatcctccatcagaaccgcctgggagccagtaaaacatgctggtttctgcaactggtctcaggagctcgcagttctgggcatgggaaagtgcactttaacaggtgtctcaggtggtctggccacctctccctgagctcatcattccctgggcctccctatgttgccacgtcctcatcttgggcctctggggcaggagccagaaacctcctgagctgcctgtcaaggtcatcgggcttgttcctcctgatctggagatggatccttggggcccacacaggcacgcgttctccttagccagacttccccgtatttgctcctggctgcagcagcacaggctgaggcccggcaccagatgttcaatacgatcttgcagtcaggcggtccacagctatttctgtagcatttgccatgtgtcagaccctgtgccaggcctgggggccccctctgcctggtgcagggcagctcacaaaagctggcagaggccgaaggctgcgtgccagtattcagaatgccacagagcgcctggctgctgtaccttcagagcctccacaggcaccccagtcagagttccgggagtggattcctgaggtcgcactgccaggttccctcacgttgccatcctgcaggcttctcgatccttgaccttttagattcccgccacactgaatctaaaagggacaatgtgacctctaagctggtggcctaggagcctgccgataacctacccattcatcagccctcgtgggtcaaggctgcctcgtcctccccgagagagtggagaggtcgagcagtggggatgcccctcaggccccggggcttactgactggggcgggtgtcagggggaactccctctctttctgagctccactgagctatctgaaagtccccaccatactccccagtactgacagccagagggaggaacggctcaccagaatcattgggcatctctgatgggcatcaagtctgctttgattattgatgagtgggtaagagggtcctctcaacttggggtctccttgggaaagcactgtcaactcagaacaggtttcagccctgttctggagaccacaggccctggaaggctgggacatcatttgcagccccagcgtcatctattagacggagccagcaaggtctcatgctgtgcggtacatttcaacactttctcaaatttacccgtggcagcttttggtgtgtttggttatttttataacactactcactgtacaatttctgtcatgcacattttttgtatcaaaaagggtgctgtaactttaaaagactgggtatttccaacttggaatattcaaaccatcttttgcaagggatgttttaaataggcatgaagggttgtttttaattgaggttaaggatctgaaatgagaggttttggtttaccctatctatggtatgtcttaaaaatcaacgaagatgtccttgtcttttttgaatttgccgagtgtgttgcagttccacagctcactgttaggtggcacataccccaaactgaaaacctgacctcgtagggcatgagtcaaaagacaggtaggcacaggacagggcagtggtgacactacagctttcagggttcccagcctgtcaagaatgagcatgtcttagcaggggaggaacgcatgtgtgggaaccgccacagagtcctacgttaggtatatgttgctagtagtttgttaagatatttgagtttgggaatttaattattttttcttttttaaaggtttcctcatgaggacaaatacctgattttgaataaagcagcattcagttgaaataaccctttctgtggtaattccaagtgaatatttttcttctaggtgatgagtttctacttcctctggtttttacaacaggaaatgaaatggtatctaaaataaacaagctgtggtatgatgattattcattttctgtcattctgtgctttttatgaactagggtgggctctaggtgaacatggagaatgggccaaatacagcaattttgatgttgctacccatgttcccctgatattctatgttcctggaaggacggcttcacttccggaggcaggcgagaagcttttcccttacctcgacccttttgattccgcctcacagttgatggagccaggtataaaatatgctgaaatgatattgcttgacagtaagatcacctttagtttatatgtgaaccactttattgaatcataggctttgggggttacacagacccccccttcctgccttgtgttggaatttcttctcaacattttgtggtcagcacacgctttctgaacatctcccatactctgggcggggaaagagtgacagaaccagaattgacaagtatggcccctgtccacaaggagccttgtgggatgatgatggacaaaggaacaggtgcatccccaagatggggagggctgtggtacagtctacaagagcctgctccagagcttagagtaaggggctgcccccgtaacagacgaggagaatcctttccctcgatgcgcacttttggtagggactcagccttctttgtggggggcacattttccattttgacagctcatcaatctagtgaaccactagatctgtaaaatctaccaggtgattctactctgccctccccagcagtgaagggcaagtttactttgacttccatgtgccagtccttcaaagctttgaaaacagcactgatgcccccgaccctgtccatccaccaatatcttctcttctctaggctgaaatccccagcccttcaaccattcgtcacaaggtagtgtttagacgcgtggttgtcctggtctctgtcttccaaaaagtttcagtttgagaaagcacttccagaataccagttggaccagatacccctcctggatgtgtgggcaacctgtatgggttcttgtgagttctatcctgacttgatctgcccagtgcatttcagggacaggttgtacactgtctctgaaatgacgtatgacgtttgctctttttggagtgcctcttctatgaactatgctaaaccagattgccccctttctggacttaagcatttaatccatccttaacatctaaatcttgtactgtatattgattcctgtttaaatttgtcttggttctggaccatcattcgggcctttctggatctttctgagcttgctttatactacccaattttattttttgcactttgatttttgtgcactgcatgtcctgtcttctttcatgtcattgatagaaaggttaaacagtttcaaggcatgattttagccctttgtttgctgggaaagatcttctgattggttgagaatcttttctgaaacttttgttgggaagtgttcagcaatttagaaattgatgtaactgcacggcctttcagtttatttccaaattttatctctagctgtgtcttttccctgaacttcagacttttgtttccaatagtctttcccacttagccagcctaacatatccaaagctggacttcacatctttcatcttcagcttttccttcaacactcttcttgtcctcaagaaatgagaatagtcactcatgccaaaaaatcatggaataatctcaacccctgttcttctcttactccatatgcaatattcagtctatgagaaagcctgtcacactccattcagactctgtgtaccacttcccaccacttcgcctgccactgtcttggaccagactgccactgtcttgtgctgaagtactgcaagagcttgctaaatggtccccttgcttgtgccctggatcccttggaggttttcctcctcagagcagccacagtgattccattaaaacccaagtcaagtcatgtcacagcccggcacaggagcctcttatgtacccttcttgatctgagtaaaagtcgtcacagtggccttacatgttctggccccattatctccctgacctcatctttttataagtatccaggccagttgtcctataacagtgtcccacagcctggatttatctgattgcttccacatgactacattcagggtaacatttttgacacgtgtgctacatgggctgttgtattctcccattgtgtcacatggtgggggcacttcatggccagcgttactagtattgtaagtttgaacactcggttgaagagctagctagcatcagccagatcttgccattgtaaaggtacctttttcaactttctttacttgttttctttttattttacttaaaaattaagtgtctagaaaatgaaatcaagcatgataaagcactgtcttaaagatccagaagggccagaatggtagtgcaaatccaatttcaattttaacaggaatcaatataaagtacagtatttagactttaaatatggatgaaccacaatgaaatactacttcatacccactaggatggctattaataaaaaacaacaacaaaagctgtgaaaggctgggcgtggtggctcacgccagtaatcccagcactttgggaggccaaggtgggcggatcacgaggtcaggagatcaagaccatcctggccaacaaggagaaaccccatctctactaaaaatacaaaaattagctgggtgtggcggtgcatgcctgtaatcccagctactcaggaggctgaggcaggagaatcacttgaacctgggagacggaggttgcagtgagctgagccgagattgcgccactgaactccatcctggagacagggctagaccccgtctaaaaaaaaagaatgaaacaagtgttaagagtgttagtgattatatggaaaaattggaacacttgtgcattgctggtaagaatgtaaaatggtgcagccactgtggaaaataatttggtggatcctcagagttaaacatagaattactctatggcccagaagttccactcctaggtatatatccacagagctgaaaacaggtattcaatcaaaggttgtacattactgttcatagcagcactattcacagtaaccagaaagtggaagcaattcagatgtctattgacagaagaacagacaaaatgtggtccgtccatgcaatggaatattattcagtcttaaaaaggaaggaaactgacacatgctacatcatggatgagccttgaggacattatgctaagtgaaaaaagtcagtcacaaaaggacaaatactgtataatcccactcctatgaggtatctagagtagtccagttcatagacatagaaagtagaatggtggtttccagttgctgggtgaggatggagaaaggggagttgttacttaatggggacagagtttcagttgtgtaaattaagaggagttctggagatagatggtggtaatgatggcacaacagtataagtgtacttaattccactgaactgtatactaaaaagtggttacgatggtaaatgtcatggtgtgtgtatttgatcgtaataaaatgcaaagataactctaatgcagacatccagaagggagtaatgtgtggggtgatcctgtgggagtcagaatatcctgttcctcaacagactcttttacctagtggttgtagccttaattgatgatccttgtctgagtcagttattaaatcggtggttccaaaattcaggttgttttaaaaagcgccaacagcctcgtggggccctaattttgcatcctgctatttgattggatgagtaattaatgcagggtgaggtgccgaggtggtgtttctaaacgtctgttgctaaagataaatgttgtaaattaaaaaaagaaaacatatggagcccagacaggttcctttactgctcctgcctggccatggcaggcttttataatgtaacccattctgctctgtcgcttcctgtttcaggcaggcaatccatggaccttgtggaacttgtgtctctttttcccacgctggctggacttgcaggactgcaggttccacctcgctgccccgttccttcatttcacgttgagctgtgcagagaaggcaagaaccttctgaagcattttcgattccgtgacttggaagaggatccgtacctccctggtaatccccgtgaactgattgcctatagccagtatccccggccttcagacatccctcagtggaattctgacaagccgagtttaaaagatataaagatcatgggctattccatacgcaccatagactataggtatactgtgtgggttggcttcaatcctgatgaatttctagctaacttttctgacatccatgcaggggaactgtattttgtggattctgacccattgcaggatcacaatatgtataatgattcccaaggtggagatcttttccagttgttgatgccttgagttttgccaaccatggatggcaaatgtgatgtgctcccttccagctggtgagaggaggagttagagctggtcgttttgtgattacccataatattggaagcagcctgagggctagttaatccaaacatgcatcaacaatttggcctgagaatatgtaacagccaaaccttttcgtttagtctttattaaaatttataattggtaattggaccagttttttttttaatttccctctttttaaaacagttacggcttatttactgaataaatacaaagcaaacaaactcaagttatgtcatacctttggatacgaagaccatacataataaccaaacataacattatacacaaagaatactttcattatttgtggaatttagtgcatttcaaaaagtaatcatatatcaaactaggcaccacactaagttcctgattattttgtttataatttaataatatatcttatgagccctatatattcaaaatattatgttaacatgtaatccatgtttctttttcaaatctaaagttaaaaaaaaatagcagaagccagtgtcttaaagtctatcttttgtttctaagaccatgggatttcataatctcaagataaaatatgtatgaagtaattaatgtagaatttttacaccaaataataaataatgcttaataaactagagatatgagatgtgtaggaaatttggttaaacttttttcagatactttctggcccaaataataatttgttagcaaataatatgacccttgaactcaatggccatctattaaaagactgttgttcacactggaaaacatttaaagatgtgactatatccatgggtggattgaatcactcaaaatatattagtatccttctttagggatggttggttacagacatgtatttattcaggaggcagaaaatattccattttaattgcttattaaagaaaacattaaattctaaattattttgaggactgtgaagacttttcattagtgtaatattaggtcattgtcaatctcccagaatgtagttctatattctctaaatatgaaagtatccagaaaggccagtggtagtaaaaagcttagtgtatataatctcaaaagggatggaatatttacaactcatatttataacatgttgaatcttctcagttatcagtagtcatcagaagtgtcaatagctttctaaataaatattaaatatctactgtcctgtagtgaaggagtaatttttagtaattttctctttacaaagtctccagtgtttccaggtaaatatttgtgaaacaaaatacagcaaactacattgttacttcagtgtattgttgccaaaaatgacaagatattatattaaaatcagtaaattttagacagattttaaaaattaattagcctacaatagaggttatatggtaacacggtgatcttctaagcagttaagtgactgactgttctggcaacaacgacttctccgtgactgaagggccctgttcatttcctgatcctgaagctcgtctctcttttgagcctccgcttgctttggtcgatggtttccctcagctttttctttgctgttcttcatcctcgttgttgctgtcatcatgttcactgtggcttttacaatacagcctgtaaattccttatgacatagttcagtgcatttggctttattgcctgctccacagttctttacctttacttggcttagagaaactgtatctttgttgcttcatataacctttccccaaccccactaagctggacataacttattagtggtcctcccgtcactttatttgtagaaatctctctttcacatgagcaggggttctttcatgtggtttagctgacagcagaactagtgattctagacattttgcatggccctcattcagtggctcacaaacatgagggagcatcagaactacttgaggggcttgttaaaacccagtgcgttagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtgtggtggtgcatgcctgtaatcccagcttcttgggaggccaaggcacaagaatcgcttgaaccaggagacggaggtttcagtgaatgaagatcgtgccattgtattccagcctcggcaacacagcaggactgtgattttctttggagactcctagattttctgtggttttgaactgaatttgttggatgttggcaagtgcctcttatgagctgtttctttatcctgcatttgccccacaaagacttatctggaggtgagcaaagtatgtttggtagtgaggtcacaaaggcaatcagccccttcctccccactcccattgccatcttctcagtccttctccctttctttccaagtagtttacccacccctcctctttcctcccctgtccctaaaataatccacgtgtctt

SEQ ID NO: 14587 - DNA, 27180 bp, Human; identical to SEQ ID NO: 14586
